United States Patent 11,001,841 (CCCTC-BINDING FACTOR (CTCF) RNA INTERACTOME) - sequence listing, part 4

SEQ ID NO: 7731 - DNA, 1028 bp, Homo sapiens
ggcattaggtggggtcatatatagtcttcatttgtagaaggagacacaaatgatttgggacagaaactgaggctatcacagctcagaagaagtaatgaaacttgtggaggaaagctgaagaagactcaagtggcatggagtgaggttagtggagctccatgtctctgaattcaagggactctcccacagtctgcaaatatttagaaataaaccagagacctttggaagaagaagagagtggggaacaaggcagagatcatattatgtgtgttattgtgggggatgacttggaagaggagagctacccctaggtagtttctatatttccccaattatcttatttttttttctctttttaaaaatagttcaagttgagatcaaaataaagtctgcatagtatgctggtcttaaattttttaagtttctaaagtttcttctgtcttctcccccttctctgtcctctgttctctttctcttattttcttgtacttttttggctgaaaaaaataagttatttatcctgtagttttcctcagtcttgattttgctgattacatacctgtggtgtcatttgacatgttcttcttttcctatgtttcctacaaatgagtggttggatttagaggcttgatcatatttaggtttgaggtttttttttttttaattttttttttttttagtgcaattgcctcacaagtgatattgtgtatatccatcagaggaacataatgtctgttagtagcaattggtggtcattgcttagatccattaagggttgaaagatgttgatatccttttttaaaaatataatttcttctttaattgctaaaatattttgaaataaagaacttttcctctgctcactttttgttacactgaggtatactttaaatagtaaaggaaggataaatgcttcattctttccctttctcaattttcttcttcttttttttttttttgagttaggagttgttttttttgaggctggagtgcaatggtgcgatctcggctcactgcaacctccgcct

SEQ ID NO: 7732 - DNA, 1026 bp, Homo sapiens
tcacatcccacaaatactgtatatatttttttttttttgagatggagtcttgctctgtcacccaggctggagtgcagtggtgcgatctcagcactcactgcatcttctgcctccttggttcaagcaactcaattctcctgcctcagcctccggagtcactgggattacaggcgcctgccactgcgcccggctaatttttgtatttttagtagagacgggatttcagcatgttggcctggctggtctcaaactcctgacctcgtgatccaccagccttggcctcccaaagtgctgggattacagacgtgagccaccacgcctagccaaatactgtattttctatctgcttttagtaaaaagacatctgcatataagaggacccatgcagttcaaacccatgttgtttaagggtcaactgtataatcaatatgccaagaaaagggagaaaatgaaatcatataatgtgctcagttaaaaccacaaaaggcagaaaaagtgtaaaagacggaaataggaacaaagaacaggggccacacacagaaacctgtaataaatatgatagatactagtccagactatatcaataatcactgtggttaaatataccaattaaaagacagagattagtagagtgaattaaaaagcaagacccaactatatgttatcaactagaaacccactttaagtttaaagacacaaagattaaaagtaaaggaatggagaaagatatatcatgctaacattaaccaaaataaactgagggtagctatattaatagtagacttcagagcactgtacgttatcagggataaataggacgtaatgacaaagggtaagtaatccaagaagatacaacaattcttaatatctatatgcctaacaacaaagcatcagaatatgtgaggcaaaaactgatagaactacaatgagaaatatatgaatgtactattataattggacactttaacactcctgtatcagaaattgacaactccagtagacaaaaaatcaataaagacatagttg

SEQ ID NO: 7733 - DNA, 1202 bp, Homo sapiens
ttctcccattctgtaggttgtctgttttctaacttgatagtttcttctgctatacaaaagctctttagtttaattagatctcaattgtcaatttttgtttttgttgcagttgcttttgaggacttagtcatagagtctttcccaaggtgccagtgcccagagtggtgtttcctaggttttcttctaggattcttatagtttgaggtcttacattgaagtcttaaatccatcttgagttaatttttgtatatggtaaaggtaggcatccagtttcattctcctgcaaatggcttggcagctatcccagcaccatttattgaatagggaatcctttccccattgcttatttttgttgactttgccaaagattagatggctgtaggtatgtggctttatttctaggctatgaattaaaaaaaatataggattaacatgcaaaaggctttaaaggaaaaagtagacaatatgcaagaacagatggataatgtaagcagagagatggaaattttaagaaagaataaaaaatagtaaaaaatattgtaacaaatgaagaatttcattgataggctcattagtatactggacttttaaaaatctctgagcttgaggatattacaaaaagcttccaaaactggaaagcaagaagaaaaatgacagagaaaaactccctcagaacagaatgtgcaagaactgtgagacagctgccaaaggtgcaaaatatacataaggaaataccaaagcagcagaaaaaaagaaaggaacagaagcaatattttaagtaataactgagaattcccccaaatgagtgtcagatatcaaactacagatccaggaagctcagagagcaccaaagatggtaagtgccaaaaatctacacttagccacaccatattcaaacttcagaaaatcaaaggtaaagaaaccatcttgaaagaggccagggaggaaaaataccttacctatagagaaactaagataaaaattacatccaacttctcagaaatcatgcaagcaagaagagaatagtgaaatatttagtgttgagagaaagaagcccaccacctagaattttatatcctgccatgttgtgttacccttccaaagtaaaggaagaataaagacttactcaaagtgaaaattgagggaatttgttgcaaatccgatttgtaagaaatatgtataaaagacttaaagcaaaaatt

SEQ ID NO: 7734 - DNA, 1045 bp, Homo sapiens
atactctgacttgcatggaagacaatcaaaggacacaacagattatcctaaattattttcagttctcagtcaataaattgggtaatatttcattatttaagaaacaagctcagaagctactttctactcttgggttaggttcttttcgcttattaattcatgtcaagactttttatttcaggaatttgagtaataatttgcatttaactctgaatcttttatttttggccattattcagcattatttgaggatcaggtgtgctgcataagcaccagttttttggcgaactctcttgttcaataaaactcaaatgaatttgaatatcattcagatcccttcatgaaaggtcctgaaatagctttacagcctttacttttactactttcacccccaactcctaatgtacccgttccctacctctcttctttcagccaacctgtattttcatgctcagtgcttttgcccagatttcgtttttcccttaacactttgctccccattctgtacctatcagaactctcatttttcagtggcctgtgccatgaagacatccttggttttcctcagggacaattattcctaattttgtctgtgctctcataatttattacttgaatttctatttcttatctgtgtcattctgcctctaccatgtctaatgtactgaatggtaaaatgtttgagaacagacatggtgtattagatttctttgtgttttccaactatctagcctcagatagggtaaacgtccaataaaaatttgaataatgtttgtgaaatacagtcactctttaggcatcagatttaaaaaatttcagccacgtacattggaagtctcttaaaaatgtctttcttgcctttttactttggaggtcatcattgtgaatattaattatttcagctaatcctagtacattaatgccttcaggggttgctgaaggcaacctaggtaggatggctggctgctctctgaaatgtccctagactgctgtgcgttaagtttcattttgtatgcttattatatcttctgcctcttccacattt

SEQ ID NO: 7735 - DNA, 1027 bp, Homo sapiens
ataccctgaatcgtctccaaggcccttcgtagcttaaaaaatttactttctggctgctacagatgcgttgcttatgtcttttgtctctgaagatttgattttacctcctgatgagctgttgaaaggtagtagctcttagattgagtataaaagtgacatctgtctcttttcaaagcctcagaacttttgtatgcatctgggaagctctgtcccctgcatagtttcaattacaatgagtattcttttcattttggatcttagcaaagacttttgccactgtgtggctgtgtgacagctgctgtacacccctccagtggtggttgacgtgatttctgcacctgtcttatgcttaaaaatattggggggagaaaatggacccagcatgctggaaaatattgacttgtttcccatattaggcttagctgctgaatgtcacggatctggaatgagaggaaagccagccaatttgtcaaggtcactagctccctctctgaaaagtgctctgtttatctaaagagttctgagacagggtcttatgtccattaaagatgaaggttcactgttattttagggctggacttggagatgggctttctgaaaaatgtaaacaacttaatcaggccaggtgagatgagcctatctctgtatgcatcccctacctccactttctgtcctctagatcccttcccagtgtagtattaaatgtttcacatgctaaaataaatattctgaacaaacagcaggtcaagtaatccagtttcctttttgggaaaaaaataaatcacattcaggattaatggagaggaacaaaagccaatagtgtggttaagaatttggattcaggagcaagaaagacttgggttcaaattccatttcatgccctatctctgtgatcttcaatatattacttaaaatttctatgcccagtttccctatccggaatatgagtaaacagtacctatctcatagatttgtcgtaagaattaaatacgttaggggacacattattgcaatgcctcaaacatag

SEQ ID NO: 7736 - DNA, 1043 bp, Homo sapiens
tataaagatggatgattcctttttaggagcagtgggagattaaagggtaggcattactgcaagaattggtgttaactgttctttaaaaaaaaatcattgttaatgatctggcagactgaacgatcagcacatcaatgactgaggaaagatgtgagattcagagtgttacagcatcacattaggcagagaaatcattgaaataaaccctatactagaagaaattggaagagctaaatgacatgcagcttaggaggaaaacctactccctcagaaaagatttttttagatcatttctttctgtggaacaaataaagggtttcagtagcatgttttggctaattgagcagaccactattattgctgtggttctgtaatcattttgctagagaacataggagaataaatctctagtgatcagagaatatatgaatgatgtagaaccctcaggccattttcataccattcatcatctgtgggatgttgccatatctggtgttcttggcacacttcaagtatgtgagctatagggagaaaagttggaaatggacccagatcttattgcacagaaaaaaaaaaaaaaaaagaaagaaagtgagccttgaggcatgaaatctcccaagagctagccctcacacctgcaggtaatttatatctgtatttcctgacttgcttcctcctatttaacactacttcttccactttgcttttgtactattccaccggttgctgattcctcaggtatggagacctagctgctcagttttcacttatttggctcctcttttatagcgttcgaatatattcaaatttgttacaggaaatatagttaaaccctctggtctattgccctttaactacctcctattcctcacatttccattggaactaaattaactctcgttgactatctaatcattgacaactgacaccatggacttctttgttctgaatccagcaaacattttcagtcctactcttccttctttttctatgacaatcaaacttgctgaccacctcttttttttcctctaatagtttcccca

SEQ ID NO: 7737 - DNA, 1226 bp, Homo sapiens
acagatcaggagtggatcttggtttcacaagcctgaagcttatacaatttgagagaccctcatgaagaaaaataatgcaaaattgtgaacataaaattagatgcaaaaatgggtagtacgagcattcctgtaatccagtcctacattgggaagactaacaatgaccaattatgcatagaagtaactgcaagccagagaaatattgcctcacccaaaccaaaggaattcccaaacatattttccttaaacacatcctagtgggtccacaggcactccagttcttgaattagaacttgtataccaaccatattttattaaagctcagttaatcaactcttatgtgatataaattccatgaatgggcgacagtatgtatttcaggctgtaggtagactacccttttattttctcagaggacataaaaacgtgacattgttctttccaatactttacaagcattcttcatctccacctcaacaatataatatacatatattacatgtggcaaaagaacataagaggtgaggcaagagtacagtattatgctcatgaggaaacacattatcatcagtgtaaataaaacctgaaaatattcctccttgaccagaattcccagtcaataactaaatctatattcatgatggattacacaacagccatttacagtggcaacttatcattagggatatggaggttgttggggaaatttaagacacccctgatatccttatggcttttaagaacctttgaggtacatctttcatcctctgcccactgttagctctgaggtctgaaattcccaagccttactcccacaaaaataccaggaaattcttacaaagaacaaagcccatggtaagtgatatcctattcatcttttctgaagcattgtctgccttcaaaatattgtgttgattatattttgggtcatgttaagtttttattgcttagaaaattttccataactttctagcctgcaaatggcattgtctcctttccagagctgcagttttcctttttcattatcttagtctgtttggttaaaacaacacctacctatttgctttgttaattatccctttggacaggaactgtgtaaagttctgttgtgaatctctgtccatgactgctttctgtgtctatagtttgactgctctctttttactctagcctcataaaatctttgcttaatgagtttgttccaataatatgaaaactcaatggga

SEQ ID NO: 7738 - DNA, 1048 bp, Homo sapiens
gttcatatatagcttttataagcaagtgataattaatggaacagacattttagttgttgttgaatcctttccatttctcttcccatcataagggccagcttcagatgctgttaggtcctaataacttcctggtgataaccatgtggcccacccatcccattaatttctgcttttattctgaagttattgaagaaacaagagtaattcttgtatatatttttgatgcttacctaataagatactaggctttgaagaaatgcaaataatgtctaaatgttcaatctatacagcttcaatattagcaaactgctatgaaagtaatgtttacacatttttttcacatttttgtaattttgagttcaatgttgaaccaaaatttcctgggactagaaaaaaaagagcctgattatgagaaaagaagagcaaaacaacagaagacaaatacaattgtagtgtaaaatgtactattttgatttgaaagtttacacgtgtactgaagaccaggaaacaatctgaatattgcaatacaaaaatatcttgcttttctcatttatctcagtttattcttaaaggtgttcatcaattactgttagatctagcaggctatttgaagagctattagtgtattttgaccctggaagaaaagaatacattttgtgctttagtgaaatatttattttatgtggttgataaacacttatagaatatttactcagtaccagttactgttttagaaactttatacatcatttaattctcataaccattctgtgagataggtgttattattatcccaggcttttagatgagaaaatgggcacagaggttaaataacttgtaaaagttcaccaagttgtctggtccagaacttaaaacttcaggctattttgcctctcagtgctgcattcattctaatctacttaagttgtattcatttaaaagactacaaattgcaatttgaacagggtcaatttatgattttttaaacttagcaaggagaaagatttaaatgtagaaagaggtggatgtatagtcatgtgttgcttaa

SEQ ID NO: 7739 - DNA, 1050 bp, Homo sapiens
atgactttggttcctgaccagaaatctctcacctgtcgataaatcaaagttgtaaggtagatttctttaataagaaaattttagtattgtcatgtcctagacatgacatgtcctagaatgcctgaagctagaatatccccatttttagcatataatatattcttaaagatttttcaaggtaattcatcagtcataaaaaacttagaagataatattttattgaaatgccttctttcatgatatgcaaactgttacaattattattttcctctttacagataaaatatagtaaagttatatatacatttatttttcctagaaattataaaattgtaagttcaatttatctaaaatagaaagttattttattctttataggtacaaattcagatatatatacatgtgcacacttacccacatacataggtaaggttggccacgtaatttgtggggcctaatacaaaatgaaaatgtgaggcttcttgttcaaaaagcaggagaaaggaactgtagctttcttacacagtctctcgtgacctatgaaaggttatttttgtttgctatttaatgttagatttctagagtatagaggtacttataaagtgactatataaagaggtacttataaagtgactatataaagaggtacttataaagtgactatatgtctcgtgacatataggtcacgagagactatgacctatgaaaggttatttttatttgctatttaatgttagatttctagagtatagaggtacttataaagtgactgcagaccctcacaggcatctgtggccccaccaaatgaccctgacccaccccagggtgtgccaaggcccccacaaggaataaagggtggcagtaatcactgggtgggagaacaggtggctgaggacctatcccaggaagtcactcggaggcaggactgcatatgagccaagacatgtgcttcattgctgcattggactacacagattcacaggtaaaattgttaaaaaattcaagactgtggtagcagagcatgaaaacccaagcctgggacccctgtct

SEQ ID NO: 7740 - DNA, 1032 bp, Homo sapiens
ttctgtattcccaatttatttttaaaaaacaatgtcacttttgtcagtaaagacttaaaagcaattttgaatgtgtgtgggaaaaaaatacccagaaaatttccccctaaacctgatttttattgcttgatttgtggtttaaagtattttcataatatttataagtaaaggtggtttcagcaagtatgaattccaccattttgtccacaggattagtggggagggattttgaattcagatcttagctttggtgctggatgcctttaacaaattgccgtaattgcttttcctttatccgtattttacttctctttggcagggtgaaataccagtttatcccaggtatcgtctgaggaaggtttggggagtgatctgtatgtttagattttctgcctaactttattaatgtggtatgaataaggagcttttttttttagaaaatgacactttatacaagtcagttcctctctattttctttatggacggtactggggtggcagcaggactcaccatgaaaactgtagtggtaactctgttcttctgactgcctcccatgatcctgtgtaggaagctattaagcctgtagttaagttacttccatttcctcttgactaaattgatataatgatagtaatatatgctgcgcttatctttcagtgtgtcagtcactgtgccaatcgctttatatgtacgaactgattaatctttacagctcctaggagtagatcttactgttatctccatttcacagatgaggacccattggagactgtattcaaatccaggcagtttaaatatagaaatatttaagagctgcttcatgctgcctcctacagcatggctgggcagaatagacacagaacattcagaaatttgagttttgggaaacatgcaggagagagatgtgacagtgagatgttgcctccaatatgaattgtccttgtcttctaaaaacagaatcctgctaaattaatgaccaacagtaatagcagctatacctcccagtttcccttgcagctgtaattatgctt

SEQ ID NO: 7741 - DNA, 1025 bp, Homo sapiens
ctataagggattttattgacaagaagaaactactccattctgactaaagaacatattgcaccctggaggatttattttccaagagaggctactgacagggatagaattatcttctttttggaggcctcccttctctcctgtaatcttctagctggcgcctaacacagggctctgcatcaaggggcttctcaatacatccaattgaatgactttgtttggggccggtcctgatgcccagaacgaaaaaacttacttttgattacctcgggagaattgctagtaatggccctgatttattctctctcttttttctctcttttttttttccccagctcttctaccctcaatgtttgattgcttgcaagaggcatgtgagccaaaattttaaagtttgcaaagtataaagaaaggaaacaagtaaatagggaaggagaataaatactgaacaagactgggcaaggtgacaagaaagaactactgtgaaaatctggaagagggccaggatgcaaaatgcaggggctgtgtagtttacaggaactatttagcctccagcatgcctcagcgatcacacagagaaaggcagatttctctgcttttgtctcctaccctatagttagctatggaaatttgacataggtgatatatgttttctgtcagcaaactgatacaaatacagaggaccatggggcctgtgatcaacaaatccaacgtgatttgaattgctaggaggggacctcttgtggctatagtgggaaatacttcagctaaatactaccttggaggctgcagatatttttatgaaggaattaaaaaaaaacccactataaaagctctttaaaattacatttcagatatttataatatttaattgttttgataacaccaaattctgtaagaaggttttatctgtattgcatctctgaagagttcagtgtaatttaaagctcttcagcttttatccatttaattcacatatcctctgaaaagcaaatgaaaagaataagagttctcatctacattttgta

SEQ ID NO: 7742 - DNA, 1047 bp, Homo sapiens
tcttttgttgcttgtgcttttggtgtcatatctaaggagctcttgcctaagctgaggtcacaaagatttattcctatgttttttttttcccagttttttatggttttaacccttacatttggatctgtgatccatttgagtcaatatttgtttatagcttaaggtagaaatctaaattcatgctttttatatattgatatttagttatcctagcaccatttgttgaaaagactattttttttcttcattaaattgtcttggcactcttgttgaaatcaattgactgtaaatgtaagggtttgtttctggattctcaattctattccatttataagtatgtctatccttatgttagtaccacactgttttcactactgtagctttgtagtataagttttgaaattcagaagtgtgaattctccaactttgctcttatttttttcaagagttttttttttttttggcaattctgggtcccttgtatttgcaaacagattttaggactagattgtcaatttctgcaaaaaaggcaactgggattttgatagagattatgttgaatctgcagatcagtttggggggtattatcattttagcaatagtaaatctttatgaacgtgggatgtcttttcatttatttagatcttctttagcttcttttgacaatattgtgtagttccttcttttgttcaattttttaaaaatattatattcttcttgaagcttttttttttttcttttgagacagagtcttgctctgtcacccaggcaggagtgtaatgacatggtctcagctcactgcaacctccgcctcccaggttcaagtgattctcctgcctcagcctactgagtagctgggattacaggcgcctgccaccacacccaactaatttttttttttttttgtatttttagtagagacggggtttcaccatgttggccagactggtctcgaactcctgacctcgtgatccgcccacttcggactcccaaagtgctgggattacaggcatgagccactgggtccggctcttgatgctcttataa

SEQ ID NO: 7743 - DNA, 1048 bp, Homo sapiens
tctactaaaagtacaaaaaattagctgagtgtggtggcgggtgcctgtaatcccagctactgtggaggctgaggcaggaaaatcacttgaacccaggaggcggtggttgcagtgagctgaggttgtgtcacagtgctccagcctgggctatagagagagactctgcctcaaaaaaaaaaaaaaaaaaaagaaagtaaacttcagactaagaacctgtggaatggtatttttgttactgatgtgcaaacttcaaggacatttggatattagaagaaggggagcaatttgtcctttgttaactaacatcttttaatgtctcaattttttttttactttatagtctttactgtttttccccatataataaaaataacataattaataaataatgttggaagaaaaagtttgcttttatctttccctgatagagaaccactattaacagttggtatattttcttccagattttttcaaagcatattttgacatcatattattatttcttaagtaattgtaaatggcatacatttaaaatgtgactgttgtaatacaaattctattgcaaaatatgaatttaaaataacctctatattttgaaggtagacccaggagttaaatcagaatgtctcgcaagacttccagcatcatttgctcctataagcttacaaaatgagatctctcttcccagaactggcaagtgtttaccttgtgtggctcatttgattagttgctacattaatggaaaaatataaacccaaactcacttttgttaaatgtggtgaagtggatggaacaagagaaaggtcacattataggaaagataaggtttcttttttctttctgcttatcaactgttgttgagggacttacatcagaataattctaagcagcttctttcattctgggaattctagaaagcgaagccaacaatgatgtgaaaagagaaggtgactcacagataaatacataaatctttacaagccccacatgagtagcaactggcatgtgcatccttggtggtaatttaataagctttttattcctgttg

SEQ ID NO: 7744 - DNA, 1050 bp, Homo sapiens
ctcggtctcccagagtcctgggattacaggcgtgagccaccgctcccgacccctggcccaaacatttctttaggattcatattaactacctgtctgaactggagttaatattaagataggtgtcctagcataaaattataaaaatttagatcgggctcggtggctaatgcctgtaatcccagcactttgggaggccaaggtgggtggttcacctgaggtcaggaacttgagaccagcctgaccaacatggtgaaactctgtctttactaaaaatacaaaattagccgggcgtggtggcacatgcctgtaatcccagctacttgggaggctgagacaggagaatcgcatgaacccgggagcagatgttgcagtgagccgagatcgcgccactgcactccagcctgggtagcaagagtgaaattgtgtctcaaaaaaaaaaaaattataaaaatttgataaacacttaaaaaccaccaccaccccaggttattctttaactgggttcttttcagtgaagcatgactgtgagttgtttctctgtccctgacaaacaatttttattcaggatacatgatgaatcactgtgtaattattgccatttctagttgccatagtgatgggggttttcatgtatgggctgcctcaaggcgtcttgttcagagaaacagtggactgtgtaaatattgtttaaaatgaaaaggtacacagacatcaatatcttctctaggcaggcatgcatttgatatatgattcaacctttgggtagaggttgttttttaatctatttaagcatccgtttactcagttttcattaatacaactttctgaacgtttatgtggatctttacacacttggatgattaaggttactgatgaaaatatttcaaatatatatatgagacaggatctcgctctgtctcccaggctggagtgcagtggtgcgatcttggttcactgctggcctcaacctcccaggctcaagcagttctcccacctcagcctcccaagtagctgggaccacacatgtgcgccaccacacctgagtaattt

SEQ ID NO: 7745 - DNA, 1136 bp, Homo sapiens
atttatttatttatttatttattttttgagacggagtcttgctctgtcgcccaggctggagtgcagtggcgggatctcagctcactgcaagctccgcctcccgggttcacgccgttcttctgcctcagcctcctgaatagctgtgattacaggcgcctgccaccacgcccagctaattttttatatttttagtagagacggggtttcactgtgttagccaggatggtctcaatctcctgacctcgtgatccgcccgcctcagcctcccaaagtgctgggattacaagagtgagccacagcgcccggcctatttatttattttttgagacggagtcttgctctgtcactcaggctggagtgcagtggcgcgatctcagctcactgcaacctccgcctcccaggctcaagcgattcttgtgtctcagcctcccaagtagctgggactacaggccatgccaggctaattttttaatttttagtagagacagggttttgccatttggcaattggccaggctgttcttgaactcctgacctcaggtgatctgcccgcctcagcatcccaaagtgctgggattacaggtgtgagccactgcacccaggtcaataaatttaaaatgataataattatcattattatatacatatatagttacataatcccttttgagataagacatggatttaaattgcacataatacttacatattattatatgcagtataacataatatattgcacatatcttaccttttctcatagaaatatttaaattttctcaggttgttaaaaatcttttatgacaagataattttttaaatgagtaaagtattctaacctacagttacattacaatcaactataacaaacatcctattattggacatataggttgtaagaattaaagaaagaggagagaaacacaaagggcggcttgacagtcaacagggacagatttgtttatttatttttattttttattttttatttttttgagacggagtctcactctgtcgcccaggctggagtacagtggcgcaatctcggctcactgcaagctccgcctcccagattcacgccattctccttcctcagcctccggagtagctggaactacaggcggccgccaccacgcc

SEQ ID NO: 7746 - DNA, 1109 bp, Homo sapiens
cttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatatttaa

SEQ ID NO: 7747 - DNA, 1029 bp, Homo sapiens
catgcccagctaatttttgtattttcagtagagatggggtttcaccatgttggccaggctggtctggaactcctgacctcaagtgatctgcccggcttggacacccaaagtgctgggattataggcgtgagccaccgcgcccggccagtactaatatttttgacaggggagatattttagtcctattgcagcaaattaccccaaaacttattggcttcaaaataacaatgaaactcttgtttcatagtttctgtgggtcaggaattcaggagtggcttagctgagtagtttgggctcagggttccctcatgaagttgcagtcagaatattggctggtgctataggcatctaaaagcatgattaaggatagagattcacttccaaggtggcttactcacatgactgttggcaggaggcctcagtatagcaccatgagtacttctctccatatagggatgtttgaatatcctcatgaaatgacaactggtttcccccagagtgagtgatccagaagaagggctgaagccatagaggtttttttttttatgatttagtctcagaagtcatacattcctcatattcacagtatccttatacacacgggcatgaataccaggaggcagtgctcactggtggccatcttggaaactacctcagaaaatttttagtgttgcttagtaccatatttttaaaaggagagataaattgtaatggtttgacttctgttcatgaatacagagaaagggaattttctgattatcacagataattccatgtcagacttttgatggtcctataacattattttatctagtttctctttatttacttttgaagatgatagtatgatcctatcatgttctttgaagtgctaggaaagatttctggtgattcttacgtatttcttctttttctcctggaactaatagcttcaaattgtaaatgtccagaaaacagtgggcaatccattgaattgcacaagttgcaaactactggaccatgttagctttatgtgctaatatattagcc

SEQ ID NO: 7748 - DNA, 1035 bp, Homo sapiens
gataatattccaaaaagaaggagtagcaaaagaaaagatgcataagtgggaatggtaatatttttagaaaaattccagaagtaaaagaaataaaaggtttcaaaataactgcctatctttataaaccaaattagtacataactggaaaaactgtctgtgataaagtttacaacaagggtgatagaggaaccctggagtagcagttgtcatgtgggaagaatgcatggttttctaagctgaatagcattctcatacttggattttatcactcgtctaaggaaaacatcctgtctaatattttatagtaacaattctaaagttttatgcacaacaaatgcttagtttccttattaacttaccaaacttggtaatttgtaattaatcatggtaggatttcaaactagagagtaccaaatttctagttctggctttaagtagaattctcagataagctatatggtagcagaattttatctcaaatttagtagttttttttaattaaatgagagaaaggtagaatataataatagattattataagttttgagtctgacattgactttttttaaaaatttaaattaatagatcacagttgaaaactttggtgcaacagaagtgaaagagctggttctaaatggtgcagacacagctgttaacaaacaaaatcggtaagtgaattttagcagcaacagtgggagtaataagattcagtagacattttcttctgtacgtagaaaacgtgtcacaaccctaagcttttactccaataaaactttaattttgagtggttagtgaggaaataatctgccttttcctcctgaaatcccttgaagacattaaaacaaagagaagggagaagtgacagcagcaaacatttttggaagccaggaaacagtagtaactaacttaagcaaaccagagaaagctacaacatgagatggaaaagaggagtcacgaagccagctggatcacttcacaaaacaaaagtttgggtgctgagaataaaacatacctttagaaaatgcatggtgtttg

SEQ ID NO: 7749 - DNA, 1041 bp, Homo sapiens
tgactttaaagggttacagtaagtttgctttatcatttgatcctgtaaataaaaaagattttgagctgcttcctctggtatagaatatctgactataccaactaaggattaaggaaaggatgaaaagaaagcttgaatatttaatagtctaaaaatattttaaaaaattaaaaaccttcaaatcttggtaaccatttttattctgttcaaataaatgcatttggtattctaaatatttttgtagtgttctatactaacagctagtaagccaattttttggaggtctttgttaaaacgataagttaataacttggtgattttaccatgggatattccattttagaacaagaactcagggagaaccataataaaagaacaaaagttttaaatggtaaaagtcaaatccttggttcgtgagcacataccatgatcacttagttaagtgaatttgtgtaatgcttccttagccagatcattccttattctttgttttttattttttatttttgagacggagtttcgctcttgtcgcccaggctgtagtgcagtggtacagtctcagctcactggaacctctgccttccaggttcaagtgattctcctgcctcagcctcctgagtagctgggattacaggcacacaccaccacgccctgctaattttgcatttttagtagagacaggatttcaccatgttggccaggctggtcttgaactcctgacctcaagtaatctgccctcattggcctcccgaagtgctgggattacaggcgtgagccactgcgcccagcctgttccttatactctttaaaggtttgtttttgctcctccctctttaccctcccctccagtgaatgttttttagaaaaaccaatgctcagatttatcagtattactaccgttctgtactggcttactctaatggtgttatgagttatacattatacattagtataaaaacattcaaaagggtactctttatgctcagtttattaagttttatgctgtacgggatactgttaggtgctatgttaattcagtag

SEQ ID NO: 7750 - DNA, 1134 bp, Homo sapiens
aattcgtaatctactgggcaagattggcaatagtcaaacaaagcaaaaaataccagctaataatatgtattattaaaatgaggggacttagtaaagataggtttcagaaaagacttatctaatgaagtatgagtactaatctgaatgacaaggagcagccctttaagatcagggcagagagaatttcaagaacaacgaacatttggtaaaatacctgaggtgaaaacaagcttgacatgattgaaggacagaaaaaagccagcattaggccaggtgtggtggctcacgcctggaatccctgcattttgggaggccgaggtgggcagatcacgaggtcaggagttcaagaccagcctgaccaacatagtgaaaccccgtctctactaaaaatacaaaaacttagccaggcatggtggtgggcgcctgtaatcccagctacttggaaggctgaggcaggagaattgcttgaacccaggaggtggaggttgcagtgagcttagattgcaccattgcactccagcatgggcgacagtgtgagactcctttcaaaaaaaaaaaagaaagaaagaaagaaaggaaaacagccagcatggcttatgggagtgaggagggaacagagaaatgggcaggggccagatcatagagagtttagtaaactaggattaggaatttggattttatctaaagtgttaatgataaacaggggaaacttaatctgatctttttgaatgatcactttgttggctgtgtagggaacgggacagaaatgaaagacggaaatccatgagaaagctatattttagtagattaggggagaggaaatgatgggtttgactaggatgatggttatttagatggaagaaggaaatggaatatgtcttggagataaaagggaatcttggagacaaaaggaaaataaaaatcactgatggattggatatgaagtgaggaaaggagagaaatccacaaagattaaaaagcaggtgtggtagagggaaaactaggagagtcttggaaaccaaaatttaaaagtgaaagagagactgttgaatgctgcagaggaggaggatgaaaccttagaattgacagtgaatttggttacatgaaggtaattggtaaccttgataataccat

SEQ ID NO: 7751 - DNA, 1049 bp, Homo sapiens
ggccccagagcactttagcccaccatggtgaggcttgcaggaactcacattttgacaactgggacccacagttcccctctggctagggctgggttttaatgctccctctgtggacaggagtcagctaagtttgatccagttttactttttgctgtaacagggcagtgctgagctcaatgcctaacaattgctgcattctttctctccccggtgcacagaaatgctctctgcaccacaatgcctctgccaggggctgggagaggggtgatgttggtgattcaagacttttttgtatctctttttttcagcaatatgaagttgaaaccaggtgctatgagtgctcacctgatttttggttctcaggaagatgctttttttgtgtagatagttgttaaattggtgtccatgcagctgggacaatcagtggagctttccattttgccctattgcttcacctcttccacctgtttgcttttagggatggaaactgtggtttcacttttaaattttaagtaagataaacaaaaatatatatcagaggtcagtgggatgtgaatcatattctgcaagagtcactaaattttagaatccaatgtgattaaaaattagtttgtatatgtataaacataaatattggagaggggaaagccattgtgttttttgtataactattctgtatatttctttttttagtagaaagagtttggctaattatttcagttgattaaagcacaatactaaagactccagggtaggacctgcaaactttttctgtaaaggaccagatagtaagtattttatgctttgtgagccatacagtttttgttgcaactagtcaactctcaactccactgtggacagcatgtaaatggatgggagtggctgctttccagcaaaatttacttaaaaaaaaaaaaaacagtgggtagcatttgacctgggtagcatttgacccacaggttgtagtttgccgaccccttcttttaggatgaaaattttggtctccatatgtaaacttggtgtctttgttttgtttgaaagctagtaat

SEQ ID NO: 7752 - DNA, 1313 bp, Homo sapiens
ggaggatgattatgaaccagagaactggactttgtgttccctattcatttcaggatttatggatgcacttgttcctcccatatgtcatgtcctttggaaagtttttgaattaaaaattgttttcagtgctccaaatggcatcataagaaaatacctttggtacctgctgtcaggaatggatgtattatcagctaaatgagtttactggcaaataattgggttatttagtagtttccgagttccacgtagtacattatagacatgctggtatgccaaaagagaagccttacttggtctgtctagcctagtcgctacatatttgtgctgatctaaatcagtgattttcaaactattttatgtagaacccttaaataaaaccaaacagataaaacatactcaccataaccacccttgaactgaggtttttaagcaagaatactaaactttaattaaaatgtgaaataaaagtgttataatcaaacttatataggttttattttgtacatttaggcaataatcctaaacacataagttgttttgaacttctaccgtgtgacttctttttaaaattcattttgcaaatagagtgcctactatgtgcttattattatattagatattagtgatgtagtgataaaagacatgatttctgcccttgttgagcttacaatattgagagattgtctaaactttttggtctttatgttacagcatggtaagtactagattagggaaaatgcagagtgctatgagaacacttgggagggcatgtaactatgaaggactaaggaagacttcctggagaaaatgatggctgattgaaccttatctactatgcgaatatattatttttattctaacattaacatttcttttcaaaaacgtatatatcatatcagcaagatatacaaactgcaaacactggttgcgtttctttaattttttttaattcttaatttttgtgagtacatagtaggtatatctttatggggtacatgagatgtgctatgaaatactaggtttggccgggtgcggtggttcactccagtaatgtaaccccagcactttgcgaggctgaggccggtggatcacttgaggtcaggagttcaagaccagcctggccaacatggtgaaaccccatctctactaaaaattacaaaaattaattgagcgtggtggcacgtgtctgtaataccaactattcagaaggctgaggcaggagaattgcttgaacccaggaggtggaggttgcagtgagtcgaaatcgtgccattgcactccagcctgggcaacagagtgagactctgtctcaa

SEQ ID NO: 7753 - DNA, 1041 bp, Homo sapiens
ttctgtgagtcaaaattaagcaaataattatttggaaaaaatatttgtagcaattacaacctaaggttaatatcctgaatatctaaagtgtccatacatattaatgaaaaaaaaaaaagacagctaatagataaataagacaaacaataaataaaggaaattaatggaagttcctaaaagaagaaatttatattactaggaaacatgcaaaaattattaccctctttagtatcaaagaaatgcaaatttgaaaagcaagaggacagtaaataattgtaatagatcaagcattaatcctctctttcctgttataagataactatataatagggagaaactaatgcttcagctacaatatgaagtaatgctaacacttaatttttcaacctacagtgaatgagcatcaatgcctactaccaccacaaaaaagaactcagtgaaaattcttctcaaaggaattatgtgtttcctgatggaactactctcctgcctccatgtagtagttttactgaaataaccaaatggtgattgaaacctgtctagattcaaccaccaatttacagaacagaagaccaagccaaatgttaggagaaaccacaaagataaagtcagcaaaatccagtctgcataaagttgtacaggacaaatgactaggtttctcaaactttttcgagtagtgattaaaaggaaattaaggataggatgcagtggctcacacctgtaatcccagcactttgggaggctgaggtgggcagatcacttgaggtcaggagttcgagaccagcctgaccaaaatggtgaaaccccatctgtactaaatacaaaaattagatgtggtggtgggcgcctgtaatctcagttactcgggaggctgaggttgcagtaagccgagatcatgccactgcactccaacccgggcgacagagtgagacctgtctcaaaaaataaaaataaggccaggtgcagtggctcacacctgtaattctgacactttgggaggctgaggtgggcggatcacctgaggttgggagttcgagacca

SEQ ID NO: 7754 - DNA, 1191 bp, Homo sapiens
atacaaaattagtcgggcgtggtggcacatgcctgtaatcccagctacttgggaggctgaggcaggagaattgcttgaacccaggaggcggaggttgcagtgagccgagatcgcaccattgcactccagcctgggcaacaagagtgaaactccatctcaaaaaaaaaaaaaaaaaaaagaaagaatgctttggctgatgatgacctttattactttcatataaattttagcataggttgtgaagttctctcaaaaaaaaaaaaaaaaaaaagccttgtggggttttgattggtagtgcattgaatctctaggttaatttggggaaaagttgttatctttgtaatattaacttttctaataatcaacatccagacttctttaatgtcttataataaaatgttttaaaattttcatcatagaggtcatgcatatctcttcgtagttccattcctaggtgcgtctttaatggtattatatttttatttccactttctgaggaatcactggcatgtagaaatagttgatatttacatattgattttaaatacaaccaccttgctaaactcttattaataacttactcatgtacgtagtcataccatctgtgagtcaattcagttttgttatttctattatttatacttaacgtgtttatataattgttttaatgtgctgtttaggacaccattataatgtttactgtaacataatgtttcctttctgtgggaaaactttcagtatttcatagttaagtatcatgtttgctgttaagatttttatagataacctctatcagactaagtaatttccctttaattcctagttttttttattgtgaatggatgttaagtttttaatgttgttttttctgtatttattgaaatgatttatgatttttttttcctttaatctgttaacatggcatattgatggattttttttttctagttaacagctttgtgtttctggaataacttcagtttggtcaagtattatcctttttgtttggtgctgggtttgatttgtgaatattctgttgactcttacttatatttctgtttatcagtgaacttgatctataatttttttcttattattcttttcaccaggttttattatgaaggttttctagtctgataaaataacattgaggaatgtacctttgttttctaatttttggaaatagaacag

SEQ ID NO: 7755 - DNA, 1034 bp, Homo sapiens
gcttgctgaaatctgccttcaaatctctctagtgtattttttatttcaggtattgtactttccaactccaaactttttttttttttttttgagacggagtctcgctctgtcgcccaggctggagtgcagtggcgcgatctcagctcattgcaagctccgcctcccgggttcacgccattctcctgcctcagcctcccaagtagctgggactacaggcgcccgccactacgcccggctaattttttgtatttttagtagagacggggtttcaccgtttttttagccggggtggtctcgatctcctgacctcgtgatctgcccgcctcggcctcccaaagtgctgggattacaggcgtgagccaccgcgcccggcccaaactttttttttagtttttctttttgattgatatttccgttttgttcatacattttttttttctttttacacgtcttactctagttctttgagcatctttaggatgtttgatttagtctttgtcttttaggtctgccatttgacctttctcagggatagtttctattgttggcttatattttctttgaatgggccaccctttcctactactttgtatgtcttgtgatgttttttgaaaactggacatttaataatatggtaactggaaatcagattctccccctttgccagagtttgctgatttttggtttttgatcattgtaggttttatctgtgtcaggagtcaccctgaggtataaaaatgaggtcttttcttagcctatacctttccctgctaatgcacagtgacattctaaattcacccataaatgtggttgctttttaatgttgtagaccttaaatgcctggctccccaaagaaacaaggaaaaaatgaaaggtgggggtggaaggagagtagaagaaaaaaagagaaaggcatcagccctttgaattccttggaagtctctttagccagaatgggagagtatacaacagtgattgcctgcctttctgcaccttggtgatcagaagcaccaatcattgatcagggcaccagt

SEQ ID NO: 7756 - DNA, 1069 bp, Homo sapiens
tattaatattttacttaatagtgccatttattttctaagaaatattttcctacctgaaggcataaaagtaatcatctctgttatcttcaaaaacatagtgttgccttttacatggaggtctgtaagttatctgaagttgatttattttgtggaggacagtataatgttcaagtaaggaatcaactttttaaaaatataaatagtcaattaccctagcaccattaaaagtttttgtgggaaatacatacaacaaaatttaccaccttaactatttttaagtatacagtccatggtattaagtacattaatattgttgtgaaaccatcatcaccattcatctctagaattctttttatcttgcaaaactgaagctctatacccattaaacaatgactccctattctccatactctcttgtggcaaccaccattctacttcctgtctctgtgaatttaactcctgtaggtatctcatataggtagactcttacagtgtttgtcttttggtgactgacttatctcactcagcgtagtgtcatcaaggttcacccatgttgtagaatttccttctatatatgtcagaatttcctccctttaaaaggctgaacagcattccattgtgtgtatatgctaattttgcttgtgcattcatcttttgatggacacttgggttacttttgtgttttatcttattgtgaatattgttgctatgaacatgaatataaaaacatcccttcaggaccccactttcagttcttttgggcatatacccagaagtggaattggtggttcatatggcaattctgtttttaatttttgtaggaactgccatactgtttctcatagtaactgccctgttttatatttccaccaaaagtgtacagggtttcagtttctctacatcctcaccaacactgttattttctcattttgcctttttctttttttttttataatacctattttaatacgtgtaacatgttatctcctgtggttttgatttgcattttcccaatgattagtgagctgagcatatttttatatacttgttgaccatttgtacatcttta

SEQ ID NO: 7757 - DNA, 1076 bp, Homo sapiens
ttttatttaaaaaattgacccaaattttattatcgtagtttaatataagtggaaacacataactttgcacacagacttcagaaaaataattgttggcaataaagatgtagtttatcttttaaaagttctgcttcttggacatatacattaaaaaattatggcaagatagtataagattattatttttgtgagtacagcaatttctggactatacaaactaaacatatttgaattattagcttggtcaaaaatacaatttattttcttgttattcattttaagatatattacaattcctgcctaattttagcatctgaaaatttggaacattatagattaaaaagaaaaattaaagagtagtttttaatggtatagagtaggtcagtttttagtctaaatttttcatttttttaaaaatctactcccctattctgagataaatttttcaaaattgaaatgagttggtgttaagatttttcttaaattactaggaaagttgtggcttaactggaaaatagaaaattggtaattgtgtttaattgcaaaatatttaatactttagctcctcaaatgtttaattacataatataaactttttactaaacattagtggttggaattttgtcttcagaaacataactaacaatgcctgatttctgcctatattgccgctacacattaagttgggaaaacagaagaatacaacagtatacatattccataattgatatgctttagcagagtcccaaaggaagggtatataaatcttatctccaatgtgtgtgtgtgtatatatttttttaatttacaaaatttattctggcttctttttctttttttctttttctttcttttttttttttttgagacggaatttcactctgtcacccaggctggagtgcagtggcgcaatcttggctcactgcaacttccgcctcctgggttcaagccattctcctgcctcagcctcccaagtagctgggactacaggcgcctgtcaccatgcctagctaatttttgtatttttagtagagacggggtttcaccattttggccaggctggtcttgaactcctt

SEQ ID NO: 7758 - DNA, 1032 bp, Homo sapiens
tcttgtcatcctatcattttctgctacttcctttgaggattgttctggagagaacttgactttttctggagcctctgagataacagatcttttaaacatttacttcttcataattaagatttatgggaatgttttgatataaacaaatgatgcttctaagtattttttcttttttttttttggaacagtgtgtgtcatatcttgcttgccttttttgtttttgtatgtttctgtaaaatacttttttaaaagctatacaaaaaatgagatattagtgtaataaacttcatgtactggaagcttcaggagtaggtaagtacttaatacatcattagagttgtgcaggttcctagaggctatatagggctaacctccctctccaaaatgcaagatagtaatctagatacaatttgaatttctgtatagataggaatttcagcctctttggttcagtctgtttcattattgaacagctgcatttgtaaattgagctaaactatgcctctgaagaaaccctgattgatccagttttaaccactttcaacataagacttttagtttgttgaagacaatgattatagctttcttattaagctgaaagaaagttaattttaaatggtatcttttaaaaaacttgtgatactagtaaaaaaacctgacaaacacatcttgaggactaagagaaacaaattcactttccttattgatttgtcaattgatggctactggtagtagggccagtattttaagggccaatattttaagttaatttctgttttaaaaattgaacatattttaactacatgtatcttttgatattaagttggcagtccacaaatggaaaccctgtcagtcatggtttactgcctttcagttctctactcaccatatctaatagatgctttatttatgagatctttaaaaaatttgttttccattcagaaattgctaattcagattatttccttaatttcctttttttatcttgagacacggtctggctctgtcacccaggctggctggagtgcagtg

SEQ ID NO: 7759 - DNA, 1034 bp, Homo sapiens
tttcccaggaggtttttgttttgttttgttttgtttcgttttgtttgagacagagtctcactctgttgcccaggctggaatgcagtggcacgatctctgctcactgcaacctccgcctcccaggttcaagcgattctcctgcctcggcctcccgagtaggtgggactataggggcgtgccaccatgcccgggtaattttttatatttttagtagggacggggtttcaccgtgttagccaggatggtcttgatatcctgaccttgtgatctgcccgccttggcctcccagagtgctgggattacaggcgtgagccaccgtgcccagctgacttcacaagaactttaaacttgtgtcagaaagcacatggaatggagggaactaagaattgtttctttacataggttggctttataaatatacatattccataactaataaggaatgaaggagaaagaggtagccttattaaggataaattattctcgagattcataataacctactggaggacttggcctgacaatgtagtgaatagatttaacctgtggcctattgaaaagaggtgtttctgttctggactttttagggaccacacagaaagatttaactgaattcctttattatactaaaggtgcagattatgttcatgttcatctctgttgtcttgtatatgtatgtccttttctatcactactggcttttctgaattatttccagagaagtgaatgtctgtttcactttcatgtttttttcttcataagaactttaaaatactttttaagctaatgtctcaatttttaaatttatagctaacaaatatatttaatcttcagtgcgctagaccaatccatttaaatgaattgttgtttttttatactttcaaattcagttctgaagattttaagtatgggaagtatacttttctttacaagatccttttcttactgtgtatctaatcataggtataatttggtgaccatggttatgttttgcacattgatttccatttgtttcatgttagaaacagtactaa

SEQ ID NO: 7760 - DNA, 1149 bp, Homo sapiens
gggcttgggcgagttgtggccccagcgggttcgggggcgtgtgacggcgttagggaggggcaggccgggctgggcggatgcaggccggcccggcatagggcgctttctccgcgcttcctgggggtgaggggcgtggggcgagggcagggctgtggctccctggccccggggctggaatgtctcatctgcctggggatgggcttctctcaggttgaggccgcgcactgccaagcctcggccgccggcctctgaagctgttgcgagcggccggttgcggtagtcgtctgcttggctgcgaggttgggtgtgtgcagatgatttctctttcccagtccccatgagctgatctgggtgcacgttcagggaaagacgggactaaactgcttctcatttccctacctgttgctggcgagaggacgcctctgtgttttaaagaaaagggtggttaaacctcgcgcgctgaagtcggggtattttcctgtattactcttattttgtttttaaatatgggaagacaatgcagaactcttgggaattatcgagttctgataccccaaaagaatgaaatcaaacttctgttaatgggatgatgggtcgtggaatgggacaccttgggcacttgctaacaggaacataggaaaattggagttgaaacttcgcaggctctgtaagaatgtggatgactgctacagaataaggctgacttcctgtaattatgatatttagtaacgcgatgtgtttaaaagtctacgtatgtatagatgaagtggactctgttatttgtgtctttctttacaagtgaggaaatattcagtcagtgtgctggaaagttctacagatttcgccatcagactatccattcctattcttgaaaaatctgcagtgctggagttatttgcaattcccccccgccaatctttaaataattgtctcagagatatagatagatatagattgcccacgggtgatttttttaatcccggttaccacttgtaataaaagaggttgaattttggagagaattgatatttaaattgcatgtttttttttctgtattataattatgcacattgatttagttttaaaattagtgaggttggaatgttagtattttgatttgaaatctgggatctttggaggtgatttaag

SEQ ID NO: 7761 - DNA, 1049 bp, Homo sapiens
acagagtaagactccatctcaaaaaacaaaaacaaaacaaaacagaaaaatcaagtacattctataatgttggatgagctaaaaaaaaaatgcacgtacataaagtgaacctgtccctgactttcaagagcatacagatacattccattacatagataaattacattaaactgtagcaagtgacaaaatagggtaagcacagagtgtttggggagcacagaatctggccattcacacagtctagggcttcagagaaagctttctgaaggagacaactcatgagttaagtgttggaggataagtaaaatttagtggggcaatgaaaaataggaaaagcatttacagttgaggacgcagtaagatccaaggcatggatgtacaaaataacggcagaagtggaaactctaagcaggtgaaacattgtaaaataaggaagtaggtaggaaccagatcttggagaagtttgtgtgctaccctatggagcttggcttttaagattgatgatcaatgtagtgctttttgggtttttttgtattgtttttgagatgcagtctcactgtgtttcccaggcttgagggcagtggcgtgatctcagctcattgcaatctttgcctcccaggttcaggtgattctcctgccttagcctcctgagtagctgggactacaggcatacaccaccacgcctggctaatttttgtatttttaggtagacacggggtttcaccatgttggccaggctggtctcaaactcctcacctcaagtgatccacctctcttggccacacaaagtgctgggattacaggcatgagccgccattcccggccaatgtagtgggtttttgttttgttttgttgttttccctgagacggagtcttgttttgtcacccagtctggagtgcagtggcacagtctcagctcactgcaacttccgcctcccgggttcaagcaattctcctgcctcagcctcccgagtcgctgggattacaggtgcctgccaccgcacctggctactttttgtattttcagtagaaacagggtttcaccatgt

SEQ ID NO: 7762 - DNA, 1050 bp, Homo sapiens
tttaaggtttttttcatctttaaggttcttttcctgaagagaattcccatcagcaacagattatctctttaaagcatttttacatgttatatgttctaatatatacaattgtatagaaaagagcaaaatgaaccattacccatttcaatatttatcatgtgcagtcttgatttttcattttttcaatttttattttttaagagacagattctgtgttgcccagcttggtcttgaactccaggcctcaggcgatcctctcacctcagcctcccaagtagctggaattaccggtgtgagccattgtcgcctggctgcaatcttgttttttatacttaatccacatcccacctccccaacccagaatattttgaggctaattccatacatatttacatatatatacatctctcaaagaaaataacttattttccattcttcatatatctattcctataaataatgttcttgggggaaaaagttttcacatttaatttttagtgttaccaatttgagcattaatattttcttcctactagggactggtttggctgaaagacaaagaagcaacacattgtaaactttgtgaaaaggaattctcactctctaagagaaaggtaagggagataagaagtgagtccaaaaatttggagtgcaaaaatgctaattttatttaaagtgtttttttccctctgatttttctgtttaatagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaac

SEQ ID NO: 7763 - DNA, 1027 bp, Homo sapiens
caacagtagtttgcaaattagcactctgcaacagggctgattttgccgttactgaagttaaactgatttagcaattgctgtaattcttatattggaataaagtttgttgtaaaatttttcacatggcatagaagtgtaagacaattagaatcttacattcctcctcttagttccattcccaagatgtaaccagttttaatattatggtgtgtgcctttccaaggcattttctatgcttatgcaatatttatgtatatgaaattaattaatggtataaatggtttagcaaggattttttcgtggctggcaaatgagtcagtattttgtgactggaaaaccctgtgctgctgaacttgtttactgaaaaatatttgtgaaagaaaatgtctgaaaaatgcattacaaaggccaaagtaataaaccaaaagggtgattttagtaaagaatacataacaactgtcgtgtgagaaatagcactgagcttctgtgtgttatttgtcattcaagggtgcaactggaaactgacttgaagattgagaaggaatggaggcagactttgcaggaagatcttcaaaaggagaaagatgccttatctcatcttagaaatgagactcaacaaatcattagtcttaaaaaagtaaatagtggtaaaactttaaaaattctgtcttgacaaatgttaacttatttaaaaagataaatcataatttacattataccaaggaaatggatatactagtcatcttaaaaaatatcagtaaagagattaagtaaatggaaaatagttgatacagcagctaggaaagagctttggacacaatttgtttcttttaaaaagctaaaggatgtttgtttctaattaatggtatatgtacaatctggagtttcttgtttctttcttttaaatttcattttctgtcttttattgttctgaaggagttccttaacctccaggatgaaaatcagcagttgaaaaaaatatatcatgaacaagagcaagctcttcaagaactcggcaacaagctta

SEQ ID NO: 7764 - DNA, 1065 bp, Homo sapiens
tgcccattagtatttaatgggttgagggcttcatcaacacccaatatgagctatatatgagataaaaagaaacctgaggtaactcatcaccatgttgttctttgattcctggagttcctagctgatcaaacttcttctctttactttctggagtcttctcttgttgttgttgttttgagatggagttttgctcttgttgcccaggctggaatgcaatggcgcgatcttggctcactgcaacctccgcctcccgggttcaagcgattctcctgcctcagcctcccaagtagatgggattacaagcatgtgccaccactcttggctaattttgtatttttagtagagacagggtttctccatgttggtcaggctggtcttgaactcccgacctcaggtgacccgcctatctcggcctcccaaagtgctgggattacaggtgtgagccactgcacctgtaatttgagaaattaatatttctcaaatataataatttgagaaatttgaggaattaatatgtagaattccctggctttaggccaggaagtattactgtggttaaaaacctacaggctgggcctggtggctcacgcctgtaatcctagcacttttgggaggctgaggcaggcggatcatgaggtcaagagttcgagaccagcctgaccaacatggtgaaaccccatctctactaaaaattaaagaaaaattagctgggcatggtggcaggcgcctgtaatcccagctactcagaaggctgaggcaggagaattacttgaacccgggaggcggaggttgcagtgcgctgaggtcacgccacttcactccagcctgggcgacagagcgagactccgtctcaaaaaaaaaaaaaaaagacaacccacattatttctacattgtgaaaactgtgaaattgaaatccactcccaaagccaaaaacagggccaggtgtggtggcacatggttgtaatcccagcactttaggaggctaaggtgagaggattgcttgacgccaggagtttaagaccagcctgggcaacatagtgagaccctgtctctacaaaaagaaag

SEQ ID NO: 7765 - DNA, 1024 bp, Homo sapiens
cactgcagccttgatttcctgggcttagtaatcctcccatctcaggctcctgagtagctgagactacaggtgcatgtcaccatacctggctaatttttgtatttttgtatttatttatttgttttggtggacacggggtttcttcatgttgcccagaacgatctcgaactcctgggctcaagcgatctggccaccgtggcctcccaaagtgctgggattacagccgtgagccactgtgcctggcctcttttttttttttttttttttttaaagagagaggggtctcactctgtcactgaggctggaatacagtagtgtgatcatggctcactgcaacctcaagctcctgggctcaagcaatgctcttgcctttacctcccaagtagctgggactataggcatgtgccaccatgccagctaattaaaaaacttattttattttatttttttgagatagggacttgttcctctgtcgcccaggctggggtgtagtggcgtgatcataactcattgcagctttgaactcatgggctcaagggatcctctcacctcagcctcctgagtagctaggatgatagtagcataccaccacacctggctaatttttatagggacaggatcttgctatgttgcccaggctggtcttgaactcctggcctcaagcagttctcctgccatgatcttccaaagtgttaggattacaggcgtgagccactgcacctggccttaaatttttttttagaaatgaggtcttattatgttgctcaggctactcttgaatgcctggcctcaaataaacctactcagaaggtgggattacaggtgtgagccaccatgctcagctctttagccattcttttagggtaggtctgttggcaataaattctattttaccttcatttctgaaagatattttcactgggtatagaattctgggttggcagttcttttagcactggagaaatcttatgccactctctcttggcctttatggttttctgattaaaaatacactgtcatttga

SEQ ID NO: 7766 - DNA, 1034 bp, Homo sapiens
aaatgctttcattttaacaaaaactgcgtttgaaaatatttacttactttttgagacagagtcttactctcttgcccccgctggagtgcagtggtgtgatttcagctcactgcaacctttgcctcctgggttcgagtgattctttcacctcagcctctctggtagctgggactacaggcgtgtgccaccatgcctggctaagtttttgtatatttttggtagagacggagtttcaccatgttggtcaggctggtcttgaactcctgacctcaagtgatccacccaccttggcctcccaaagtgctgggattacaggtatgagccactgcgcctggccctgcatttcaaaatatttattgccttgttatagggcctggttgattccctttagtggacttaaaaggtgtagtctgcatattgaatggaaaatctttcttaaagtatatctaatttttacatcctgaagtggcatgtgaattgaggatacattgaaattgcaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcaggtaaggattgttcttaaatttcattttatgtaaattgaaagtgaatatttgtagaaaggttttggtttttaagagatgagcccattttattttaactgtgcaatattataaaggccaatgtctttttttttctaaatgaaagcttaagaaatgtaatgaaaaaggtatcaacaaacaaaatatcacctgtctaaatttttaatgttgaaagattaagagtatgaagattaaatcttttgggaaaactctcaatttaaactgcaaaacgtttttgtgaacttccttttccagtgtagttctaagaaagatttaattttgattgaaatgctacactatcaaaatagtaaattttctttctttgttttt

SEQ ID NO: 7767 - DNA, 1022 bp, Homo sapiens
tgggataataacgagcgtgttttccttatgaacgtttctgtgaatgtgacagaccttttgctagttgtgagattttattttctgatgtttatggccatgcacataacctgcaaagcaagtataagggtgtttaaaatcttttttcttgcccgtttcttaatttttagttagcaatagcaaagaataacatcattaaactccaggaagaaaatcatcaattacgaagtgaaaataaattgattttaatgaaaacacagcagcacctagaggtaagtatagactgctttcaagcagacaatctcgtgtcagaaattaccatttttggggatttttggatgaagtaggtatttctatgctgtattaatagtagtgattatagaatgaaaaattttgttttcttcctaggttaccaaagtagatgtggaaactgagcttcaaacatataagcattctcgtcaggggctagatgaaatgtacaatgaagccagaaggcagcttcgagatgaatctcagttacgacaggtaggttatattaaaaattacattagcaagatcatcctgggagtaatttaccctcaagcaagcaccatttaaaatctttttcagccttatcctttttggtgtggtatgtagcaagctcaccccttaatcttctcaaattttctaagcttccactatatcaatgttttattgttgttttgagacagattctcactctgtggcccaggctggagtgcagtggtgtgatcttggctcactgcagcctctgcctcccgggttcaagtgattcttgtacctcagcctcccaagtaattgggagtacaaggcatgtgccaccacacccggctaatttttgtattttttgtagagatggggtttcaccatgttggccaggctggtcttgaactcctggcctcaagtgatctgcctatcttggcctcccaaagtgttgggattacaggcgtgagccactgcgcccagcctattgttgttttgagacagagtcttgctctgtcactcag

SEQ ID NO: 7768 - DNA, 1026 bp, Homo sapiens
taatttaaaatttctggtaactataataaaaatgtaaaaaaaaccccaaaaattaaaaatatattttattttacccagtattccccaaatattcttccaacatgcaatcaatataaaaattagggtacaggcacgatgtctcactcctgtaatcccagcactttgggaggccgaggcatgtggatcacttgagatcaggagttcgagaccagcctggccaacatggtaaaaccccatctctactaaaaaatacaaaaattagccaggcatggtggcatgtgcctgtagttccagctactcgggaggctgaggcaggagaattgctcgaacccaggaggtggagattgcagtgagccgagatcacgccattgcactccagcctgggcgacgtaacgagactccatctcaaaaaaaaaaaaaaaaaattaggccaggtgtgatggctcatgcatgtaatcccagcactttgggaggctaaggcaagaagatctcttgagcccaggacttcaaggctgtagtgaactatgatcgcatcactgcattccagcctcggtgacacagtgagaccttgtctcaaagaaaaaaaaaaaactattattagcctggcatggtggtacatgtctatagtcctagctactttgaggctgaggcgagaggatcacctgagcccaggagtttgagataagcctgggcaacataatgagacccccatctcttaaaaaacaattattattaatgacatattttatactctcttttttttggcactgtctacaaaatccaatatatattttacccttacagcacatttcaatttggactagccacatttttaagtgtttagtagccacatgtggctcatggcggccatactggacagcacaggtatagcgagtaatatttgctatgtaattagaaatgaagtgttttcattaatcacatttaataattagtaaaatattctctgggtgataggattatgaataatttttattttattctttgtacttttctatattttctgag

SEQ ID NO: 7769 - DNA, 1109 bp, Homo sapiens
tgctgagattacaggcgtgaaccaccacgcctggcccgagagtcaggtttttaatacagaatcttcatcagatttaaatagaacttaaaacttattgctgtacccttgacaaaaaaggctaaggtaaaagtttgtatcagtttgatggttcagaaattcatttttcctacttcaaagggcttcatatgtaaatgtggctgtctgtcatcttctgtggtggaaatttttgctttcttacattgtcaactggtcattgaagccatcagtgaatactcttgttgagaagaatttttgagacctgtatgtaaaatagcaaagtgcaattctaatagaaatatatgagatgtggccaggcgcagtggctcatgcctgtaattccactttggaaggccgaggcgggtggatcacctgaggtaaggagtttgagaccagcctgcccagtatggtgaaaccttgtctctactaaaaaaaacaaaaattagccaggggtggtggcggtcacctgtaatcccagctactcgggaggatgaggcaggagaatcacttgaacccaggaggtggaggttgcagtgagtcgagatcgtgccattgcactgcagcttgggcaacaaaagtgaaatgtgaaactccgtctcaaaaaaaaaaaagaaaagaaagaaatatatgagatgcatagtttttttgtttgtttgtttgtttgtttgtttttttgagacagagtctcactctgttgcccaggctggagtgcaatggcaccgtctcagctcactgcaacctctgcctgcccccagggttctagcgattctcctacctcagcctcccgagtagctgggattacaggtgcccaccaccacgcacagttaatttttttgtattcttagtagaaacggggtttcaccatgttgaccaggctggtctcgaactcttgacctcaggtgatccacttgcctctgcctcccaaagtcctaggattacaggcgtgagccaccacacctggccttttttttttttttttttttttttgagacagggtctcactctgttgcccaggctggagggtagagggcagtggcatgatcaagctcaccacagccttgacattgcaggct

SEQ ID NO: 7770 - DNA, 1027 bp, Homo sapiens
tgaaaccccgtctctactaaaaatacaaaaaattagccgggtgcggtggcgggcacctgtagtcccagctactcaggaggctgaggcaggaaaatggtgtgaacccgggaggcagagcttgcagtgagccaagatagtgccactgcagtccggcctgggtgaaagagcaagacttcgtctcaaaaaaaaaaaattaataaataaaaaataaaaaatataaaaagttattcacacgtataaaggctaatttgaaggcacctaactgagatggcttccatttctgtaaggtagaagattaggaagataatggtgattttaaattttagtttttgaaataaatttgtgatttaaagtccttattttttaaattttcacagtgagttttatgagtatcacgcactaatgatggaagaagaaggagcagtaattgttgggctgctggttggcctgaatgtgatcgatgctaatctgtgtgtgaagggagaggatttagactcacaagtaagtgaaagtgactagtgccaaatgcagagtgttttcagtttgcacagttcctccttgatcaggtgtcatttgaagttgtaaacaggactgttaaacactaaaggaatattaagagtaacattcagtaaaggtacttctgataaagtattttctcccctttaaattaaaaaaaactttatttacttcaggttggagtgattgatttttctatgtatttaaagaatgaagaagatattggaaataaagaaaggtatgattttcataagttatttcacatattgggttttttatatagctctttacaaatcattataagatccatctatttacagtgtggttttattttgttgttttcccccctgtgacttcttcatttcattttcacttccattacaagctttacaaagcagattatggaaaatcacttaggagaaggaggttttattaatagtatgaagtgggacctttggttatacctgtagttactgagacccattttaatagtggttttttggaataaaag

SEQ ID NO: 7771 - DNA, 1363 bp, Homo sapiens
gggaaggatcaagatggcagtgcaaatgcaaatgccaatgccattaactgtgatcaggaccagagaaggagcatcaggttcagcagggatgaggaggagttctgctttgaaagtactgtgctttcacagcctgggtttagctaagtggagagatctcactgcctactaaatatccaaacccaaagcttgggtgaggaaccaggtaggagaggagtgtgaggtcaggcctaaagatggaatttggaatttggaggcacgtgagggcctgggaccctggagcaaacaatgagaaagagtagtacaatgaaccagggaagggactctagggaataccagagcttaagggacagatagaagacagggagaaggtggcagaaaagaagcctgcactccaggttagaggaaggaagagccatgcattcaggatccctctggggatggtgaacccgtgttcgactgcaagggtaaatgaattttcagcaaatgttgcaggttcccaattattaattgctttgaccttggtgccttggaccttccccttccctctgccttttcccaccaatccagggcctcatgctgtccttgattggcaagtgtgactgagggctggtagctattttaatagctattctggcccattcattcttttagcagatagcagcatatttcttatacagactatgcgaaatggcgagcattcatgtatatttgttttgttgttttagaaacttgtcggtccttccagaatcaactttgttcagattagaccaagaagaaaaaaattgtgatatagataccccattaggaaatctttccaaattgatggaaaacacgtttgtcaggtttgtaacaatgagcaaatttgaatttcactccacttttctaaggaatattactaaaagtgctttttcacttttcagcaaaaaacttcgagatttaattattgactttcgtgaacctcagtttatatcctaccttagttctgttcttccacatgatgcaaaggatacagttgcctgcattctaaagggtatgctaaaatcaccatgtctgctttgattaatttttcttgtttctatttgatttatactgtagtctaatatcttgattagacttgcaactacaatgtttagaccaagactctttggaaatggttttgtattgaagaatagacttggatagagactgcttttcttatgaaataattaacttttcctttgaaattcaacactctttttcctgttatttttgaatttaaatgtaggtttgaataagcctcagaggcaagcgatgaaaaaggtacttctttcaaaagactacacactcatcgtgggtatgcctgggacaggaaaaacaactacga

SEQ ID NO: 7772 - DNA, 1048 bp, Homo sapiens
ctattaatatttttatttaggctggaccttgtgagccaccacgcctggcctaaataaaaatattaatagtagaataattgataggaaaatatgggcaggcaaggtggtgcacgcctgtaatcctagcacactgggaggctgaggtgggtatatcgcttgagaccaggagtttgagaccagcctgggcaacataagtaaaacctcgtctctaccaaaaatacaaaaattaggaggtggtgcatgtctttagtcccaggtactgtggaggccgaggtgggacgatcagttgagcccaggaggttgaggctgcagtgagctgagatcacacctctgcactgcatgtagcctgagtgacagagtgagaccctgtcttaaagaaaaaaaaaaaattgtggcagagaccaatatccatattcacgaataatccatattccctcctctttcacagtcagatggattgtgttttccagcatttcttacagttaatacgggcatgcccgaccatttcttaatggatagaggtcagcaattgggactcattgacatctgagtaactgtaatggaaatgtccaggcttgttccctactgatcagtaatcttagttgagtcataaccaccccttgtctagatgtcatgacatgggatggtgatccacaatattccagttgtctgcttggatttgtgtatcctttgcagtatttatttagtgtctaccatgtattaagcactttgcaaatccttgaggaatttatggtcttgcgtgtagacatacatattttctttttttttttgacacatggtctcactccagcccaggctggagtacagtggcatgatcacagttcactgcagcctggacttcctgggatcaagcagtccttctacctcagcctcttgcatagctgggaccacaggtgcatgccaccacacctggctaattttttaattttttgtagagatggggggggtctcactacgttgcccagcctggtcttgaactcatgggctcaagtgatcctcctgcttcagccttctgaagtgctagcat

SEQ ID NO: 7773 - DNA, 1070 bp, Homo sapiens
ctaacattttactgtaggttgtggaaaatgtaaaaatgacaggctcaatattagtctgttttgttttgtttttgtttttgtttttgtttttgagaggtggttttgctcttgttgtccaggttgttgagcaatggtgagatcttggctcactgcaactttcacctcccgggttcaagtgattctcctgcctcagcctcctgagtagctgggattacgggcgagcaccaccacacctggctaattttttatttttatttttttttttttagtagagatagggttttcaccatgttggccaggctggtcttgaacatctgacctcaggtaatccacccgcctcggcctcctggagtgttgggattacaggcgtgagccaccacacccggcctcaataataatttttaggagtcagatgaacaagtaagttgtaggaaaatgcagacacaatacttacgtatgtaatataaacagaagtttttttctctttggtcttttcatagggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacaggtaatgaaatgttactttttttgataacagctttattgatatataattcacatctgtgtagttcatccatttaaaatgtacaattcgctggtttttagtatattcacagcgttgtgcagctatcaccacaatcaactttgagtattttcatcaccccaaaaagaaactcccaaggaagaagccctataccctttagtagtcacttttcattttcctccaatttccccagcccgtggcaaccactaacctgctttctgtctctgtagatttgcccattctggacatctcatgtaaatggaatcatgcaatatgtggtctttggtgactgggttttttcac

SEQ ID NO: 7774 - DNA, 1090 bp, Homo sapiens
tttcagcctttggtgtctaatgttaaccctggagtcacaatcgaaggataataaaaagaatcaccaaaatatctggctaatgcctgcttcggaaatgtaagtggtccatttagtacagtaagatttcagtagtttggattagtgaatgaggtggcctttggaatttatgacaaatacaagttatgaagcatgttatagataacgtgatttcatttattcatgacaactgcagatggctctctattgtttctaagaagagcaccattcctgtgtatcctatgtgctgcaatcattgctagttagtaatatagtttcagtagactaaatatacctcaagaaatcttgttttaaaaattacttttctttgggaggccgaggtgggtggatcacctgaggtcaagagtttgagaccagcctggccaacatggcaaaaccccgtctttactaaaaatacaaaaattagctgggcgtggtggcgggtgcctgtaatcccagctacttgggagactgaggcaggagaatcgcttgaacctgggaggcggaggctgcagtcaaccaagatcctgccattgcactccagcctgggcaacaagagcaaaactgtcacaaaaaaacaaaaacaaaaaattagccgggcgtggtggcaggcgcctttaatcccagctactcaggagactgaggcaggagaattgctggaacccgggaggtggaggttacagtaagccaacatcgcaccactgcacttcaacctgggtgacagagcgagactctgtctcaaaaaaaaaaaaaaaattacttttgtcagggcgtcgggtcatgcctgtaatcccagcactttgggatgccgaagcaggtggatcacttcagctcaccagtttgagacccgcctgggcaacatggcaaaaccctgtctctacaaaaaatacaaaaattacctaggtgtggtcgtgcatgtctgtagtcccaggatgaggtgggaggatggcttgagccagaggtgaaggttgcagtgagctgagatcacaccactgcactccagcctgggtgatagagccagaccttgactcaaaaaaaaaaaattattttaaat

SEQ ID NO: 7775 - DNA, 1033 bp, Homo sapiens
atgtttattaattcatttgaaattaacatgtatattcatttttgctgtggttgttattgagacagtcttgctctgtcacccaggctggattgcaatggcatgacctcggctcactgcaacctccacctcctgggtcaatcaattctcctgcctcagcctcctgagtagctgggattacaggtgcctgccaccacacccggctaatttttgtgtttgtgagtagagacagggtttcaccatattggccaggctggtcttgaactcctgacctcaagtgatccactcgtcttggcttcccaaagtgttgggattataggtatgagccactgcacctagcctaaaatgtatttcattcaaaaatatcaatctatgcttgttaacataacattttaatgaaaaaactattgtaaaaaaatgtaatgaatgtcattgttttacatttttttcagtttctttttgctttctttcttccttatttattttttttgaggtaaggtgtctctctgttgcccaggctggagtgcaatgatgaaattatcacccactgtagcctcaaacaatcctccagcctctattttttttttttttttttttttttgagacggagtttcactcttgtttcccaggctggagtgcagtggcatgatctcagctcaccgaaacctccgccttccgggttcaagcaattatcttgcctcagcctcccgagtagctgggattacaggcatgcaccaccatgcctggctaattttgtatttttagtagagatggggtttctccacgttggtcaggctgatctcaaactcccaacctcaggtgatctgcccatctctgcctcccaaagtgctgagattacaggcatgagccacagagcctggccattttttttctttctttcttaaagctacagcacccaatattcccaggtggtctcccatccaagtagtaaccaagctcaaccctgcttagcttctgagataagatgagatcggctgcgttctgggtggtatgggtgtagaccaagcctctattt

SEQ ID NO: 7776 - DNA, 1050 bp, Homo sapiens
ctttgtcgcccaggctagagtgcaatggtgtgatctcggctcactgcaacctcggcctcctgggttcaagggattctcctgccttaacctcccaaatagctgggactacaggcgcctgccaccatgccttgctaatttttttgtatatttgatagagacggggtttcaccatgttggccaggctggtgtcgagctcctgacctcaggagatctgcccgccccgagctgccaaagtgctgggattgcaggcatgaagcactgcgcccagccgattttaaaaaattttttgtagagatgaggtctcactgtgtttcccaggctggtctcaaactcctagtctcaagtaatttttctacctcagcctccgaaagtgctgggattacaggtgcgagctactgtgcctggcctgttattcacctttttataaaaggagcaacccattttttcaagtcattactagatgtacagtattgtagagaagtctatattattgctttagaagcatgccaagctcgaagggctggcctggactctgacctatgctaaagcccatgtatgcactttattctactttcatctatacttttccccagtggcacatggtagggtcgaaatacatatttgctgaatgtataaatggatgactaattttatgggtaaaagttggttgtttcaatgaaaaatgatccagaagaagaggagtttacttcaaacagaacctggcaatcggataaataccttcaagtgtctgtctccgtaaaaatgttccagaagaagaggaggttacttcaaacagaacctggcagttggattaataccttgaagtgtctgtctccataaccacattttagcaagattcccagccttcctcaggtattagatgacgatttacactactaaaatttgttttagtaagttttagcagtgtaatcatgctcacttattaagttacaggaaatggggaccagtcatctgcatatctatacgctgtgggcagatttactcatggagactgaattagagattagagggtttgctggctgaacaact

SEQ ID NO: 7777 - DNA, 1192 bp, Homo sapiens
cagccggccggttttaattagaaactgtcaaagtatttctaaagtgtctattccattttgtatccccactgccttgttggcacttgatattaaatgtgagtatgtgtgtgtctgtgtgttccttttttttttggagacggagtctcactttgtcaccaggctggagtgcagtggcgcgatctcggctcactgcaacctctgcctcccaagttcaagtgattctcctgcctcagcctcccgagtagctgggactgcaggcacgtgccaccatgccggctaattttttgtagttttagtggagacggggtttcaccatgttagccaggatggtctcgatctcctgaccttgcgatctgcccgcctcaacgtcccaaaatgctgggattacagatgtgaggcaccatgcctggcccttcgcctggctaatttttgtatttttttttttttttttttgagacagagttttgctcttgttgcccaggctggagtgtaatggtgcaattgtgaatcactgcaacctctgcctcctggattcaagcaattctcctgcctcagcctcccgtgtagctgggattacaggcatgtgccaccaggcctagctaatttttgtatttttagtagagatagtgtttctccatgttggtcaggctggtttcgaacttctgacctcaggtgatctgcctgcctcggacttccaaagtgctgggattacaggtgtgggccactgcgcctggcctaatttttgtatttttagtagagacggggtttcaccaagttggccaggctggtcttgaaatcctgacctcaagtgatcctcccacctaggcctcccaaaatgctgggattataggcatgagccattgtgcccgggtcaattgtttatttacagattgtctatctaatattttttgaacatggatgactggtggtaactaaaactgcagaaagtgaaattgcagataaggggggactatcgtagtgtgaaagcaagttaagatactattaaataggctgggtgcggtggctcatgcctgtaatcccagtactttgggaggtagaggcgggtggatgacgagatcaggagttcaagaacagtctggccaacatggtgaaaccctctctctactaaagactaaaaaaagaaaaaattagctgggcgaggtggtgggttcctgtaatcccacctactcgg

SEQ ID NO: 7778 - DNA, 1597 bp, Homo sapiens
taaatcagagaacaaaatatctatggccgggtgcactggttcaggcctctattctcagcactttgggaggctgagtagcggggatagcttgagctaatgagttggagaccagcctgggcaacatagtgacacccagtctgtacaaaaaatacaaaaattagctgggcatggtggcgcccacctgttgtagtcccagctactcaggaggctgaggcaggagaatcacttgaacgcgagaggcggaggtcgcagtaagcccagatcgcagcactgcactcaagcctgagcaacagagccagattccgtgaaagggggaataaaaagagctatcgttgttggctaagttaaatgcactttgacaaacatgttgtgtaatgaccaccatagtcaagatatagagtagttccaaaatatttccacttttattttttttttgagacattctcgctttgttgcctaggctggagtgcagtggcctgattatcactgcaacctccacctcccgtgttcaagtgatcctcctgtctcagcttccagagtagctgggactaccggtgggtgccaccacttctggctaattttttttttttttttttttttttgagaaggaatctcactctgttgcctaggctagagtgcagtggtgcaatcttggctcactacaacctccagctcccaggttcaagtgattctcctgcctcagcctcccgagtagctgggactataggcgtgtgtcaccacacctggctaattttttgtatttttagtagagacggggtttcaccgtgttagcaaggatggtcttgatctcctgacctcgtgatccgcctgcctcggcctccgaaagtgctgggattacaggcatgagccaccgtgcctggcctaatttttgtattttcagtggagaccgggtttcaccattctggccagactggtctcgaattcctgaccttaagtgatccacctgccttggcctcccaatgtgttagaattacaggcatgagccactgtgcctggctttatttccacttttctttgacaatcctctcctctcatctgcaacccttgtcaaccactgatctgtttttctatctctgtagtcttgacttttccagaatattatataaatcgggtcatatagtatgtagccttttgagtctgacttccatcacttaccttaatgcatttaagattcattcacattgcacgtataagtaatgtatttccttcttttcttttttcttttttttttttgagacagagtctctctctgttgtccaggctggagtgcagcagcatgatctcagctcactgcaacttctggctcccgagttcaagcgattttaccgcctcaacctcccgattagctgggactacaggtggtgtgcgccatcacgcccagctcatttttgtatttttagtagagacgggtttcactatgttggccagactggtctccaattcctgacctcaagtgatctgcccacctcagcatcccaaagtgttaagattacaggcatggccgggcgcggtggctcacgcctgtaatcccagcactttgggaggccgaggcgggcggatcacgaggtcaggagat

SEQ ID NO: 7779 - DNA, 1022 bp, Homo sapiens
tcatgcctgtaggtttaattgcaggtgccagtttgctgatggctgccaaagttggagttcgtatgttgatgacatctgattagcagaatcagatgttccagcttggactcatgaaggattaaaaatctgcatcttccactattttcaatgtattaagagaaataagtgcagcatttttgcatctgatattttacctaaaaaaaaaagaccaaatttggcggaggggtggaaaatcagttgttaccattataaccctacagaggtggcgagcatgtaacacgggcttattgagaccctcatagagatcgattcttgtatattgattttatctcttctttctgtatctataggtaaatctcaagggtaaaatgttaggtgttgacattgagaaccctgaaaccccattccctgctcagaggaacagtgtgaaaaaaatctcttgagagatttagaatatcttttcttttgctcatcttagaccacagactgactttgaaattatgttaagtgaaatatcaatgaaaataaagtttactataaataataaaaaaaataaaaaaatcaaaacaaaacaaaaacaaacaaaaacaaacaaaaaagatcgctaagattcaagacaatgcttattaaaatgtacaccatttcccccatttcataatatattggggtacatgtcaaatgagggaaagctttcaaagaaggctttttaggtagttattgttatatatggtctgtatggtaattttgtgttgtctgtattcaaaaaccatttgtcattttggggatgagaataactttatttgaaacgctaattcgctgactaaccctgagtctgggaatgcctccaaaatgtctaggtgatgtattactctttatataggatacctattcattgtaagtttcacctttccttcaaagcaacccttggtacatcataggtttaacacccatagccacctacacattccttccagagcacatttacctttctccaaggtctaagccttggacctgggcatttg

SEQ ID NO: 7780 - DNA, 1050 bp, Homo sapiens
gtagcttatttacacaagggtatgcattcaattaaatatgtattgagtttatgtcttaagtaaattacttatggatctcatctagttgaagttctatatttaataaatgaaattatcaacatgcagactgagtaacaaagatgttggaaagttatttaagatgtaaacatgttgcaataatttgcctacagctatgccttttcagatagcctcactttccaataagaatgtatttcaattatgtttatgacctggtctatttggtactttgtagatgaattggaaacaagaggtaggtgagacagacaagcacaagaaaaaaaagaaatttcaacaatggctgaagagccattagaaatggaatttcaggccaggtggagtggctcatgcctatcatccttgcactttaggaggctgaagcaggaggatctcttggggccaagagtttgagaccagcctgggcaacatagtgagacagtctctacaaaaaaaaaaaaaaaaagaagaaaaaagaaaaaagaaatggaatatcaagggcagcatgatattttgtacgattctgcaataggcaggaattattctctcattaaaattggtaagtttgtagcatattatgaactgagtgggctattaggaggtcatgtatcagtgaattcaatgatcatactatgaacaaacgcagatttaaaacccaatttaagtgttataagagaggtataagaaaaggtgatcattacagtaaaacataatagaggggtagaaataatgttagatgaccagttttatgagagaaaatgtcatttcaaacaaatttatttccttgcttcatgagaaagagcattctaaaagcagtgtagccagcatacaatcacaatgctgcagaacattgaataagcttttaaaaaaaatcacagggcagagaatgggatggtaaattgttaaaatcaggaaagagagtccaacaaagtaggaatccaatttggttcccacagtggggtaatcagcttaagaagtccattcatgatgttaactacaacaacggaatggaaa

SEQ ID NO: 7781 - DNA, 1077 bp, Homo sapiens
ctgctacctctggcacttggaatttcagagacaaaaccccttttttaggcagcgagccctgattttcagttccaaagctatgggcactgctgagtgggaccagaggagtggtgtgcagtgagctacctggaggggttgcatgagaccatgtcccctctcctggatggaggtgtcttctggttgccaagaaagtattgagtgataatcagaaaaattccttgattttcatggtttgttgctttgtagcaggtcttaaggaaaaaaaaaaagtttttcatggtttgggacaggtccttagagatgggccacaccagccctggcacacctgagcccagtgttgggccacctcacacctctctcgcctctcttccagctttatctttgtcctgctctttctggagtcctttccttgcatcctgccagctggcatccccttcatccttgcacgcctaccttctacacaaagccttccatgaccatcccaagcctcagggctgattccgtgcagtgggcaggctgtagcctctctgttcacctctctgtgtcacatcttactgggtacatgcccagtaaattccccacaactgagattctgctttgcctgagcagtgccctctggctccttagggatgatgcttgctgaggggtttcctggctttaaggtcatggttcaggctgggctcagtggctcacacctgtaatcccagcactttgggaggccgaggtgggcagatcacttgaggccaggagtttgagactagcctggccaacatggtgaaaccccgtttctactatagccgggtgtggtggcaggtgcctgtaattccagctgcttgggaggctgaggcatgagaatcgcttgagcctggaaggtggaggcttcagtgagccgagagcatgccactgcactccagcctaagcgacagagccagattcgtccccctaccccccaaaaaggggtcatggttcagacctccattgtaggcccacccccttgctttactagctgagggaccttgcctaaattctttagcctctaggagcctaaatttccttatctgcaaaatggagattaat

SEQ ID NO: 7782 - DNA, 1046 bp, Homo sapiens
tggtgcaatcacggctcactgtaacctccagacttctgggctcaagcgatattcctgcctcagcctcccaagtagctaggactacaggcatacaccaccacacccagctaattttttttaaaaaagtgtttttgtagagacagggtctcattatgttgcccaggcttgtctcagtctcctggcttcaggtgatcctctgcctcggcctcatgaggtgctgggattacaggcatgagccaccatgcatggtctccattctctttgtttaaactcctcttttcactcttgattttggagctacctctctggctgatacttctgtctctttgagaagcactagttcttctggttagtccttaaatgttggtgttctccagagtactttctcctaggctggtcccatctactcccttcatttggcacctacatgtcagtgactctcaaatgcatttctctcctctagacctctcctgagctctaatctcatacctaatcctgcctactctcgacaactcctactactgattctgttttcctagaatggaactatttgtctttcccacccaccacctacctggacatgcagtccacaaatctgtgaattaatataaatcctaccatgaccctgatatgcaccataatgctagaaggaactttctcagacttaattgccctacttaatatcctttgatagttctctatcattttcaggataaaatctataaatcttttgcatagcacataggatcattcatgatcctccctctgtttctttttactgcctaccttgaactatattccaaacaaacaacttagccatccttgaatatgcacaagtagctactgcctggctttttcacctgtacctctcctcaacccctcgctttgtcggcaaattttaaaatgttctataagagacctcagagttcagatatgactgcttctggtaagcctcccttgacctctgagactgtgttagactcccaccttaccaatgtctgttgtctttattgatttttttatagttctctctcatcagactatga

SEQ ID NO: 7783 - DNA, 1024 bp, Homo sapiens
gacaagtaatttgtatcctgatgttttaactcagaggttgcaaactagacttggccccaggggcaaggcaagtcatttaagtgagtaaaattggctgactgtaagacagcagggaaattttgtcaagcaaaagtgttcagacatcatctgaaggggcagccactgcttagttcctgctgataattgtcacgtggataagtaggcatgggattgccagatgttgcagtttttcaaaaaaagcggaaactctgattttcaaatttacaaaaatcaggttcagctcatggaccatcagtttgcatcctctgttctgaattaatactggccagaacttggagaaatccatagagtctaatcttactgaaacccgaccaagatttgtccattttatagaccattaggttattcattttcacaatgtatattttttactcatgcaactacaaactttgttttttagcacgtcgcgtttggaaaaattatctcccagcaattaatgggattgtctttctggtggactgtgcagatcattctcgcctcgtggaatccaaagttgagcttaatgtatgttttgtcctttaatgtgtattttaatgtatattttgttcttttttggcctctatttttttttaaggaatatagctcagtagtgccaataattagtcattccagttaacatttggcaaaaagacctagttgcaggaggaaaatgttttaaatctaagacattgcttttcaatgtcctgaggaaactcagctcaaacttaaataaattaactgttgtttctatcatacagtgattatatggccaagtttgctcaggatactcctcatttatgcctgttgtcccagcataattaatagtattctgtttcacgtgtcatgaacagtaattctgttttttttttttttttttttttttttttgacggagtcttgctctgttgcccaggttggagtgcagtggcgcaatcttggcttactgcaacctccacctcctgggttcgagggattcttctgcttca

SEQ ID NO: 7784 - DNA, 1085 bp, Homo sapiens
ttactggcttgggaacttactgctatatcctgaaaagtattctttttttgcttttttgtttcttgagacagggtcttgctctgccacccaggctggggtgcagtgacacaatcatagctcacggcagcctcaaattcctgggctcaagcaatcctcttgcctcagcctcccaagtagctggaactacaagcacgtgccaccatgcctgactaattttaattttttttttttttttttgtagagatgcaggtctctctatgttacccaggctggtcttgaactcctgaggtcagggaggaatcccccacctcagccttgcaaaatgctgggattacaggtgtgagccacgggggcccggcctgaataagtattcttattttaagaaaatctatttgtaaaatgagtttgggtgtgattattcatgtatgaaaagattctcttcttatcccttaatggttctctaaaatagtgatgtcatttctttttataaattgagacccgtgtctgcaaaaatgattaaatattgagataacattggtaaatggagcagggcaagtggtgctggccagtagaattttgggtgacttttgttttttagagttgtttacaggatagattaatatgtttttcattcaaatcaatgtgcttttcattcttattttctatttagtgcatctaagtggcattctgattcacattattgataagactgatttcctagagttgttcttcactggatgacagcagtcgtatgtctagggaatgtgaatgaaccgctgcctggaggagtaagtcacacagtaaaagaaagtgtaggcatacctcggatatactgtgagtttagttccagactactgaaataaaacaagtacagtaaagcaagtaacacgaatattttggtttcctagtgcacataaaagttacgtttacactatactgtagtctgttaagtgtacagtagcattacgtcttagaaaatacgtaccttatttaaaaaatactttatggctaaaaaatgctaacaagcatcggagccttctgcgagtcataacctctttgctggttggggatcttacctccatgtt

SEQ ID NO: 7785 - DNA, 1034 bp, Homo sapiens
ttctattaacatttgtttgaatcatttagccctggaattcgcaagttttcattttaggtacattaatagtgttttgttgatagtttagagacctaccttaaattttagattactcttaacttctcgtaaggtggtacaatggaccaagaatagaaaataaatagaatgctagttattaaaataccattcaaaagatgtgatgagttgtaaggaagagaacttcggaagatcatcctctgtgtagttggtgggttaaagaagttttagtttttttttttttccccagcaattttgtggtttgggtttgaattttatgtactgttaacaggaagagcttaggctttggtgttagagatgagggtttaagccctggcactattactttttcaactgagccgtcttaaaggactcagcaaaactaggagtatcctcatctttatcttgttaaatgaggccagtgatccttgcctggtagggttggtgtggggatgaaatgagatgtacaagtactgtgcagattgtaaaactactgatgagttggtacaaatcctaagatcttaaggagagaggagccaccaaggccattttcagctgctgaggaggctgaggtgggaggatctcttgagcctgggaggttgaggctgcagtgagccatgatggcaacactgcacttcagccttggagacagagtcttggtctgtcttaagaaaaggggggcgggggcattttcttaactttgggtagcagtgcaacccgactctttggatctagtaagggtttttattatttttagctcacctgaagagtttcttcagtcagcctccactctcatcactcctttacaacccaacacttctatatacatttgtactacactggttttcagtcaatactttacagacttgtaaaaaatgtttacatcactttagaaatttttctttctttcttttttttgagatggagtttttgctcttgttgtccagactggagtgcaatgtcatgacctcggctcactacaacctctgcctcccggg

SEQ ID NO: 7786 - DNA, 1034 bp, Homo sapiens
tatagttgtgatctcagcaactcttagtgtgatcaatgcatttttttttcccaggtaaggaaacttgatgccttggcctggttatttaaagggtctgaatgagaacccaaatcactcaccactgagcccaggcctacacgtgctactgctctgatggcaattattttcaatctgataagcatatttgctctacaagggcctaacttgtgcttttgcacatgacgttctttacatttagaaaaagctgctcctactgcttcctgggagtctcaaggcagaaaggaatttacttttgcattaataagaatgttgtgcaaattgccatggtggaaaagtttttatgagttataaatttgaatcaattgctatatagttcattgctacctctgtcgatctttgagatctttccctgattattacaaaacctttaaattaaggaaatacttgccaggaataaggttaagcaatgagaatcacaaggttatgtggcaatctgaacttgaagtctgagagcaatttggcaatatctatcaaaaatttaaattcatacttaatctttgactcagcaattctaggaattcattctgcagaacagtcaaccaaacacatagtatacagcagctttgtttgcaatagcaaaatctggaaaagtacttaactgccccacagaggaatggctgaatctgttactcatacccacagcacttaaagagtgaaatcactgcatggactgatatggaaaagatgttcaaaatatataagtgaggagagaaaattgtagtactctatagtggtaaactatgacttgtgggccaaatccagcctgctgcctgttttgtaaataaaattttattggaacatagccaacatcttttcatttgcaaattgtctgtggctgccttccgtctacagtggagtgttcagtagttaggacagtgaccatatggccccaaaagccaaaagtatttactgtttgtctgtttacagaaaacattttccaatccctgctctatcatatgatcctatttgtgttt

SEQ ID NO: 7787 - DNA, 1076 bp, Homo sapiens
tctatttatttatttagagacggagttttgctcttgttgcccaggctggagtgcagtggtgcgatatcagctcactgcaacttccacctccagtgttcaagtgattctcctgcctcagcctctcgagtagctgggattacaggcttgcgccaccatgcccagctaatgttgtatttttagtagagacggggtttctccacgttggttaggctggtctcgaactcccaacctcaagtgatctgcccgccttggcctcccaaaatgctgggattacaggtgtgagccaccatgcctggccggggattttctattttttaatttgtttctaccaaatttcgaattgacagtgcacttttaagacagttgctttaaaatccctatcaggattcacctcagtgctggcatctgttgattgccctttctcatatgaattgtgattttcttggctcttagtatgatgggtggtcgtcaataatattggagacattttgtctattaggttgggagactgtaggtcctatttaaatctttcattttagcaggcagcactctgtttagctttcgcacatgggtcttggtctacagttgtggtctgtggttccagtggcggtttaattttcagcagctttgcagggttatcttggtctgcatggtttatccagtgctactgggctcctgtttgttcctgctggtgctgcctgaaggggctcattgttgtctttcagtggtggaagggggcgtcccccaactggtcccccacccctgctgccctagtgtctgaattggggagagagtcttgggccacagaaattaagcttcctgaagctttaggccacttgctatagctcggtctttccttcagctcagcctgcccacctacctgcctctgtagctcttggtggaaaaggtgtctcagggcttgcagggaggagagtccctcccctggttgcctgattctggctgggctcccagttgatctcccttgccagtggtgtcagcctcaccagaacaaaccccgtttgatcaggggagaaatgagccttttgctaagtcaggaggctgggtgacaggatgca

SEQ ID NO: 7788 - DNA, 2736 bp, Homo sapiens
gcacgcagccacgtacatatttttaacatacacaggaagagagggaagaagggtgagaagagaagcatttttagaattctgtagtgtacgtgggaaggaagatgagctgctacataccacctttagtgccacactgtatcacagtggtttccaaaccatgacccattgtgcccctctgagttccatggaggtgcccgctggacactggaggggaccctgagtgggctgatctccacattcccacctggccacaggctgcttcacccagaaaacagttctctcctccttagatgtcagaattctctgtaagatttttctggtaagaaaatgattctgccacttaaaaaaacaagtttgaaggctgggtgtggtggctcacacctgtcatcccagcactttgggaggctgaggcgggcggatcacttgagcccaggagttcgagaccagcctggccaacatggagaaaccatgtctctacaaaaaaaaaatacaaaaatttgctagatgtggtggcacacgtctgtaataccagctgctggggagactgaggcacgagaattgcttgaacctggaagatggaggttgcagtgagccatgattgctgccactgcactgcaatctgggcaagagagtgagaccctgtctcgaaattaaaaaaaaaagtttgaaaatcacactatgcaattagcatgaagtgtaaggaagcccaaaagaaaacacctgcatttgctgtagagaaattttgtatgtatgcctgttaattttcaggtaattcatagtaggattcattaaagcaagtatattagtctttgttatatgttaggtgtatttttgattctcaacaggaattctaatttgtttttcttttctctgaatacagtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaacttggcttaggatatttttattttaatctgaagccaacattaagtaggtatgggtattttttggtgtttgttttctgttgatagtcttataattcaaatttataattattagacgaagaaatcgcttatatttatagtactcttgatactatgctctagtacataagtcctagcataccattctaaagcaaaagtttttaaatttatatcatattagcagaaagcacaatgttgctcaccctttgaagttatatattaatagttatttttttacttcttcagtcaactaattggacgcttaagtcatttatattatattctaagttatcagctgaacaaaccagtttgaatgccagcccatcttcttactagctctgtaatcttaagtcagtttaccaaccactcaacttcagttccttcatctgtgaaacagacattattcatgtaatggcatgtagtatgcattcagattcttttttttttttttgaaacagggtctcactgtcgcccaggctggagtgcagtggtgtgatctcggcccacttcaacctctgcctcctgggttcaagtgattctcctgcctcagcctcccaagtagctgggagtacaggcatgcaccacaatgcctgactaattctggtatttttagtagagacggggttcaccacgttggccgggctgctctcgaactcctgtcctcaagtgatccacccacctcagcctcccaaagtgctgggattagaggtgtgagccactgtgcccagcccattcagatttttttaatgaaaattttattgagatgaatatagattcacatgtagttctaaaaaagtaattcagagataattcaaataattctgtataccttaccctgtttctcctaaaagtaagattttgtaaaactatagtataacaaccaggacattgactttgatataatccaccaatcatatacagactccaaatccaccaatcatattcagacttcctagtttcactgtattaatgaatatttgtatgatgtattctatataatttataattctatagtgtaatcacctaggtaagtttatgtatcctataagatattgaacagtttcaacaccacaagatctctcgtgttgcccttttataatcacacccacctcccccctgtcttctgcacaccaccatccgtaacccctggcaaccactaatctgtcctccatttttctatgattttgtcatttcaagaatattatataaatggaatcatacagtatgtaacctttcaggattggcttttcactcagtgtaattccccggtattccttcaagttgccacatatatcaatgtttcattctttttattcattcctttttattgctgagtactttccatgatatgttttgttttacctgttgaaggacatctgggctgatccagtgtttggctattacagatacagctgcaatgaacatatttgtacatgttttcacgtcaacataaaacattttcatttct

SEQ ID NO: 7789 - DNA, 1027 bp, Homo sapiens
taaacatttcccagtgcattctgtaaagtttccatacttttagtgatattatgataatagaatgcatgctattctttatgcagattataaattggattgaagcggccgggcgcggtggctcacgcctgtaatcccagcactttgggaggccgaggcaggcgaatcatgaggtcaggagatcgagaccgtcctagctaacacgaaaccccatctctactaaaaatacaaaaaaattagccaggcatggtggtgggcacctgtagtcccagttactcaggaggctgaggcaggagaatggcgtgaacccgggaggcagagcttgcagtgagccgagattgcgccactgcactccagcctgggagacagagcgagactccttctcaaaaaaaaaaaataaattggagtgaagcaatgttatcttatacaaatataaataagcttttgttattgttgaatgtatttctcttcctcataatacttttcctaactgactttttaggatgtgtatctctgtttgcttgcattgagcaggagtttgttatttgaagtgcagtttgataacattgaggctagccattgttgatggctatacagaaacttaaaatttttaaagcagtgcacttttctgtcagccagaactaaagtattgttatgtacagtgcctgtactatccagcaaagtctagtcacatttaatacgtaacccatcaatggatatcaatctaatctatttttcttatcttttagtatgtaatagtgttgtgatcctctgacatagcctctgcctctggaccagggatagtacctcaagcctgtaatcccagtgctttgggaagccaaggcaggaggattgcttgagcccaggagtttgagaccagcctgggcaacatgacgagaccccatttctacaaaaaatttaaaaattagctgggcgtgtgcatgcttatagtcccagctactcaggaggctgaggtgagaggatcgctgaactgtggaggtcaaggctgcagtgagccttgttcgggcca

SEQ ID NO: 7790 - DNA, 1071 bp, Homo sapiens
ctttatgtctctctcaggtgcagagaaatagtaaacaactaaaaacaaagttatcattttgttttttaagtcataaagtttttgagtcatcgtatgacttgcttaactcatgacttttataaaataaaaggtaaagcatattaagatacgtatttgagactatggaggacttattcttcagtataatcaatgacagtgcaaaaaacattgattaccctgagctatgtactggtttccctatgacctagaagaaaataggacctataagtcctgttttcaactttaataggactgatgaaacatttactcatttaggtttttaaaatttgcttaaaggaacaatcttcaggtaaattctcaagaacttggcctctttcttatttcctgttagccaagtaaaactgtcttctagagtgtggttctgtaatgttgtcctgactttggctattgactctcaggtatgtgcaagaggtgaaataattggcgtgaaagttctaggcatattggctatgattgacgaaggggaaaccgactggaaagtcattgccattaatgtggatgatcctgatgcagccaattataatggtaagaaaatttgaaaagtctgaagtctttctaattaattcataagcaccaccatacttaacctataatgacagaattgtaagcccttaccttcaaactgttaaaggatggaggaacaaagcactggacaagcattatttctatgactgcacttgtaattaactaagtaaactttctccttcattccaggaaagaaaaaatctggtaggttcttactgtttttttggtcctttccttccccacataccagcactcagttggtatgtttatttattttaaaacatttaattgagatattcacatatcaaagagtcaccattgtaaaatgtacaattcagtggtttttagtatattcactaagttgtacaaccatcaccactctctaattgcagaacatttcatcagcccagaggaaatcctgtatccatgggcaatcactccctgtcccccttccctcagtccctgatgactgcagatctactttgt

SEQ ID NO: 7791 - DNA, 1050 bp, Homo sapiens
ttttctgaaactgttaacagagagctgagagctctgatgccagagcaatgactgagactccaaagcatggtaggattggaggatggagttctgggaagtcctaacagtgggagtaacaagatagtaaatccaagatccagctaagtaaaagctgaaaccagttgggattaaagaagaaggaatgaatttgtaactgggtagtacgaaatttcttaaaatcagtattttttaagtgcgtgaatattggaatcattagaatgcataaaaacagtaatagtttttatagcaactctgttgctataaaattcattgaatttctcatatcagttgccctgaaaaatcctaaatatcactgttgttcacctagtagcaactctttgaattgtagccagatgtctagaagaaggttgttctttagtagtaattcctgctaaagtatgtggaacaccccctccttacaagtacagagctgggcaggatggcttgcacctgtagtcccagctactagggatgcataggcaggaggatcacttgaggctaggaattagagaccagcctgctcaacatagtgtgacttcatctccaaaaacataattaaaaaacaattagccaggtgtggtggtgcacacctgtaggcccagctacttaggaggctgaggcaggaggattgcttgagaccaggagttggaggctgcagtgagctatgattgcgtcactgtactccagtctggatgacagagtgagaccccgtctctctctctctctctctttaaaaaaatgttttttaagagacagggtcttgctatgttggtcaggttggtcttgaactcttggcctcaagcggtcctcctgcctctgcctcccaaagtgctaggattatagacgttagtcgccacgcctggctgagacaagtattactacagcatctacatgcatttgaaagtgtgctagtattccatgcataaaaaatgatgagttcatgtcctttgtagggacatggatgaagctggaaaccatcattctcagcaaactgttgcaaggacaaaaaac

SEQ ID NO: 7792 - DNA, 1026 bp, Homo sapiens
tgagttgtaagagttacataggttattgactttctttagctagatgtcaatatacaacacgaacatcactttgcagtgcacgtctagaataatagtaattttgttcttgtgtgtgctgtcttactgtttttctgggcctgactattagatagaaatagacacattcattgcacttctaccaggaagtttgctgcagttctgtactgcctgaaattccaatttttacattgcttcccaggagccttcctgggtaagactccaattagaggcaatggagcaaacagccctaggccaattatgtgccacaaatacaggagggacttctaattggcatgtgtttttcctgtgggagtgtcagagtggtatttattcagaaactcgaatttgttacatctgatttcctgggagttgatataaactgcagaatccttccctcttcaattggccccattgggttggcttgaattatctgcttgttgtataatagcatgtatatcatactgtagcatctcagaccattttgagcaatgaagaggtataaaatgatgaccctaagtttattgataataccctggcatacaggtatgctacaggtaggaaaacattttcttgacatagagctattttcccagtgttctaagtgactgtattcctaccaaggaccagaatgatcatagatgttttggtacctactcttattgctgcttcaggttactccaaaataggaaacaggctacattttggtgtcctgttaagtgtgttcacttagattactctcagacactgaagccttataagggactggttgtgtctataaagtggattactcaaaggaagactctgcccttggcacgccctgtcccagctcaaaagcacaagttcttatgactctggattttaccagtagtctagacctcagtggaccttgggcagaagccttcctgcctgagaggctggaaggaattcttttgttttgttttaaaggaagttacttgtttaaaacacaaataaaggtgtggtagacat

SEQ ID NO: 7793 - DNA, 1026 bp, Homo sapiens
gggagtggtcttcctgctccaagggccctacatgcctggtgcctgggggtgggtgtgggcagagggcatggagaagctaggttaaagcaactgagttcatcctaacaggccagggtggtgaggacggggtgggtccctctgttcctcaggccatgccatcaaagctgctgctgtccacgtgtggtcaggagtcttaggcggtatttgggggtgggaagggggtgtgccagtgaacagtgtatgtcagtgccccacaggagttactattttctggagttctgggaagggaggagacggggagtgtcccctgggcacattacatttccaaacccggggagcaagggaaccgtcctcagaaaggctgttggggtgttggggtcacagtgtgctgttcctccccagcttcctacttcacttcagcccactgggtttactttttctaatagctgatgttacttagtggacaaaagagaaaagaagagggggctcaggaatgtgcagggacagcagggcagacatggaagctttgtgcggtcaatgggatgcttaggtttggttgtagcatgggatcaggcagatctactctgtcagaaacacattttcttttttttttttttaagatggagtctcgctgtgtcacccagggtggagtgcagtggcactatctctgctcactgccacctccacctccccagttcaagcgattcttctgcctcagcctcccgagtagctgggattacaggcacttgccaccacgcctggctaatttttgtatttttagtagagacaggatttaaccatgttggtcaggctggtctcaaactcctggcctcagatgatccacccatcatgtcctcccaaagtgttgggataataggcctgagccacagcacccggccagaaacacattttctggttctttcagtgcaacccaccactggaatagtggggtctgggagagtccatctcccctgagttatgcacaaggggcagaccccaattgcagatgatcaagagttcctacct

SEQ ID NO: 7794 - DNA, 1028 bp, Homo sapiens
gagcttggcagggagtggcaaagaggggaggggcagcaagaaaggatctgaagagcaaccatcgaggcctctccccacacaaaatccaagggtgtggtcaggtctgcccctttttttttttttttttgaggcagagtcttactctatcacccaggcgggagtgcagtggtacgatcttggctcactgcaacctccgcctcctgggttcaagcgattctcctgtctcagcctcccaagtagctgggattacaggcacccgccaccatgcccagctaatttttgtatttttagtaaagagggggtttcaccacgttggccaggctggtctcgaacttctgacctccagtgatccacctgcctctgcctcccacagtgttcggtttacaggtgtgagccaccacacctggccaggtcggcagattttattctagaattcgggctgatgttattccataaagctcagagggagagccccaaagggaaaatgagaagaataggtgcaatataggacctcatttctcttccaattctgttaagggctcagtgggagggagagaggttagagagagtgacagagacaaagaaacagagtgagagtcagggtgggcaaagggtggcttgttctggggccaaaaatgacacttcttcagaatgaaggcttcctcaggtccccagacccctccctaaacctgctacagctactctgtcccctcttctgtggccacagccccctccccaccacccacagttgtgtcctggggacagagccatccacctagatccccattaggccttagggaaattctaaaaaggggctccccttggctgggcttttcccctctctgggcccatctgtacaatgtgggggctgaaccaggcctataagggacataccagctctgacattcattgaataatgacttaagagatatctcagcccctccccttccatgtgccctgataatctgtggctgtgggggaagggagcagtcatcctccatccctccacccatggcttcccagagccc

SEQ ID NO: 7795 - DNA, 2001 bp, Homo sapiens
gggcccccattctggccatgtccagctctttcctccagctaggctccagcccatctccaccgccagccccaccccacagctggttctgctgctgtcctggggaaatgtgggcctgcttctcaaggcccgagctggtgtgtagcctaactcaggcaaggaggttctgcctgggagttagtgtgcaggctgctagcaggacgctgggtgccgggtgcaggtagatgaagggtcctgagccctgcctgcgtgggtactcatctgcaaactgctgcaggcatctgctgctctggactcgtgccttagaagttcccaaaactctgatggccacgtgttccctgtttttaagtgagatcctgtcctgggtcttcagcatctggtgccatccagctgacctaggacaagagaacaggtcctgttttggggtgatatctgatacattgatgggccgggaacggagtttttcatccgaagactaaactcagcttcctctctcctaccaggctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgtttctgtgacccttcagctggaagagtttgttcctctctgatgagctctgagcccatgacacctttggggcccagcactcccatgacccatcttggccagagaatgaaagcaaagtggataaaggaagatcccacctcatcctccccaagactcagggccagcagtaggtcaggcgcacctgaaggtcggctctgctcttcacctgcccctgtccctgctccctagaggccagagtcagagcacgttgccagttccttgagagttgccttgatttttaaacaaaccattccagaaacttgtagtgagta

SEQ ID NO: 7796 - DNA, 1060 bp, Homo sapiens
cttttgtgccccactatgctcggacacccccagagctggacctgtgtccccactttcctttatagtgtgatcagtttgtggcagagtacgagcccgtgctgatcgagatcctggtggaggtgatggatccttccttcgtgtgcttggtgagcctcactgggtggtgtggtcctctcgggcagctgtaacctggggggctgcagagacccggaagggttgctctgagacttggccgtggggtggagtctctgggttctgctgcgggagagccaagaaggtagggagccagccccccaagccccatcgctttcctcagcaaccctgatgttctgaaagagcgtggtggagctgtgatcctagctccttctggaaactgttttcttagttttgaaagcgatacatcgggcagctctcattctccccctttcttctttccttttctcaccatatagaaaattggagcctgcccctcggcccataagcccttgttgggaactgagaagtgtatatggggcccaagctactggtgccagaacacagagacagcagcccagtgcaatgtgagtagctcagcagacagtgtcaccagcctgtcttgccctggggtagcctgtgtgagaatcctgctttaatgggaacccagtgatcaactctccaccctgcttttatgttatcagaaagctgaggcccagagaggtggttaggcttactcatggtcccctagaaaagacagggtgaactacactcttgtagtgaagggtggggtggattttatttatttattttttttagtatttttttgcttctgctttgttgcttttgtcttcatttcccttgtgacagtgtcagacttgtacaaggtcactccagggattgtacaaggtctgtgggattcattgcccagagctttgcccaggtcctgtcccccgggaacatgtttgcccttgctgaagccgggcccgagtcctcactcaaggccctgagaactggcccctgcccagcagccctagggcactgtggccctggcctggcctggcagccaccagttgggtgacttgtg

SEQ ID NO: 7797 - DNA, 1025 bp, Homo sapiens
agacctgaagtgtgttcaacattctgtcttctagatagtggaccgatagtgagcccctcactttgcttttggtccttcatcctcctccccaaaatgaaccctgaatgatgaaatgattgtaaccgaacacatcatcaggacagctcttcggggtggggaagggactttctgtctcctgaactgtgaattcctgggttttgttttggtggggttagggggaggtgggggtggtagaggattggggaagggggtgaatgtaaaaatagggaattaacttggatattagaagccacacgccatttggaattcaggaggcagtggcccttgatgtgctaacccaccctggtctctgtgtcccctttcctttaggggagcaagaccaagggctgtgagtcccagcattgaaagtactctccttctactctttccacagaagcacgaggtcccagcaaagtctgatgtttactgtgaggtgtgtgaattcctggtgaaggaggtgaccaagctgattgacaacaacaagactgaggtatgctgtcctcctggcagagggagggcctctcctgcccccccgagcctgaatgtcccagtgggaaagtcccacaggagagagggcttggcccagccttgacatgtgtacagccatgtccccatctcgtggaaggcaatcctcaccagtgggacctctaggctggcgggggtccggggaggtggacaccattgccctgctttgtagtttggtagttttttgtgggtggaaacggcacccaccattgactcatttcctggccatgttagtattttcagaatgtcccccaacccttgtccggcctcccgtcttctcacacgatcctctcgtgtgtttcagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctct

SEQ ID NO: 7798 - DNA, 1014 bp, Homo sapiens
cgttctgtcacccaagctggagtgcagtggtgtgatcatggttcactgcagcctcaacctctgaggcttaagtgatcctcccaccttagcctcctaagtagctgggagtacaaatgcacaccaccacacctggctaatttttgtattttttgttttgccatgttgctcagactggtctcaaactcctgggttcaagcgatctgcctgcctcggcttcccaaagtgctgggattacaggtgtgagccactgtgcctggccaacctttttatttatactaaaccccctttttataccatactgttactataatgaacacttaatcgattttaagcctatcagtaatttgagagcctgtaaagcatcttaggaactggtcagcaagtgccccctaatgctgcagccctgagtatataaggacgttttcctaggaatttgagtcctcttaagttgcaaacctaactgcctcttctgtaggataatggggacgtttgccaggactgcattcagatggtgactgacatccagactgctgtacggaccaactccacctttgtccaggccttggtggaacatgtcaaggaggagtgtgaccgcctgggccctggcatggccgacatagtgagccttgtgtccttgtgcattggggatgttctgggcctgggagttgggctgtggaggctggagtagggcgttcagacaacatccttctcttttttcccagaaagcagcttgaataggtagtgcagacttgaatctattttggttaatggcatctggatatgtaacaaaactgggaacaaaaagtaggagactgtttctgggaagattttgtttcctgccaggcaccctgtgtattaggaacactgtagaaatactttttgcccccattttttttttttttttttgagactgagtgttgctctgttgcccaggctggagtgcagtggcgtgatctcagctcactgcaacctctacctcatgggttccagggattctcctgccttagcctcccg

SEQ ID NO: 7799 - DNA, 1065 bp, Homo sapiens
aaggatcaaggagaaaagattttagggtatatgagccgtatactgtccctgtcacacagtctctttttaaaaatgtaaaaagaatgtaaacaccattccttgagttctgggttgtacagaaataagctgaagggcctactttgctgaccccgggactaaatgcccaaagttaattgagatgttgtattgcatgccactaatacctaggtccattttggccatctctgcttagaattccctgtgcctgcgagactgcaggtccagggattttcattttgaatgctcatgtctgcttttgcctgattgacctaatagagccataggtaacatggccaagtccttttccctgagggctggctgttttccaggcttggtttttctgggagctattgagggcctcttgccttcagcccatttatttccagggaggaaagcctatcgtgattctgaccctggtgtcctctcgtaggaggagatccttgtttacttggagaagacctgtgactggcttccgaaaccgaacatgtctgcttcatgcaaggagatagtggactcctacctccctgtcatcctggacatcattaaaggagaaatggtaagtgatggggaataggcttttccttgaaggtgcttctggggcccaggagaggcagtggcccagagtagattgattaaaatggaaagtctgttcttagctctggaattcctcaacagcattttgctacaatttgacatccagaatagctcctttggcacagcaggccactctgtatgtaacttgccctggggttagcgagggtgcggctgctggggactggtcggactgctgaaggaatgtaaaccggcataaccttcagagatgtgagttggatacatcatgtccaatctttaactgacccctttgagcaggcacaaaacctcacttctgtgaatttatttctgtgaacttataatcaaggaataattcagggaatgtattggggtctttcattcatcaagtatgtattgtacacagacacaaaccctgtgtcacagactgggtttttagcaaagaacacggagcta

SEQ ID NO: 7800 - DNA, 1044 bp, Homo sapiens
gatcatccgtgtccatttccctttctccctctccaatctctcacagattgaaaaacgtctcaggtccttctcctccgatcctgatacttatatcaaagaatttaaatatcttacccaatcttatgaactcacttggcatgatctctacattatcctctcttctatactctccttccagaagagaaggaaagagtgtggcttgtagcacaggcacacactgacgatcttcatgggcaagatcctgctaagcccataggagccactgctgttccccaggaagagccttcctgggagtaccaacccacagaccccagctgggcgtctgtaactatatgattacttgcctcattgcaggccttaacaaagctgccgggtaatggccaggcgctatggctcacacctgtaatcccaaaactttgggaggtcgaggtgggcggatcacgaggtcaggaaatcgagaccatcctggctaacaccgtgaaaccacgtctctggactcttcagaggactcttcccagagtcctctcttcctgctgtagctcatgatagattttcagatgtttggtgggcactcatacaggcacctgattgttacctgagagacacaagcaaatcctattccccatataattatccaccctttgattaaatttaaagggctatgtcactctcatatgagtgacatagaaaggggaatgcctttgttgtactgcttgctgtaaagaatgaaataaaagattaagttggtcattagtcacattttgaattaaggcacattcaatattttgtgtggcttgcactacataggctgaatcagaaacagtgtttattggctgtttaaaagtttttaacactgttatcacagccataagttcagcattttgagcagaagcaaagtcagtttgaaaaacttgttgttgaggtcccacaaatgaggcctttccattactagatccatcagtaaaaacagtaatggccccttcaataggggctttttgagtaatggaaggcaatatccatgatattaatttaagaaattggaat

SEQ ID NO: 7801 - DNA, 1031 bp, Homo sapiens
ggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgccttttactttgcttggtctatcattttcctaccaaagtttgtcctcttaatatttgttggattcctgttccttcaccccatccccaccctcatcttcccatgcccctgatggagttgcagtgttgcagcccttttttgtttacttttcaaggcagcagcaaaagaaactgatgatatcagcaggactgtgcagagttccctggaagaatgtcagccacaggaggccctcactcctccctcaccacggaccagcagagggaggcgggaatgctggggagccccagcctcccacccctgcctcctcacattcttcctccctccatgtcctctccttcttctccttccttattcttgccttgattctttctctctttatattctttaactgcacttctgaactctgtgttaagttgctacattgtgaggactgtgtctaacagtgagatttattattgggactgcacaaatcacttgtgaataaaatgtttaacggtgtttctgttagtatgatcacatagttcacatagtttgaatttgaccccttcctgtgttgggatacaatgttgccctcacttatttaccagcatagctggatcattcatggaggacttacatattagtacctgcaaggttgattttttttttttttttttttttgagacggagtctcgctctgtcgcccaggctgga

SEQ ID NO: 7802 - DNA, 1016 bp, Homo sapiens
atttgaatgggaaaaaaatatcctgttaaacaattgaagacattttgatggttgcttgctaatcaactgaccaactgctaaccaactataccaatctttcagcaggcattttcaagtgagaacagccttgactggaattcggtaataatttggacagtatttgagggtttaaaaaagagcagcaggccgggcgcagtggctcacacctgtaatcccatcactttgggaggccaaggcaggtgaatcagttgaacccaagagtttgagatcagcctgggcaaccaaaacttgtgtctacaaaacatacaaaaattagccagcctggacaacaaggcaagatcctgtctcaggaaacaacaacaacaacaacaaaaacaagcagcagagctttccacttttgcttgggttattattcaaatcatatactcttcccgaattgttgaaaagaagtgtcatatggatcagatattatctaaggacacgttcattaagatgtctgccttcagtcctggttcaggacttaagaaggtgagactcttcatcttctgaaaaaaaaaattgatattattaatgtttatttctttttttgagaaggtaaatttatttttctttatagcttatgtcaaatacgtcaagtgcttttgggatctctgatatgaaagattctgttgaaatatcaggttatagtttaccctaccttatgagttttctattgctgtgtaaaaaattaccacaatcgtagcagcctaaaaccacacccatgtatcatctcacagttctctggtagtttcatagtactgcaggtcggaagacccagtgggctggactgggttgtctgcttagggtctcacaaggccaaaatcaagatgttgaccagactggtatctcatctggaggctcttgggaagaatcaacttccatgtgcattcaggttgttggcagaattcagatccttgtgtctatatgtctgaaagtgccgtttccttgacacgtgactgctctggcttcaccaaatc

SEQ ID NO: 7803 - DNA, 1032 bp, Homo sapiens
gctggaaccggcacacaccaccaagcctggctaattttttgaattatttgtagagatggggttttactatgtttcccaggctggtcttgaactcctggacaaaagtgatcctcccaccttggtctcccaaagtgttgggatgagccactgtgcccaactaccatatcccatattaccttttaaatatctcttttttttttttttaaagacagggctttgctttgttacccaggctgcagtgcagtggtgcgatctcggctcactgtagccttgacttcctgggctcaagtgatcctcccacttaaaccccccaaatagctgggactacaggtgtgtgccaccatgcctggctaattttttgtatttttggtagagacagggtttctccatattgcccaggccggtcttgaactctggaactcaagcagtccacccgccttggcctcccagtgggctggcattacaagtgtgttaaatatcttttgaatctaccagctgtctgtatcttcactgctacctctctgccttttctgtggattacttaaaatagcctgcttattggtctctacacacacacacacacaaacacacacacacacacattttttttgagatggagtcttactctgtcacccaggctggtgtgcagtggcatgatcttggctcactgcaacctcctcccctttggttcaaacgattttcttgcatcagcttcctgagtagctggaactacaggcctgcactactacacctggctaatttttgtatttttagtagaggtggggttttaccatgttggccaggctggtctcgacctcctgacctcaggtgatccacctgcctcggcctcccaaagtgttgggattacaggcgtgagccaccgcacccggccacaaatgttttcatttcatccaccttgatagcattctgaaacacctattaaagataaaattctcctggaatatgaccaaatcaggctctagtgacattttttcctaagaaacatgattttagaaagttgtggctcagttt

SEQ ID NO: 7804 - DNA, 1057 bp, Homo sapiens
taccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggccgtggtgggtctgcattgagcagggaggcctaaggggtgggggggagggggcacaagcccctgctgctgctgacactgtccagcctgtgccacaaggagctctagatgatgagcctgaatttcccccgacccctggccctggctaacagccacttaagccacacatgctgttccagaactaactccatccaggcagaggggtgctcaggtgactggggggctgcaggacctgagcagtctgggtccctggggtccccagcgccagtcctggctgggcatctgggccacgaccatcaccctctgcttttccctctcccaatccctcccccccacaccctcaggcctgccatgtgcccgcagagcattcgaaattcccggccccagcctggagctcgatcccactcaggagccagatcctgggaaaagtgttgcgagtttgtttccatcgtccttccc

SEQ ID NO: 7805 - DNA, 1050 bp, Homo sapiens
tttatttagaccatgcttatttttaaaggttggtccagatattgatttgactttaattatctatcatgataggtgaattcatatttcattgtgagtttacacttaaaagcaataaggggcattggaggcatctcccttgaaggaagagtatttgagcattggcaggagttaatttaggatctgaagaccttgcaaaagagctctaaaatgaaaggacaaattttgtcagatgatgaaaatctgcggtgttaaattacttttggcccagaatttctagcctgtgttagcaacgagattaagattgattgtcctctcatgttgattaaatagtttgtgaacatagcaattaactaaagtgagtgtcaaggaagggcctttgctcctaaggttacgagtccatctctctaggaccatttcctataaaaggggaatcaccatctgctttctaattgcttcttttattccactttggatttgttaacatgaaaatgtaagttttcatttggctgacattaatcagtttctgtgtgaggttctgtatcaaggtatcaaacaagacctaagagattgaaggtcctagtggtggtattaaatttttgcatataaattaatgaccatgcaatgtttcacagccatttttctcttcctttctaacagccttgttagatactgtatttttgagaatatagagacagaaagagaagttaataacccattcagagtctggtctaaaatccaaggcttcctattccagatcttgtcttttccttaagaaagtgctgtttctcctaatcatactcttcctgtaaagcagtgcttctctactataggatcacttgaggaatttttaaggaatgtggttgtttgggccctcttcaaatcaattaaatcagaggctcagtaggtgggtccaggcatcagtgttctggggttttcttaaccctctgcatgagaaattccagaagtgtttcttaaagggtgatatggtttggctgtgtccccacccagatctcatgttgaattgtagttcccataatccccatatgtcct

SEQ ID NO: 7806 - DNA, 1101 bp, Homo sapiens
tgctatagagttgaaagcccactaacatactgcgtagaaggccgggcatggtggctcatgcctgtaatcccagcactttgggagtccaaggcgggcagatcacgaagtcaggagattgagaccatcctgtccaacatggtgaaaccccatctctactaacaatacaaaaaactagctgggcatggtggcgcgtgcctgtagtcccagctacttgggaggctgaggcaggggaatcgcttgaaccggggaggtggaggttgcagtaagccaagattgcgccactgcactccagcctggtgacagagtgagattctgtctcaaaaaaaaacatattgtgtagcatgcccatgagggaaaatattataaagcagattaggggtttcatgcatgtgttcctacacatagcctacacccaaatgcagaagaaaagagatgtaaaagacagttgtatctaagatacttactctagaaggctctcttttgtttgacattcatgtggaactatctgtaggctttggaccaagatgtgctaagactgttccttttgccagtcagcagttcctcatgtgaggagaccaatagactcttgtgaaagaatgcagcctaacatgtagtaagtgttctgtaagtggctagtaatactgaatccattcttcccatatcatggcataagtctagtgctatggtttcattatacaccacctcaccccccccgatcaaagttcatgtattggaaatttaattgctgttgtatcactgttaagaggcaggggctttaaggggtgattaggtcatgaggggtctgctatcataaatgcattaatgtcattttcatggaagtggctattgctgtggtagtgggctcctgattaaagagtaagtttggcccccatttaccctctgtcttacatgtttgcttgcccatccaccatgaaaggacccctgccagatattggtgccatgctcttggacttcccagcctccaaaaccatgagccaaataaacttctgttctttatcaattatccaatctgtggtattcttttataccagcagaaaatggacgaagacgtccagtagaataagtaccttcttattgatg

SEQ ID NO: 7807 - DNA, 1025 bp, Homo sapiens
gaggattaaatgggataatataagcaaattgtttagaatagtgcctgtcatagagcaattactttagtgtttattagaaatgttggtaggatcatcatcatcatcatcataactaccactagctaagagtgacatttctacttattgtccacaggatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagaggtgagtgttatccaaccatcttgttcttgcgtatacttttattcttccagtcatctctgttgtcagaaaggagttgatttctggcttaactctgtatcagaatttcttgctcggatcatttggtattgttaatattcgtctatgaaataagatgtttcaaagaattcaacatgctaaggcaatacttaggaaacactgtgcttcaaggtctgcctgtctcctctgctgaacattttaaataatgggatagggatagcaatagcagctttagaaaatgaaggctttctggccaggcgcggtggcttacacctgtaatcccagcactttgggagcccaaggtggttggatcacttgaagtcaggagtttgagaccagcttggccaacatggcaaaaacccatctctacaaaaatacaaaaaatagccagacacagggcgtgagcctgtagtccctgctacttgggaggctgaggcaggagaattgtttgaacctgggaggcaggtggaggttgcagtgagccaagattgtgccattgtactccagcctgggtgacagagaaaaactgtctccaaaaaaaaaaaaaaaaaaaaaaagaaaatgaatgctttctgagacttcacaatttggtgaccctgtgaaattaacaaaggaaccttggtactttagtgtccctgataatttttttcactagttatggaaacttccttgg

SEQ ID NO: 7808 - DNA, 1140 bp, Homo sapiens
aatacaaaaggaattagccaggcatggtgtcaggtgcctgtaatttcaggtacttgggaggctgaggcaggagaatcgcttgaacccgggaggcagaggttgcagtgagccgagattgcgccattgctctccagcctgggcaacaagagtgaaactccatctcaaaaaaaaaaaaaaaagaaagaaaagtgtgtggaattttgggaaatgctctttctgcatgaattgagatgaccatgtagatttttcttcattctgttaatgttgtatattgcattaattagttttcatctgttgaaccatccttggattctaggaataaatcccactttgtcatggtgtctaagtgtttttttatgctgctgcatttggtttgccggtattttgtttaggatttttacaccagtattcataagggatattggtctatagttttcttgtagtgtctttgtctggctttgatattagtgtaatattggcctcaaagaatgagttaggaagtgtttcctcttcttcaatcttgtggaaatgttcttagtaggattggtgttagtttttctttaaatgtttagtagaattcaccagtgaaaccatctggaccaggaattttctttgttgggagaattcttttttttttccttgaaacagggtctcaggctgggcatggtggctccacacctgtaatcccagcactttgggaggctgtggcaggcagatcacgaggtcaggagtttgagaccagcctgaccaacatgtgaaaccccgtttgcactaaaaatacaaaaattagccaggcatgatggcaggtgcctgtaatcccagctactcaggaggctgaggcaggagaatcgcttgaacctgggaggtggaggttgcagtgagccaggatcgggccactgcattccggcctggatgacagagcgaggctctgtctcaaaaaaaaaaaaacaaaaaaaccagggcctcactttgtcgcccaggctggagtccagtgttgaatgttggctcactgcaacctctgcctcttgggttcaagcaatcctcctgcctcagcctctcgagtagctgagattccaggcgcacacaccacgcctggctaatgtttgtatttttggtagagatggggtttagccatgttgc

SEQ ID NO: 7809 - DNA, 1032 bp, Homo sapiens
aacttaagcagtaagcagaatttttttcttataaaatattagcattatgtagctcagactaaagaccccatgacttccaccatagtcagttcctataccttacctggaaagaacgttgttttgtttggtatggttttttaaagaattttttgaagttctcaatgtaggtggctttcaatatagcctccttacattaatccaactgttttcatataagcattataataaatttgattagttttttccttcccaacctctaacagtagaatgtgacatttaaaaaaaattacaatatccattaataaagatgatactaagcaagaaaatgaactaaatgccttcagtaaaggtttattgtcctatatattaaatattatggctttaaaaataacagctattagtctccatgtaatgaaacattatcaataaaactaatattcctcttattcttagtgcctggctctctggctatgaaaatcctgtggtgtctcgaattaatatgagaatacaagatctaacaggactagatgtttccacagcagaggaattacaggtaggtaatcacattatccttaagtcatttttacacttcaggagatgcttgagaggagatttcctgacactgaacaggcagtcctcaatttgcatgatagtttgggaccttaaaaagtgaccctgtaagctgcaaccatgcaaagtgattttaataatgggaaaaattgtgattgttctgtgacttttaaatttcttgtcaaaacatgaaaactcttatctagggaaatgaaaaatatagatcactaatacttactaagtacactgtaattttttttctatcccccaggcctcactttgcctgtcaagtggccagggtgggttttaaaaaatagtgggtttttttcctttttatttatttatttttaagcaaacagttttcctttatttgtaatagtgaaacataggacttttttcatcacttctctttttctgttacttttatgtctataaatcatttgtcatcaaaagtagctgtcc

SEQ ID NO: 7810 - DNA, 1058 bp, Homo sapiens
tttacacattttttgtcataaagtttgtaaatagctaaatcctctagatttgcatgcttctaggaagcatataaaacaaaattacggccaggagtggtggctcacgcctgtaatcccagcactttgggaggccaaggtgggtggatcacaaggtcaggagatcaagaccatcctcacaaacatggtaaaaccccatctctactaaaaatacaaaaattagctgggtgtggtggcgcgcctgtaatcccagctactcgggaggctgaggcaggagaatggcttgaacccgggaggtagagattgcagtgagccgagatcatgccactgcactccagcctggcgacagagagagatccatctcaaaaaaaaaaaaaaaaaaattcatgaattcgatgttttggaagactgtttgtttttggaaattttctatgtatgcaatgacccttttgaagaaatatccagcccacagtcaatggactgttgccaataaatcaaaataaatcactgtaggaaagtgatctatacacttaaaaaaaaaaactaaatattgctaaacatttcaaacctattttttaaatattctaactttgtagctcttaagcagttttattggatttttgagaaaggtacaaccatacttacatattataaatgatagcagaaggtatttagctactagcattagaaggccgggcatggtggctcatgcctgtaatatcagcactttgggaggctgaggtgagaggatggtttgagcccaggagcttgagaccagcctggatagtatagctagaccttgtctctatttacaaaaaattaagaaaaaaattagctgagagtgatggtgcacgtctgtagtcccagctacccaggaggcttaggtgggtagatcacttgagcctgggaagcagagattgcagtgagctgagattgcaccactgcactccaggctgggtgacagagcaaaaactctgtctcaaaaaaaaaaaaaaaaaaaaaaaaggccatctcagttgccaaatggaagaaaattcgtgttctgatgtcagttaatttaa

SEQ ID NO: 7811 - DNA, 1050 bp, Homo sapiens
gcacaatggtggctcactgcagctttgaactcctgggctcaagcaatcctcccacctcagcctcctcagtagctagcactacaagcatagaccaccacgccaggccaatttaaaaatttttctttcttagaaacaaggtcttgctatgttgcccaggctgatctcaaattcttggcctcatgtgatccttccacctcagcctcccacagcgctagggattacacgcgtgagccatggttcctggcccctgaaccattttttaaaggaaatcgatatatttattctcaagtaatgaactaagttgttttataatgtgaaccttggcactttgttgttttaatctgtagtagtcattctataatgctatgagagagtatatatattttaatttttcttagaattttgtttgtagcataagagatattatagccttctataaaacttataaaacttgcttgtaaaattccatatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttcacgcctgtaatcctagtagtttgggaggctgaggctggcagatcacttgaggtcaggagttcgagaggagcttagtcaacatggtgaaaacccgtctctactaaaaatataaaagttagccgggcctggtggtgggcacctttaatcccagctagtcgggaggctgaggcaggagaattgcttgaaccgggagttggaggttgccatgagccaagattgcactgctgcattccagcctgggtgacagagcgagactccatctcaaaaaaaaaaaaaaaaaaaaaaaaaaaaaaaaaggcctggtctcttgctgttcaaaatacgtagctggctggacacagttg

SEQ ID NO: 7812 - DNA, 1030 bp, Homo sapiens
acagttgggcaaaatcatctaacaaagcctattttataataaagtgttgaatagctcatgtaatttattgaatattgtaccgaaagtgaaccacagaatggttgtggggtcaaagtatgttttgtttttgttttgagacggagtctcgctctgttgcccaggctagagtgtggtggtgccatcttggctcactgtaaactccacctcccaggttcaggcgattcttctgcctcagcctcctgagttactggaattggaggcacacgctaccacgcccatagtagagacagggtttcaccctgtttgtcaggctggtctcgaactcctgacctcgtgatccgccagcctccgcctcccaaagtgctgggattacaggcgtgagccactgtgcctggcccaaagtatgttttttattgaatggcatatcacttttgcaccatcataaagttgaaaaatcctaagtcaaactgtcctatgttggggatcatttgtatttactatatggtagaacttttaagatctgttcccaggtttgattgacctgttgagtctgtgggactggacttccctggaataagaactgtaggaaagttttgtgtttggatgaatgtaaacttcacatttatttttatccaggcctacctgaaaatgttttctggtaggatttcttccatactgctttttttcttatagtttaaaaaatgtaatatgctaccaaacattataagtaatatacatgtatgttacaaaaattatataataaacacttttgaacctatctaaccaataacctaaatattatcaataacttattcatactgttgcaacaccaagttttattccagtgtaagtttatctttggatctttgactcttcttgggttttcttttctttcttcctcctattcctcctccctccctcctctttgtctttttaaaaattaagacaagtcttttcagggatgctatctgagattagtctttcttttaaaggagattgcatccattttgacccattaatttctttttca

SEQ ID NO: 7813 - DNA, 1314 bp, Homo sapiens
ttggatttgaaaactcattcactttttcaatttttttaatgaggcataacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccactagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttacagacagctccatatactgaccatgtttttataatctaggtctctggattcttctttattattgtatgcagcagagagatgcctttactatatcttaccctatccaagtaaaaacaatggaaatagtttcatactgttccctctccagtgaccaagggaggaattaggagaatggtgtagtagagttctcatctgagaacttactatcacgaactaataaaaactgaatatggccgggcatggtggtgggcgcctataatcccagctacttgggaggctgaggcaggagaatagcttgaacccgggagccggaggttgcagtgagccaagattgcgccattgcgctccagcctgagcgacaagagcgaaactccgtctcaaaaataaataaataaaaactaaatataccatatcccactccaatcctttgtcttcctagtgttcactgaaatgaactaaggaagaggataagtgttacacattgactaaagtaacacatcagatgatattgtgcaacattttaacattttaaataataattattttaaatatatttttattgtttgttttgaagctacatttctcatgttaaaaatggggccagaatgccgtcccagctcaactgtgagaaaaaggtttccccccatcgcacttgtggtacattaggtttatcttcattgaggattaaatattgggtagagaaagggtgataggcaaaaatataaatgaaatttttttttattctggttgc

SEQ ID NO: 7814 - DNA, 1033 bp, Homo sapiens
tgggattacatctctacaatatttttaaggtacatgataaacctatacacttttttgtcaattaaaaataaacaaataggccgggcacagtggctcacacctgtaatcccagcactttgggagaccgagatgggtgaatcacctgaggtcaggagtttgagaccaacctggccaacatggtgaaaccccatctctactacaaatacaaaaaattagccggatgaggtggtgggcacctgtaatcccagctactcaaattaaaaataaataaatagccaggcacagtggctaatgcctgtaatcccagctacttgctgagataggaagattgcttgatcccaagagtcaaggctgcagtgagctgtgatcatgccacgcactctagcctaggcgacagagtgagaccctgtcttagaaaaagaaaaaaaagaaactatgcacagagatacttatgtgttgagtgagtgacataatggtgacatgatttgttacataaattgatggcaccctgtctgaactattaagaatggatcaaatcaagttgtataaaggacttgctttaattggataaacatttgcataccttgcaaaatcacgtaggtgatggggaactgtctctactctgtattattaatatgtaaacgttactaggagagagaataaaccaaataatcataacaaaaggcaaaataaaaatcattctggaatatcaaatgctaaagagagtcatagtgagaaggtaataaactttcactaaggttgaagcagagatgttaaaaaaagaaagataatggaaggcttcagggaggaggtatttgagttaagtcttaaagaatgaggattttttttctttttatggagtctcttttttttttgagacggagtcttgctctgtgcccaggttggaggtgcagtggcgcgatcctggcttactgcaagctccacctcctgggttcacgccattcatctgcctcagcctcctgagtacctgggacaacaggtacccaccaccacgcccagctaattttttttt

SEQ ID NO: 7815 - DNA, 1028 bp, Homo sapiens
ggcgcctgtagtcccagctactcgggaggctgaggcaggagaatggcatgaacctggggggcggagcttgcagtgagcggagattgtgccactgcactccagcctgggcgacagagcgagactccatctcaacaacaacaacaacaacaacaacaacaacaacaacaaaaaaggataacagttatcttacctaatactgtgttgccctggtagttatagttatatttaaatagagatgtgttttcttgtgtgacagaactttattcttctcccacatgcatggaggataaaatgactttgctaggtttcttatttatacaaagagtttatatttggaaccagtccttccaggtgtaggcattaggaagtagagttccgcatctctaatgaaagtgattactgcaaggccctccaggatgattggaaggaacaagtggccaagagctacccttcctgcctaacatcttttcaggcacttgttggccatttgcatatctgtgtagaatcgtctattcaagtcctttgtccatttttcaattgaattattattattattttttgagatggagtttcactcttgccgcccaggctggagtgcaatggtgcgaactcgactcactgcaacctccgcctcctgggttcaagcaattctcctgcctcagcctcctgagtagctggaattacaggtgcacactgccacgccaagctaatttttgtatttttagtggagatggggtttcaccatgttagccaggctggtcttgaatacttgacctcaggtgatccaccagcctcggcctctcaaagtgttgggattacaggcatgagccaccacgcccagcctgaattactattttttgttgttgttaggttatagattattcttatatattctggatataaactcctcatcagatatgatttgcaaatattttctcccattccacatattgccttttcattcttttgcttcttttgatgttcagaagtgtttacctttgatatagtaccatttgtctgttcttgct

SEQ ID NO: 7816 - DNA, 1029 bp, Homo sapiens
actgcctgtttttcaaaataacggtgtggctgggtgtggtggctcacacctgtgatcccagcactttgggaggccgaggtgggcagatcacctgaggtcaggagttcgagaccagcctggccaacatagtgaaaccccatctctactaaaaatacaaaaaatagctgggtgtggtggcaggcacttgtaatcccagctactcgggaggctgaggcaggagaatcacttaaacccaggaggcggagcttgcagtgagccgagatcacaccactgcactccagcctgggccacggagcgagactgtctcaaaaaaaaaaaaaaaaaaaagttgtaataatcatttgtttattctcatagtggtatagtattccattgtatgaatatatcacattctactgttgatggacatgtgggtagtttctgatgtatgttttctagttatttatgaacattcttgcacctatcttttggtgaacatatgtactgagtatgtactagtgtacacagccaagctcattcatttacatcttatttatggctgctttcatgctacaagggcagagttgagtagttgcaacagagactggatggttgtcaaagactgaaatctttaccaccagcctctgcatagacagttgtttcctgacccctgttttaaggtatttcagtcaacctactaaatgccaattagagatcctccagctccatttcatgatgtcttgtttttagactttagtctcaaaattacagttacaatacaataaaataatcttaatttatgaatgcacagaaaaataaaaatattaattcacagcccaacactggtaaattgtgaaaggtgaaataagattttatctggtacgtggtggttgatacactgaaactggaaggagttcctttgtttattaccagggtttattattatgggagtctgggtatgactctggacttttaattaccacctgtcctgtgtctcaaaaaaattaacctcatataatataaactagttcattttaaagagagtgctag

SEQ ID NO: 7817 - DNA, 1048 bp, Homo sapiens
aggcattaaagaataggcatcagggactagttagaatttgaacaaaatgtatttataacactttttattgttggaaactcaacttttattctgggttaagcctctagataaaatcttaagtctgccaaactattattccccccaccttttctttccccaactatcaagaccattctaggaagtacgtcactctaccaaaaatgattgagttgtgttgggcctggggaaaaagtcgggcaaaaggagcctttcttgtggctgctgatagttaggttcatccaccaccgcactttgagctcgactagagtcgccatggggtttctgcagaggagacaaaagttacagaaacagtgaaaactatctgtaatgtggtatgtagttaaaaccctatcgaccatggcagatatggtaagtgcaggccaaacagctccaattccacgtcataaattagcactgtgtttgtacttttgacaaaacacagtataaatcaagatcagggcacagatcctgcagaattactgcccattaggttgtatggtaagtacatggagaggcaatatgaaagaaacataccatctgtctttgtggccccacagtgctcacatgttccacttcagctgtgccaataggtggtagcagattatttcgactcaggggcgtcggtgagggagaggagagcgagtcgggtgccactgggctgcagatcccaccaacaaacacgaaggtatgaaagcatgaagttataacaataccagcaaattgattagaaatcagataaatgaagcagatgagtttaatgtgcacagaaagctttaggctacctatgttttcaagtagagatctcaggatttttggaaaattagtttttaaaatagtgttttctgattttgttttgaagctctatactctgggtacacaacagaagctggccttttctctcccacagaactggaataaaacatttgtccctatctggtattgcacttctctgctgatttggatttgtaaattcccagctgatgatggaattcttgacagttctggacct

SEQ ID NO: 7818 - DNA, 1182 bp, Homo sapiens
tcatggagaaaaactcgttgccctcaacctagacaggatccgtcattggattggctgcggggcccacctctctaagcctatggaaaagcttctgggtaactcagctctggtcttaccttattgaggggattttaaactgaagtcagctccaggacagtaggtgtaagaatgattttcggctgggcacggtggctcacgcctgtaatctcagcgctttgggaggccgaggcgggcggatcacctgaggtcaagagtttgagaccagagtggccaacatggtgaaacgctgtctctactaaaaataaaaaaaaaaaattagttgggcgtggtgacacgcacctgtagtctcagctactggggaggctgaggcaggagaatcgcttgaacccaggaggcggaggttgcagtgagccaagatcgcgtcactgcactccagtctgggcaacagagggcgattccatctcaaagaaaaaaaaaaaagagttatttcattccctctaggctgttcaggactgaagtgggagctgaagttgtgatctaattggcattttgaatctggaggccccttttgtggactcctttgtaagactttgggtgactggtattttatgctaaaaataggaatagtatgttttgaatggccatctgtcagtttacgttttttaaagtaaggggaatattgttagggaagtagacatccactgtctccttgccggggagaagtagtacagagtttggcaagtgaggagcatggtttgcatccatgcactgggtcagatctcagacctcagttctgtgagacagagttcctagggaagcattggcttatactgtgttataataagtgaaaaatctgttacttttaggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgactt

SEQ ID NO: 7819 - DNA, 1047 bp, Homo sapiens
gcgtatcagtctaagatcacattgggaataacgacagtagccctcagttttccactggacagtatgacaccaaattggcagggagtattattataagagaaatgaaccaaacaaaaattactagattttctctttagtgtaaatatcccaaatatcaacattttaaaaatacctgaggtctggctgggtgtagtggctcacgtttgtaaccccagcaatttgggaggctgaggcaggtggatcacttgagcccaggagttcaagaccagcctggggaacatggcaaaaccctgcctctacaaaaaattagccaggaatggtggggagcgcctgtggtcccagctactttcgagggttggggtgggaggatcacttgaacctgggaggcagaagttgcagggtgctgagattgtgccactgcactccaacctgggtgacagagtgagacctcgtctcaaaaaaaaagaaaaaaaagaagaaaaacaaataaaaagagttcttaccccagctctcccctaactagctctaggatctgaggcaagtcacctaactttattgggcctcaatttcctcatctttaaactaaaagggccagtatggaagaccataatatacttctcttagaaattgataagtcaaataggaaaaaaaataggatatatatacagatgtataacccattcaacaggtttgagttcaaacaccaatgtagaactcttcacttaacaatgagaggacacatattcttttcaagtacaaatgagttatgtataaaggttgaccacatgcaaaaccagaaagaggggttcaacaaatacatacagatcacatggcagtaaaattataaatcaacaaccaaaataaagcccaaaagactcatatacctttggaaactgaaaacatgcttgtaattaattaataagtcaatgaagaaaccttgtgacacttcaaatatgaaatcttttgtgctaggtagaattctaaagatggccccctcccctaagattaatctattaaacactaatgtaggtactgctgtaaaatgat

SEQ ID NO: 7820 - DNA, 1090 bp, Homo sapiens
caaggaaataaattctcccttagagcctccagaaggagctagccctgtcaaatcttgaccttaatccagtgaaactgatttcagacttttggccttgagaactatgagataatatgtttgtgttgttttaagccactaagcttgtagtaatttgttacagcagcaataggaaactaacataattacattcaatgcaaatggtctaaacatacaaattaaaagacatagactgactttaaataataatttttaaaacctcaactatatgttgtgtacaggaacctcatttcaaatataatgatataggctgagtgtagtggctcatgcttgtaatcccagtgctttgggaggctgaggtgggaggatcgcttgaggccaggagtttgagaccactctggacaacatagtgagaacctgtcccccaaaatccacaaacaaatatagtgatatagataaattaagcataaaaggataaacaataagagcttatgaaccaataatagtaagctggagtagctgtgttaataatggacaaagaagactccagagcaaagaaaatcaattgagacaaagagaaacattaaagaacaataacagggttaattcaccaagaagacataccagttctaagtgtgtttgcactaaacaacacagctttttaagataatgaagcaaaaactaacagggccgaagggagatgcagacaaattcatacttagagttgggtgtgtctcacccctatctccgtatttgatagaaccactagacagagaattaacagaatatagaaaaattgaacagcaccattaaccagtgggatccaattgatattatagatcacccaacaacagcaaggtacacattctttcaagtgcacatggaacatcaccaagacaaactatatcctaggcaataaaactgaccttaacacacttaaatgaattgaaatcatacaatgtatgatctcagaccatgacagaaccaaactagttatcagtaatagaaagataacaggaaaatctggccaggtgtggtggctcttggctcacgcctgtaatcccagcactttgggaagccaaggctgacagct

SEQ ID NO: 7821 - DNA, 1026 bp, Homo sapiens
actcaccataatgtagaatcagtgggagccctgagcttgttttcctgcagctagacagtcctatctgggggtgatgggagacagtgacaaatcaggcattcgattcttataaggagtgcacaacctagatcctttgcatgcatcagttacaatagggttcgcactcctgtgagaatataatgctgccactgatctgacaggagagagagcttaggtggtaatgcaggtgatgcagagtggctgtaaatagagatgaagctttgcttgctcgcctgctgcttacctcctgctgtacagcccagttcctgacaggccacgggctggtactggttcatggttcggggtggggacccctgatgtagggtatgggaggtcaaggtgttcctactttgtcttgtgatactttgtgcttaatgggttagttacctgtataaacatctttagcgctaccagtgaaatcatccttgtgaccagctccctaaagcactgcctgtccaacagcaaaggttggatatggggaataaaacagtgctggactatggcatttccttaggttttccctggtattggttatgatggaatatgggtacttgtgcagctgtggtacatgaggggacaggttgattcattctgtttacagagaccaaagaaaacagagggacttttcccagttggtgatatggagcaagtgccatcagcaggcagactcgtgcagatcaccgtgacagagggatatgatttggtaaagttacttttggaaatttacaaaaatccttagtttgggagtacctgcaggaggaatggaattttgcttcattctctacctccaaacctcctggctttatgtagcagtggcattccgcctcagtgttccttattgttagtcttaatctccaagtcacattactgtgtgtctcaaatacccggcaatttgaatactaaatttaacaggatgaaagaaacagtggttttagtttccctagacagcagttcacgtataatttttttccctttctcctgagaagg

SEQ ID NO: 7822 - DNA, 1033 bp, Homo sapiens
aacataaactaattcttttaaatacattagtttcttaaattacgtagaatacaaaatttggagttacaaaccaaaattacagttatgctagtgtttagttttttttaatgtgttcatctcaaatcatgtagaaaaccaaaagtatcgtcacagactattattacaataacattagcttttataattgcccatgtatttaccctttattgagatctttatttcttcatgtggcttcaagttactgtctagtctcctttcatttcatcctgcaggactaggacttctttgagcatttcttgtagggcaggtctagtggtaatgaactttcccagcttttatctaggaatgtctaaatttcttcctcactttttaaggacagttttgccagatataggattcttgggtcgacaattttttttttagcactttaactatatcatccaattctttctgatgagaaatctgctgataatcttattaaaaatatcttgtatgtggcaaatcacttctctcttgctgatttcaggattctctctttggatttagaaagtttgattaaaggctgggcacggtggctcacgtctgtaatcccagcactttgggaggctgaggcaggcggatcacgaggtcaggagatcaagaccatcctggctaacactgtgaaaccctgtctcgactgaaaatacaaaaaattagctgggcgtggtggtgggcgcctgtagtcccagctactcgggaggctgaggcaggagaatggcatgaacccgggagacagagcttgcagtgagccgagatcgtgccactgcactccagcctgcgtgacagagcgagactccatcttaaaaaaaaaaaaaaaagaaacttcgattgattaaaatgtgtcttaatgtggctctctttaagttcatctacttggagttcattgagctgcttgggtgtttatattcatgtctcatagaacttgggaagcttttaagccattatttcttcaaatattttctcttcctatttcttgcccattagaattcccaca

SEQ ID NO: 7823 - DNA, 1060 bp, Homo sapiens
gtccttgtgcaagtatttctataaggtacattcctggaaatggaattgcattctagtcttttatataattatttttcaaaatgtaccaaaattcactttcttaaaatagctttaatttttattatatacagataatctttgccttattttcatttttgttgacataattcctccaggctcttaaaggtaagatttaagatagtagctaaagaatttagatataggtcttgtcactggaacaatttcttgaaacttagaaatttaaattgcttatgatgtctttggtactgtaactgcatattgcctttcaaattactattaatttatctcataaattattttcagatttttttttcctttattttgaccctgacccttttgcccttggtctatctacttttctttttctttctttttttttttctttttccttgtcttgtcttgtcttttctttcaactggagtgcaatgatgcaaacacgactcactgccgccttgacctcctggcctcaagcaattctcccacctcagcttcctgaatagtttggactacaggtgggcgccgctgcactgggtaatttttaaaatatttttgtagggacgaggtcttactatgttgcccagcatggtctttaactccttggctcaagcagtcctcccaccttggcctcccagagttttgggattataggtgtgagccactgcgcctggcctatctgaccattctttagagcttttgcccctcctttactctttatacaaacccaggcttagaaaagaaaaaagcaaaaaaattcagcctgtccctgtttttatatccagccctttgggatcccaaatgattattttataattgactgggtcagttttcatatcattttatgtttcttattgacttatagccttgattcaatctatgtccgtttattctcaattcagcacatttttagcttctatcctgtgttcctgtcataagggacactatattatctcattttcctatactgtgtactcaaatggctgaatacttaatctttctatcagcacctaggacagtgctc

SEQ ID NO: 7824 - DNA, 1009 bp, Homo sapiens
tttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacga

SEQ ID NO: 7825 - DNA, 1030 bp, Homo sapiens
accaataatgtatttcttatttataatatgacctatgtgtctatatcatgaaataattagaatttatgcctgtaagacctcacttctcttccttaatgtctctttaattggtagatgagtttgaaaagatgctcagtagtctttttctgaggcaaatttgagttcatgataaactctgtcagtataaatggaattttttaaggctatagatgttagtatctgtaggtatttggaacatcagtactagaatagaaaggaagttactggtagacaggagaagtcctttcaggtcccccacaaagaacagagccacagaactgttctacttatagtaattcatcaagtttactgcccttaaatttcactgtagtcatatcagctcttgcagcttatgttttgccttataaattacaagtaacaggtaaagcattgctgaccccttctagtttatgtcttagggaaccaactggtaatgagtattgttctcactgacatgaaagaaaagacttttctgtttgcttttctgctacaattctattataattttaccctagagcattttcctgtgattgtgatggatgtgatataataaacataatggaaaattctaaggccatcaaattactgattcaagatgggtaattaatactggagtgcatttgcatgggtgctgaggtgtctgtgtttacagtaggtttatgtgttctgtgctctgagtgatgttgtcatagtgctgtgtgtaaactgtgctgtgtcaggaattgggggtttggatggggctctctaatttgggtactatttatgttaaattttaaatgatgatgtagtatgggatactgtgatattttaagtgatcattgccttttctgctgtacaatatgacccttctcatctctctcattcattttgcatgcctctgctcacttctgtacagccacagttgaggctattgaggctgaaaaaggtatgatcagagtccttgtgctgggcagagatctgtggtgtgtgggtgggcatcagagaatgtcct

SEQ ID NO: 7826 - DNA, 1031 bp, Homo sapiens
ggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaatctggctcattgaatattttatacttaaaaaactttttttggcgtaaatatttgtgtaaatactgggttaactttttaaaagcccattacagattaaatagaagagagtgatgtgagtattagtgaccatacacagtaattcagtctagatttcttttcctgtggttggaaagcaaaaatacatgatgtggaaaagcctgaatttcttgtagtcacttttgacagccctctaagggtcattgtctattaaaatagcaacagatctgatgttttccttagtcataattaggtttctttttggtgttgtaattagtgacttttttagagggaaaaaaat

SEQ ID NO: 7827 - DNA, 1447 bp, Homo sapiens
aaataagcatcgagaacagattatttccctgattttattacttttttcccttttgaataaaatgaaggatatgaatagttacatgtttagatataccttaatttattaacaataaagttttgttgggtgtggtggctcacacctgtaatcgcagcacaggttggccaagtcaggcagattgcttgaacctgggagttcgagaccagccagggaaacatggtgaaaccctgtctccacaaaaaaaaaaaaaaaaacttagctgggcctggtggcatgtgcctgtagtcccagctgctcaagagactgaggtaggaggatttcttgagcccagaaggtcgaggctgcagtgagcagtaattgtgccattgcactccaacctgggtgacagtgagaccttgtctctaaaaataaaaaagtttgttttttctttttgcatatgattatataaaccatgcttatttccatatcaaatatttcttccttttttaagcaaataagtaaaatgtgagtctctttcttatgttaaatctatttagagaatagcatctgctataatgtttaataatatttttatttgaaaaattacatttgcattgaattagttcagataataagcacttaccatatgtaaggcaatattcataatcaatgaaacaaacataaaacatggaccttcccttcatgggcagcatggcataatgcttaagatcagaggatcagaatcctatctccatcacttagaagttttgtggttttggacaagttacttgagatctttgcttcagtttctcatttgtaaaataaagatgatattacatacttcatagtgttgtttgaggaataaattaggggaattatatagtgcttcacatattgtaagtacttaataaatgttagctgctgttattttgacagtattatttactaatacgcatctgtagaccagtgtgctaattgtttttatattgggcagtctgtaaatccaaagtaattaaatagattgtttgactcattcattcaacaaatatttattgctcttctcctatttgctaggtactcttctgggagtggagaatcaaaagtgaataagatgacaaaatctgtgattttgtggtgcttatattttagtaagggacaaagaaagataatagaggatggtaagggtagtagaggaaaaggagcaaagatcaagcagcttcattaaacaaaagtacaagataaattcactagaaaaattttcttttgcagtgtgtcttatatttatgggttctgaagattctatacccaagcacattatttcttctgagaggcaaccatgaatgcagacaccttactgaatattttacctttaagcaggaatgtgagtactgccagaagaaatgttttcacttcctcagtattcttttggacttaagtgggtagtaagagttttgaagactttacagtg

SEQ ID NO: 7828 - DNA, 1066 bp, Homo sapiens
tttctttattctttagtcattaagaaactaccccaagtttttgagtaggttaatttactactttgttcagtcaaagaggaagaagagatttttctagtaaatgataagaacttgaactagtattgcaacagtggagatttaagaaaattgaatttgaagaatcaataggacttagagttcagaaagagaacaatgacattaagtgtgagtgatagagaatggtgataccttaacaggtgtaagccaggaaggggagccaattttgagggaaaggtatatttaaaaaccaccacaaattaaaagagacccaatggataccttgaaattttgaagacaatgctgttggatttattgaatctttccttaaagcatgtggccaatccatacttctactcctggcaagcaaatggttatatcattcttcatgatgaggcttttttttttttttttttttaaccctcaagacaggatcttgctctgtcacccaggctgtagtgcagcgccatgatcatagctcactgcaggttcaaacttctgggctcaagcgatcccccaactcagcctcccaagtagctgggactacaggcacacaccaccatgcctggctaattttgtttattttttatggagacagaggtctcactatgttgcccagattggtctcaaattcctgggctccagtgactgtcctgccttggcctcccaaagtgctgcagttacaggtgtgagccaccacgcccagccatgatcagccttttgatgtctccttttgtcaaaagaaaattgtccttgtgttggtataaagacatatgctacaggagcagcattctgaagacttcaatttcaactatggctctacttcttactagtgaaacccctggagaagcaacttaatgtctctgaacctgttatctatcatttgtgaaatgggagataaaacttgcctgaccctaaccccagcactttgggaggtggaggcgggcggatcacttgaggtcatatgttcgagaccagcctggccaacatggtgaaaccccgtctctattaaaaatatactaattagccg

SEQ ID NO: 7829 - DNA, 1090 bp, Homo sapiens
attaaattcagttctgagcctactccagctgctggctcaagtcaaattcttcccctgtttgaaagttgatctaacccacctgattaagcaagatggtatatacccttttaattatattctattaagcattctttagctatgtaggaaataagaaagtggaaaaaaattaggaaaaatatctaaccgtatctgcatgtgtgctttcttaccacatcagcaaagctggtataggtaattgaagcacaaaatcctgaatttatatatattgctttccctcctccccacaaagtttacttgacctgaattgcccagatacctccttttttccccagatacttaaaaaatgtacgttttgctttgtataccaggttctagatttgtaaagctggattgtctcttgagattatcaagactgttagtattaataaaaaattcacctttttacttagagagcattgtcagtattgggcatatgttcattttagcacctacaatgtgagtcattttcttaacattattttatttcatgggttatagtaacctcaaattatcagactttcagattgaaccaaaatgctgaatttatgtgttttaattttttttaagctaaagtatttctgattgacaacgttagaattcatttggattctgttgccagttgccctgcttataaatctgaagtcatttggctaaagtgttttctagtagctttcctttaggaggattactttttgtttatttatttatttatttatttatttatttttgagatggagtttcgctcttcttgcctagactggagtgcaatggcgcaatctcggctcactgcaacctccacctcccgggttcaaacgattctcctgcctcaacctcccaagtagctgggattacaggcatgtgccaccacgcccggctaattttgtatttttagtagagacgacatttctccatgttggtcaggctggtctcgatctcctgacctcaggtgatccacccaccctggcctcccaaaatgctgggattataggcatgagccaccgtgcctagccagattacttattttcagataacccatatagccttggtgtga

SEQ ID NO: 7830 - DNA, 1054 bp, Homo sapiens
agtggatttaaaaattatggtttattccaatagtaaaacactatatagtaatgaaaatgaattctgcagctgcatgcagcaacttgggctaatctcataaaacatcacattgattgaaaaaagcaagtcatagaagactatatgaatcatgattccatttatatataaatcaaaaccaggcaaaactgaagaacatattgttcaggggtacatgcatgtgataagtctgtagagaaaaaggaagtgcttttcacaaaattcaggatagttgtgttctgtagaaggtggagggtagatttcatgtaagtatgtaatcagttggagaggtttaaactcgtggtttatttttctatttcttaaattgggtggtgagcacatgggtgtgtgggtgtttattattctttggctatgtatgtgtatatgttatgtttattctctttttatgtgactattttaattataaaatatagaaaagcactgcaaccattctaggaagcacactaaagtgtaaagaggaaagctgaaaattgcctgaattctagcatggagattgtaatttttttctctctctctctcttttttttaatgagacagagttttgctctatcacccaggctggagtgcagtggcatgatctcggctcactgcaacctctacctcctaggttcaaacaattctcgtgcctcagcctcccgaatagctgggattacaggtgtgtgccaccacgcccagctaacagattgtcatttctttttatgcttcccgtctggtctgtatttctggtagtaagtctttttgcccactgtttttgtaaaaagattacttttttccagatccctaaattgcccctctatctgtagtatcttcctacttcatttgtttttaaacctaagaataccctggaatgctatattgaagttagtatcttctcataatcctgaagtggctcccacttgtttcttaaatcacttaaaaatgcatgattacaaacattttaaaacttaattttatatttctttcctttccttccctgggcattctgcatttcaactgt

SEQ ID NO: 7831 - DNA, 1048 bp, Homo sapiens
agtcctttgactagtcgggactgtgctatactcttcattgatctgggtgggactctggagaactggctgccacattcttgttatatttcattttcctgagggacaaattgttacttagtataaatcagtatcattatataagccagaaagatgaagaaagtcaaccgctagacttaccctctgagacacacaagtacagaagggaaattgtcaatttgttgggctgaggaaatattttgggactctttcagagagacagttgcttgtggtggatagataaatgggcttggggatgtatttatcaaaggctatattttgggtcttcataactctggggatgtgttagaattctggtactttcctcattacatcactgcctgatctaaccaagagatttattttccttcactgcttcatttgttgtgttgggagtgtattaaaatttgatttttttttcccctaagggcttttcagttcctcagtgctatatagatgttaaataattaggctctagtttgaacacacttcacgttttagatggcgttgtttctattcttttaattattgtatacttgatttgaaaattatagacttgtaatgcagatagactaatttggaagtgtggatgagctgaacttgattttaatagttaagaagtttaaattgttagaatagccagttttcaagagctattccctcatccaggatggagagcttcattttctgagagaagggaaaggatgataaacatatgaaggagtaaacttgaaatgagccatcagcacctgggtcctcctgtacgatgtctcttttgttccccactttaaaactacttttatagggctgggagcagtggctatgcctgtaatcccagtgctttgggatgctaagatgggaggatcacttgaagccagcagtgtgagaccagcctaggcaacatagcaagaccccatctctacaaagaaaaaaaaattagtgggacatggtcgcacatacctgtagactcagctactctggaggctgaagtgggaggatcacttgagcccag

SEQ ID NO: 7832 - DNA, 1029 bp, Homo sapiens
tgttgaattgggcaagttaatgtctttaagcctctctttacttttctgtaaaatggaactattaatagctatctgataggactgttgtgaatattaaataaaggacataagtatcgtgtttagcacatacctgactgtagctactatttcatttcatgtagtcatattatgacggatacgatataaaacagagagtaataaaaatagagaataatgtgacagtaggctgtataatcaaatactttaattgggacatgtagattataaatagtctgggaatttacagaagggaaagaacagtcttatgcaaccatttaatattcctgtacctcagtttttccattggacatgctgtagacaatgctaggtgatctcccagagaatgattaagatgttaaagcatttttgtgtttttagatggtgcatatgatggtgagaaggaagggagaatgaggaattgttgatgttggcaaatttaacacttaacatttaaaaatttttccttatgtagatggacatggcagccttataggaaaacttaaagctggagatgtggtgatttccttccagggaacatacttgctttggtattactctctgttgcctcactggcattttaattagttgaaaactaaagttggtcaatggattgcctctgattgtgagcccttggatataatctggagattaaatgatttgtaacccaaattatctctctgatcctctggcaaaaatgaaacaaacaaacaaacagggcaggagaagatttagttctcttggactgcatgttaaggacatgtggtttactcgccatcagtgtttctctggatggaacatctttactcagaacagatcttagactgctaacatggccttcccacctttaagcacgttttcataagcatattcatggaaaacaccttttaaaaagtgctttattcacaatgtccaaaaggaactttcagttcctagtttgtgtgtgcttacttggtgatttgttttgtgttagcctgatactggaaagtttgt

SEQ ID NO: 7833 - DNA, 1031 bp, Homo sapiens
gccgggcctggtggcgcgcgcctgcaatcccagctactcggaaagctgaggcaggagaatcgcttgaaccccggaggggaaggttgcagtaagccgagatcgcaccattgcactccagtctgggcgacagagcgagactccgtctcaaaaaaaaaaaaaaaaatacatatatatatatatatatatatatatatatatatatggcttttaaaaatccttcttcagctggtcttaatgtggttagtcactgaacccatttatttgatatatgttagagtaaaacctaatttgtaatgtcagcagctaaacattaaagtagaagtgcttttctgatgcaagataaagctttgtgtggtggttgagtccaaaagatttctgcatgaatccaataacaagctctactgaactcctgttatgtgtaaagtactgtgtaaggcattgcagtgaaaaaagattaattcatttagccacttaatatttattgagacctattttgtgtctgattgctaagccttcaggatacaaatacaggtagaactcgatctttgccttggaattgctcagaccctgtgagggcagactgatagagaaaaaaatacttacaatgtaataagcacaatatatgaacatgaaagtatgagacaaggttctgcccctgaagagtttatatagtagttgacaggacaaagaatttgtttgtttgtttgttttgcaacagggtctcactgtgttacttaggctggagtgcagtggcaagatcatggctcactgcaacttcaacctcctgggctccagccatccttgtacctctgtctcctgaacagagctgagactacaggtgagggccaccatgcccagctgatttatttttagagatggggtcttgctatgttgccaggctggtctcaaactcctgggctcaagtgatactcctgcctcagcctcccaaagtaagaattttcttttctctttttttgagacagggttttgctctgttgcccaggctggaatgcagtggtgtcatcacagct

SEQ ID NO: 7834 - DNA, 1032 bp, Homo sapiens
ctcaggagtttgaggctgcagttaactataattgcaccactgcactccagcctgggcaacaaagggagaccctgtctcggaaaaaggaaaaaagttactaattctttaaaaacatatataaaatttgtcctgcccaaaaggagagtgaaaaatataaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccatcacctgagcagtatccgctgaacccaatttgtagtcttttatccctcaccctcctcccagcctttcccccaagtccccaaagtccattgtatcattcttatggctttgcatcctcatagcttagctcccacatctgaaagagaacatgatatttggttttccatgccgagttatttcacttagaataatagtcttacttccatcgaggttgctgggaatgccattaatttattccttattatggctgaggtggtattcctcatatatatatatgtatgtatatcacagtttctttatccgctcattgattgatgggcatttgggctggttccatatttttgtaattgtaatttgtttgagttcctcatagattctggataatagccctttgtcagatgtatagactgtgaagatttcctcccactctgtggttgtctgtatactctgctgattgttcctcttcctgtgcagaagctctttagttgagtctcacctatttgtttctgttgcatttgcttttgtgttcttggtcatgaagtctttgcctaagccagtgtctagacgggtttttccaatgttatcttctagaacttttatggtttcaggtcatagatttatgtccttgatccatcttgagttgatttttgtgtaagatgagagttgaggatccagtttcattctcccgcatgtggcttgccaattatcccagcaccatttgttga

SEQ ID NO: 7835 - DNA, 1026 bp, Homo sapiens
tttgggcctgtgcctctgcttccaccacagaagtcagcagctctacctttctcttttctcctctttatctaataattgtctcctcttcaaatttgggaaatgaacttaatcaaagatttgttgtgtttttttgtttgtttgttttcgaaatgtggcctcagtgtgtttgcccaggctgatcttaaactcctgggctcacatgatcctccctctcagcctcctgagtagctgggactacaggcatgtgccactacacccagctaagttaatgctaatgtgtagtttatctgcttcaattttgaagggtaggatatatatagttatgtgtgtgtgtgtgtgtgtgtgtgtgtgtggtgggggggtagtgtttgtgtgtgtgtgtatatatatttatatattcctagtccattgctgctacaacaaactaccactatgtcagggcataaaacaaatttattacactcctgtaggtcagagtatgatgtggatctcactgggctaaaatctaggtggtggaaaggctaccttcatctctagaggttctaggggatcttttttctcgccttttccacattctggagtctgcctgcattttttggctttgggctcttctccactgtcaccattagcaaccttgcatcccatggacctgtcttctatggccacatgtctctgtggctctttccttcccccttctcttccactgttaaggactcatgtgcttacttagtcctgaatggagacaccgtcatcatccacatagcccactgtcgtaatccatacaggctgctacaaggaaatgcattagaccaggtagcttataaacaatagaactttgtttctcacagtcctggaggctgagaagtgcaagatcaaggtgccggcagtcttggtgtctggtgaaggcctgctttctcatagaggcttccttcttgctgtgtcttcacatggggagaggaacaaacaagctcccttgtgcctttaataaggtgctaatcccagtcatgagggcagagtctcatgtaa

SEQ ID NO: 7836 - DNA, 1050 bp, Homo sapiens
tattatctgtagtttacataagatgaaatagagcctcccagcagttaagtaacttgtgtgaagatgggacccttgttcctaatggttctagaacctttatccttagtgataataagtaagtacatgaattgcctgaagaagtggtcagagtttatcatagaaaatctagatagtactcagtgtgtggaaaaatgtacacgctcttgcatttatggaaatgataatgttcactatttctgatattctattaactatcttttttttaaactatcttttaaattaactaaaataaaatacaaattaccaaaaaaaaaaaagaaagaaagaaaaaggccagacgcagtggctcatgcctgtaatcccagcactttaggaggctgaagtgggcagatcacctgaggttgggagtttgagaccagcctgaccaacatgcagaaaccccgtctctactaaaaatgcaaaattagctgggtgaggtggctcatgcctataacctcagctacttaggaggctgagacaggagaattgcttcaacccgggaggcggaggttgtggtgagtcgagatcccgccattgcactccagcctgggcaacaagagcgaaattccatctcaaaaaaaaaaaaaaaaaaaagcaaaaaataagccatattgattaggaagtgtgggatgacagataccttggttttttcatttttatttagttttttctagagctacagatttcatactttggcccaggaagactcctaaaatataaagtaaaaggtaatacagattttaaagtcgtgccattgtaatgtctgtaatgtcagaaaactaaataacattcaaattttgaacatgtaatgctactattagtaaaaataagtgttattaatgtaaagttgtgtaaggattactaaatcttgtatacttgaaatgattgaatagttcatagaagtcatttgtttctcttttatttaagatgtagcaagtttctaattttaaagacatattaagagatgcctttacttttttttatttttagttattatggatacataatagt

SEQ ID NO: 7837 - DNA, 1046 bp, Homo sapiens
gtggaggagcgcccagctctggtgcgccaggcgcggcagcggggcggccgacgcgcggaagtctgtgccgtagaagagcagcgcgcgcgtccgcgagtccctcagcgctcggcggttccgggacgccacgcacgcgccgcgcgcacactcgatgcgctccgagtctcccgggaagtgggggaatagccctgggctccaccacagcagtaccggcaagtcccccgcctcctccctccctggccgcggcgtcccagagctgcgcgtcacccccactgcgcccagcgccgagggcggccggaaaaccgcgccatcccacggttccgcccactccgcctccccgccggcctccctctccgctacggacccatggccgctggctgcacagacactgagcacccctagaaggaccaacaccaccctaatggggccggccgccatgtccactccggcagccggcgccccctcggccagcaccgaccccgcccagcggatagtcgtgaccggacgaggccctacgccacgggggcacgtggcgcatgcgcagctcgctcagccgacggccaggactaaaagcaaagtgagctttcgggagtaaagatgaggctaatggttacatcttaatttattttatttctttacaaattaaagatgcattgaaaaataaaccaatgaagagaaatgagaggtccagagcaggggcatcccaggtggggagcaggcaagcctggccaccatcaagcctagcccttgtcctgcccccaagccagttggggttggaagataactgtcagccactcagtcaataccaaagcccaagcggtgtcccagcaggagagaacggcgctccagctgcctctgcctctctccccaacaaccccgggcctggagaagcagtgtttctcgtgggagctcagagtgggatgtgaactggctctgtgaggtattgcaagttgatgaccaggctccctaggctccctacagaaccatccagtgttggggcctctccagctggaaaggaagctggtacctctaccagatcttaatat

SEQ ID NO: 7838 - DNA, 1054 bp, Homo sapiens
taaaagaaaagggctggagacagagagctcaggaagcttttttaatagttggaatagtctaagcaagaccaggtgaggtctcagcagagggtaaggatgggggaatgtgcagtgtgttgaaattcaagagatatttgagagaacctaaaggatttaattctctccagttggatttggggggagcaaagaagagagaggccaggtttcaagttgagcggagagttgtaccctcactgacccagaagaaaaccagaggaggagcttgtttgtgagacaagacgatggttttctctttttttttttttttttgagatggagtctcgctctgtcgcccaggctggagtgcagtggcgcggtctcactgcaagctctgcctcccgggttcatgccattctcctgcctcagcctcccgagtagctgggactacaggtgcccgccaccacgcccggctaattttttgtatttttagtagagatggggtttcaccgtgttagtcaggatggtttcgatctcctgatctcatgatccacccgcctcggcttcccaaagtgctgagattacaggcatgagccactgcgcccggccaagatgatggttttcattttgtgcctgctgagtctggcaacctccagccagacacattcagtgggtggttagaaatatggtcctagagattagaaaagaagctaaaaattggaaatccacattgtagtcatttctgtgtagttggtagtgaggctgtagaaatagcctcttcctatgctgtagatgggcctgttcctatgctggttgagttcttacggtgagcttctattggctgtagtagagaagagacggccactacacaccagcatttaatgatagggagagttagggggcccagcaaagagcactgagagtgagaccttccagaagacccagaagctaagaaacagggggtctcagtaagggagcgtcaggaatcagatgcagaagagtccctgattaagttggggaagaatcccctggctctgaccattagatgccattgtttcatcatttcactgagacagtg

SEQ ID NO: 7839 - DNA, 1050 bp, Homo sapiens
ctctcttcatctcaccagtgtcctctgacccatgggtaagagaaggagagatggctgggagccgaattctgggatgtgaggataggtgatgtggtgacttcctgcagctgcctgactggggctttcatttcctactccttccctacctgcgtaaatttccatgacctgtgtgatagcctccctttcccttcctcacctccttttaaccttgtcccatctttcccaatggatatctttccctggccaaactggatgagacttgatttctcgttgatttttttttttttcccctcaagaagaggattcttgtgtaaaagtatatgcttcagacagcaactccccctctcccaagatggatatgccaagactgggctctgttgtgtggcctcatgtgccaggttgactttgggacagaggcacagatgataggcacagatgccagccagaggggtcagaatgtgtaagtgccagccagtactgtgtggaggtgggaaagtggaaaggggctgtcttggagatggagggaacaaggtggggctggactataggtgtgggcatgggagatgtgaactcctggagagatctgggccagggtagccatgggctggttcccatggggttagggagtgagggccatggcttccctgcagactctcagtttacactatatattttataaaggtgcagccactggagctgggtttcactcatcgctgtctgcctaggtctccgcaggtgttggatttctgtgtctgggaatgtcgtgggcccaccagggtcatctgtgaaggtctgaaggggcttgctgtgttcactgggtcttcctgcctcctgtctttcttgtttgtgattctctgggctacaaactgaaaagataaaaagagggtatagagctgtttctccttggcatccctggtgaggtggctaggagtcagggagagggatcacctgttcttctgggggggtccaatcgagacaggaagccttcttttgggctgttgtgtcttgtcactgtggcctcagaggcccacattggcggctaggttgcaa

SEQ ID NO: 7840 - DNA, 1072 bp, Homo sapiens
ctgcctgtgtgggaatcttaaccaaaaccataccatcaaagtgcaataatttgtaaatgatagaagagacatttcttccaaatggtggaagggacactggttaatgtcagatttaccatatagcgctcattgctaacattatattggttgggatgatgataatttattctttttcattctttttgatacaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccgagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattac

SEQ ID NO: 7841 - DNA, 1035 bp, Homo sapiens
gccacccattagctaaggggcagcagtccccatgactagggtttttctctttgaaggaccaccagcagtggttagttgcctgcgggtctacttcacactgctggagttgctttcaggcctagcctgcatggacatcttttcatgtttctcctcttacctgactcaagctggctcaaattctaaccctctgtcacttaagtcatgtctgtctggagagggccttccagagaaccatgattcacatgggccattcaagccagtcccctaggaatagtgggaccagaggggtcttcatgcccccaaccctcctgtgtggagagcttgcttgagctctggtctctcaccagcttcttctcaacctggaagtttgtagcatgtatcatttcttgggtgataagtccttccattttcttacccatttcttatcactcaggttctaccattcttcaggtctattacagatttgttgaacaaatcttctccaacctttaatcatatccaattatcttctcccatcagaaaacgtactcttacctacttttccagccagaaccacctattaatgtctcattcatgcccagatgaaggccaatgccacgcagcctaaaggggttgtctctggtctcctacctatacccacctttcagtgtgtctgcctagaaggaaatgagtaatgacctctcacagtccctcaggttaccctcactgtctacaccttactcctcttctgtatgcttaacaccatctcaccaaaccagggcctactttatgttcctagcagtagctcacaggggtatggtgtgtttgtgtaacttttcagcaccttctctttttcctttcaatgatgcagggcaattctgcacagacttacaaactgtgcatgtaaaagtgtaaaagcatgtatcctcttattgtagtcttaaaaagctcgtggaatctagggacacagaagattctgtggcacagatttaggtacagagcaaaatactcactggaaaaatcaagtattggctagctaccacggggatttgatcc

SEQ ID NO: 7842 - DNA, 1083 bp, Homo sapiens
gagtgtggatgtgactgctctgctccacctggctgggacatagcaggacaggcagcaacccaggtctgtgaaatcaatcatgatgattctgggaggaattattggtgaattagggggatgctccaagggatggtccagatggaggtaggtgtaaagtggagttttgctggaaggagttgtttttgcacaacatattgatttccttggggtgggagaaaaaagaaacagcagctcttcgctgctctcccagagtggtgggtaggagaggacaggtgggagtctgtgggcccctttagctggttatttttttagatgtaccatcaggtagctgcaactgtattcccactgcttccccagcaatgcaaagggcagattacgaagcagagctgggctggcagcaagttttgctttgctttctcccagcggccaacagcatttgcattggtgggtggtgcacacactctgcagagagagggcgatacccaagcccagggcccacagactgagcacagaacagaaaattagggctgggaattcacccgtggctcctcagtgtctgtgttgcccatctctgatagacttccaaaatagcaggggccaggaatttggtggggacacctggggatgaggggccctgccagagctgggttcattcttgagggaatgtctcccaaatctgccatttaagaggatagagtttcggtccccaagctcaattctgcctcacctccatgctccattatctgggtatccccaggccactcacttatcccacccatgtctattctcttacctgtaaaactagaattgcaggtattttagtggatacgttgttgggagatgactcataggttttgatcccatctccatctctgcattatcttggacaagcaacctgacttaggtgcttgcttgtctttaaaatgcagaacgttagtacctatcatgctagctcattgggaagttgggaatggcaaataagagaatggccttgcaggctcttgagggaacagaaaagagaaaagtgggttcctcagagacatatgctcttacctagggtgggggagctggtttatgaatggt

SEQ ID NO: 7843 - DNA, 1049 bp, Homo sapiens
gctgcccacttgaccatcttccaagttgtactctccttcttctctttcctttccttcctttccttactgttctaaagcttttaaataaactttcactcctgctctgaaaaaaaaaaatgtttatctttgcaaaaatatagcaaaagcagaatttcctggtttcacagaaagagccttacctttcataaaagcatcatggtttataattttttaaaccatcaaatgatcatctttgggaagcagggtgcttggcaactgtgggataacaaggctgaagaagggatgcaccttccagggaggccactgtgaaacaaagggctttaaaaaaaattccatttttatttttgatttgagggtacacgtacaggtttgttacaagggtatattgtgtgatgctgaggttagtgcttctattcatcccaccatccagacagtgaacacagtgcccaataggcagcttttcagtccttgctccccttcctcactcctccttgtggagtccccagtgtgagtctattgttctcatctttacgtctgtgtgaacccgagagttgattcccacttacaagtgagaacatgggatatttggttttctatttctgtgttaattcacttaggataacagcctccagctgcaaccatgttgctgcaaagaatgtgattttttttcctggttgcatagtattccactgtgtacacatactacattttctttatccagtgcaccatcgacagacattcaggttgattccatgcctttgccattgtgaatagtgctgtgatgaacataaaagtgcatgcatttttttggtacaatgacttattttcctgaaacaaagggaccttgttttggagaacattatgacaaaagcagacaccaggaaagcaagtcagaattggaagtaaatgaaactcttagagatgttgtacttcctgacttctctccttattcccaagagggtttgtaagtgggaaggatgatctcagcattgttcttacttgcaaatattgcaaaagctaccaggaagaggcaggagtaagtccctgct

SEQ ID NO: 7844 - DNA, 1149 bp, Homo sapiens
gctcactgtagcctccaactcctgggctcaagcgatcttcccgcctcagcctcccaagtagctaggactacaggtacacgccaccaagcccagccaatttttaaattttttgtagaaatgggtctcactgtgttgtccaggctgatctcaaactcctggcctcatgattctcccatcttggcctcccaaagtgttgggattacaggcgtgagcccctggatctggccagctccctcattttttggttactccagtgtcgttttgtcattttactcttattttgtggcgattcactcaactttcatccttcagtcccttctcttgagtttttcagttttgctaacaagttcttaatttccaagaactcttttatatcttcctgtacttgtttcatgaatacaatatcttatctgaggatagtattttttttcttcatcccacataattccatttcctctaaggttgtttttttttgtttgtttgtttgtttgtttgtttgtttttgccttggtcttggttttgcacattagaggttttaacttcaggtgtcaggtaatcactgggtgtcgactgatgaagcctgggaaatgtaaaagtccagatcaaatgggtgagagtgcggtcttttgagtcttttgagtttcactgtaggatggtctggctgggctgttcactggggaagcacagcagtgctctctttaggtcttcagagatttgccagattaccccaaggggcccttcctatgtgatgggaaggatcggcctggccgcatcttggagcccagtaggggaagaaggctaggactctttgcactcagcgttcagcatgacagcatatggtcacttcatccttttgttttcagtgtggcgcccattctctggatccatgctggcatcccctagttccaaacctcacttatactctctagagaataacctcctagcttcggccatgttgaggaaaaggctgtagctctgtagtttggaaactaggaatgggtttctcacccagcttttacccattccatacttaagcctcccctccaccccaacttccatggggtaacaatgccacagttctatgtatttaaagattcttagcattttcttctgctggttttgggtgtggtattctcaggtctgctaagg

SEQ ID NO: 7845 - DNA, 1568 bp, Homo sapiens
ttagcatttgcagtcacagaggatgggacagggattctaactgcattgtggagagtgttatgatctagtccagggacctgggcttggtgcccatgtgtgtgtaggtatgtgcaggtgtgcatgcctctgtgtgtgtgtgtgtgtgggtgtgtgtgtgaactttcatttccaattcctcacagactggtatttagccaaatacactgacaattcctagagagatgaaaatttaaaactctaagtcttgcaaaaggtaagctctatttttttcttgttagattcaacagacataaaattacgacgtcctgtttccatagcagtttctagacactcactgtcaatttctgagcatgccttgttgcagtaggggcttggtttgtgtccaggtgctgttatgtggagcacactggagtacccctggcctggtgtctatagacccctttgtcaaactcctatagtacagggctggcccaagttggcgccatcatctttctgtgactctcctcttggccatgagctatctggctccttaaacttgtcgtttcctgcagaatcctgctaatgattagaccaccgccacatgtcctccaaacttccttctgatgccctgggattcccccaaccattgcaaacccaacccagggtgttaactgcagtggggtgggcagtttacatatgagtgatcaactcaagaggggcaattttctttcccagtttcttgctggtgaaggagagtcaggtggggatggagcagagtgccaaggagcacaaagcagacagccacacagtagaaagagtgcaagctgtactgccttgcctcaaacctggggtcttactctgagctgaatgacgtgtctggggggctcttttgcaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggc

SEQ ID NO: 7846 - DNA, 1034 bp, Homo sapiens
ccccgtgcctgggttctcagcccctcagcggcggccccgtgcctgggttctcagcccctcagcggcggccccgtgcctgggttctcagcccctcagcggcggccctctgcctgggttctctgcccctcactctcactttagaagtctccagttgctctgaagggggaaaggcctgcagaatgtcagcttctaatactccagtttccttctctccaggatcttggcatctcaaattctgtcttgtctctgccactctacgatgccttcaaaaagatatttctcattttttacccagattttctaggtgttctccaagggatgctgcaagctgttccattatacctgggagtggtaatccctgtgtagtagtttaaaagttaccccagctaattctaatgcacagtgggttttgaattcctgctttagtttattgcttccaactgctgcatagcatccctggtaccccccaccctgctgattgtgcacccacctgcaatggtctaagtggactcaactctccaccacccagaggacactgcatgtctttatgcttgctcttttaggggcttgtgcgggagtgtctcaggaatatatggaggactggttttcctcttatgttagtctgctagggctgctgtaaccaaataccacaggccaggcacggtagctcacacctgtaatcccagcactttgggaagctgaggcaagaggatcgcttgaggccaggagtttgagaccagcctgggcaacatggcaagactcccatctctacaaaaactttaaaaaactaatcaagtgtggtggcgtgtgcctgtagtcccggctactcaggaggctgaggctggaggatcacctaagcccaggagtacagtgctgcgatgagctatgattgtgccactccacttcagcctggcaacaaagcaagagcatatctcaaaaacaaaaacaaaccaaaaaaccaataccacagactaggtgacttaaataacaagaattcattttctcacagttcttgaggttggaaatccgagatc

SEQ ID NO: 7847 - DNA, 1047 bp, Homo sapiens
gcaggtggatcactggaggtcaggagttcaagaccaacctggccaacatggtgaaaccccgtctctactaaaaatacaaaaattagccaggcacggtggcaggcacctgtagtccctgctactcaggaggctgaggcaggagaattgcttgaacccgggaggcggaggttgcagtgagctgagattgcgccactgcactccagcctgggtgacagagcgagactctgtctcaaaaaataaaaaacagaaaagtagaaagaagaaaaaagtcacagattatttcttcaacaagagattcaattgccattaccctttggatatatatatatatatatatatatatatatatatatatatatataaacatgctttattatttatgtacataatcaaatctcccttaatattatgtttttagctatttttaatagtttaagtatactttataaacctcttttgagaagcagctgttgtttagagaaaacttctatgcatattacaaacaattcaaatcattcagaagactataaagtaaagattatctctggctgggcgcggtagcctatgcctgtaatcccagcactttgggtggctgagacgggcatatcacctgaggtcaggggttcgagaccagcctggccaacatggtgaaaccctgtctctactaaaaatacaaaaattagctgggcgtgatggtgtacacctgtaatcccagctacttgagaggctgaggcaggagaatcattggaacccaggaggtggaattgcagcaagctgagatcatgccactgcactccaccctgggtgacagagcaagaatctgcctccaaaaaaaaagaaagaaaaaaaagattagctcagatcccctcaactggagacaccattgttaacacttggtaatgtcctacataagaagcctccttgtgcataaatccacacatacttttgtttgcagatgcagataaatataagtgaaatgatgccgatcgggcctccccaccccgtggtgtgtcccttacgtctttgcatgtcactggaacctgggaa

SEQ ID NO: 7848 - DNA, 1062 bp, Homo sapiens
attatactcaatggctgacatttattacaacaaaagtacacagagcaaagtcggcaaagggggaaaggcgcgtgaggcaaagtccaggggaaactgggcctgagtttccaagaatcctctcctggtggagtttcaccggaggcacttaattcctccagcatggaatcacaacaacacacaagaagtgctggcctccacggaggcccattagagactcagtgctcaagtgtcttattgggggctggtcatgtaggaacttctgcctgccatgtacccagattctggactcccagtagaaagcaggtgttcagcataagccactttatttgtacaggctcagtaccagagctgcttatatcaccagaagaaaagttttacatcagcctagagaactgtttactgttcgggttcctagacgccattcggtagggtcaaccttgcaagcaggcctttctaaggatatagaagtctcaggtcagctgtgttaactgttctgcacaatacttagtaaatagttgtgactgagtgaatctaaatgaatcagcccagtgtgactgcagggcctggagaattggacctcaagactctcaaaagctttagggtaaccccctccccccaaccgccttgtcatcagtctcaccctcagatagacaaaagtgagagtgggaggtctcctccgccacctcccacagacccttggtaagtgaaactgtctggtctccaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtagggctagggccatcgggggccgggggcaaatgggtcctataaggttcccagccaccaccaggggatgagaacagc

SEQ ID NO: 7849 - DNA, 1076 bp, Homo sapiens
tacccaaagtctcatttaaaagctcactcctgctctgggtgtgacaaaggtgagcgttggatacctcagtggatgtctgcaggtaagtgtgtgcagcgtcctttctgtaaaacattggaaagagtcccagcagtttcaggaatggacttctgaagtccgccatttccaaaatgcacaccgagtactgtgaaaatgagggtgaaccctcctggacggtgttactttatcggagaggaagcatgtttggaacatctgagggcccgtcttggattggaggatcatctgctttgggcagggctgcccagagcgcctctgatagccaaactctcagactttctgtttctcggggcctcaaaagaagtcgatggaaaaaagataattgtccttttatttttccctgagcgctccttgagtcacagtcatttaaaggatgtcagagacacagattagattgcagagtttaattccaatcagtaattaattacgggaagcctgctaagtgccgaccaccatgaaccatgtctctggaggtggacaggtctgtagaaacaatgtgctccggggatgagatactcttgcccgacttgcccaaggcagacgttgctgatccactgtggggtcctttcccagtgagctgaggtatggctttaggcacagtactcaggcaggcggtgtgatgcatggctgctctttcaagatgcaccttgtgccttttctggtcttatccaagcccttcaattctcagatggagaaacagggccaatcaattgcctgcttaattgactccatgcatagcatctttgacctccaaatgaccagatcagaagtttctttgcttccgagtcctccctagcatttggtgtggcagaccaacccctccaggctccctccaccccattgccttctaggatgcatcattctcttgctcctcctacccctgctccaagtgatctttctatgtcttttccagaaactcattttttcctcctgtcttcacaggaagtatttccccagattctgaactttatatacacttagaacaatgttacttcaggccaggcgtgatggctcacgcc

SEQ ID NO: 7850 - DNA, 1048 bp, Homo sapiens
tgggtaaatggttgcaactgtattagtttgctaaggctgccatacagagtatcacagaccaggaagcttaaacaacagacatggattatctcacagttctggaggctggaagtccaaggtcagggcgtcagatgggcaggtttcttctgaagcttctttccttagcttgcagatggccatgttctccgtgcagttcttcatgcagttctccttctgtgcatgtctgtgtcctgatctcttgttataaggatgccagtcattttggattagggcccaccctcatggcctcatattaactttattacatctttaaagaccttatcttccaatacagtcatattttgaggaactgcagaaggggttagggctttaacatatggattttgggggaatacacttcagcccataagagcagcattactggcagggcgcgttggctcacgcctataatcccagcactttgggaggccaaagcaggcagatcacttgaggtcaggagttcaagaccagactgaccaacatagtgacaccccatctctactaaaaatacaaaaaattagccaggcctggtggtgtgtgcctgtaatcccagctactcgggaggttgaggcgaacctgggaggtggaggttgcagtgagctgagatctagcctgggtgacagagcgagactctgtctccaaaaaaaaaaaaagcaacattactactctcacacggttctctagtgacaacggtaccctaagggggcaagcatttctggctgagggtcagtggcagtgttcaggaagctcagagggcaggaagcccagggtgcgtgtgcagaccctggtggtattccccaactgagccactcaccagagactctgagcagcatcttaaaagcctggaatgctggaggtgctgattcctggggataggaaggggtcctgagacatttttggtttttatttttatttttttccagcatttttaaagagcagcttggatgattctgatgaacagccaggctgggagccattggccagaagctctgttgaccgactgcccctc

SEQ ID NO: 7851 - DNA, 1038 bp, Homo sapiens
aggagtgttacaggttatttgacataaaacagagaaaaaccagtagcatcttttacaaagctcagaaactttttctctcttttccccttttgatgtggggtcactggcctccttagctctgaacaccttcagaacatcagctagggtcactgcagaccaaagcacagccagaggagaagggaaatcctggggaggaaggagaaggggcgtgagtagtgaaacggcattggcggggacagggtggaggaagagatgtatgatgggccagggcagtgctgccctgcgggtgagggtctgtcagctgagtgcctgctgtgagcctcccatgggaagcagcctggggctgcagagtgagccctgatggacttggtcagactggggttaagtccagcagtgtgacctgctcatcacttttcttccctgaacccatgtccacctctcataaggttgtatcgaagttccaagaagaaaagcagagcgagtgctttgaaaggacataggaaggaaggtggccctgcccctcaagaccgctgtgctggggtcttggcaaaccccttgcccctggaacagagaccggtacaagacctctggagtggatagtgccagctaggggagggcagagtgaggaaaggccttgttccccaggaggaagagaggtgctgagctagcagcgagggcttcttggaggaggtgagatttgagtttttctggatgggcagaggtggggaaggggtacgctgggaatcagggagcagaaaaggttgggctgctttgggcagtagaactccttgcccatccagaagatcctaaaatagaccagcagagagagggctgcttccatcctctgtgtttaaaagaaagggttacttgggattctgagctgttcttcctaccccatcaaaaaaaaaaaaaaaaaaaaagctttattctttgctgacaataaagcatgcacattcatgtagaaaatttaattaatgaagaagaaaaagaaaagcacacaaaatcccagaggcaaccctattaacattgtgctgggga

SEQ ID NO: 7852 - DNA, 1181 bp, Homo sapiens
agctgcttaacgaggaaggctggtgactggttcccttgagggtgccttttggaacccctgtgtctttggtcttggggatgactgatttgtaagtgtgtgtctgggtgcaggaacggatactggcgggagtttctgacaagtggtaggcttgtcctggcctggccgtggagtgtggaagccagcctttttagacaaggcagctggaggaagaagacatggcactgagggaggaggagaactagcatttattgggcatctactgttgtggcaggcgctctgctttatcacgttcagttgtcgttgccactatgtgagctttctgttattctttgccagagagaaaactctggcttggagtggttaaaatgctcagaaagtattgggcaccaggaattttgaattataacctattgtttgatttaacttgttcagagccaggaaacaaagtgccatctttctaggtcttgtccctgttttaacagtgaatcgataggtacagtaaaaataaataaggatatatgtataaaagaaaaacaagtgaaccgagagggctgagaaactgcccttagcaacctgaaggtcaaaggctgatgggacccatttatttggctgttaaaagccccacttattaagggaatgattttataaggcattcctggtaacagctctcttacgttggccatcttaacctcaatttttgtagctgcaggaaactgacagagagactaaattgctggccacacagcaggtcatttcattggtggccctcccgtctccactttgagcttctgacttgcatctctgtccctcaaacctgcattctttccccccagttgtggtcatgtcagagttactgggcaaacctagtcctttcctgggatagtgctttgggagatgctaggaagggactgtcagatgtggccatgaggataaggacagaggggatctcaacaaagtaatttttttctttttaattgtatctatgtatctatctaatctatctctgaatgaagaagttaagatctgtttctgaaagtctttcgtaaagcacagaacttagtacagactggaagtctgcgttgggaagcatgtgaatcaacgctcgccttaatctctgaaaattgattgatggatcaattgccattaattaggtctcaccctttccgtgtctggtggagaat

SEQ ID NO: 7853 - DNA, 1023 bp, Homo sapiens
accctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcct

SEQ ID NO: 7854 - DNA, 1051 bp, Homo sapiens
attctcccagccccgtgtgctgtaccagctggaccgcatcacccccacccaagtagaaaagtttctggagacctgtagggacaagtacatgaggtagggatgcttttgtcttggactgacggtcatccacataggtctcacgtatcccttctgtttccccatgtgtacaaaaccctgcaccagctcacttgttaactgccagtatttgatcagattctgtcacattttctgtagggggtctgatgaattgccagtctgaatgctccaagataacggaaataattgcaaggaaatttcttagtgtcttctccccatggggaaactgctaacgaatatggcagatgccactgctctgtttgccatcagtaccattggttagcagactgcttagattttctgcatccattacatgctgaccacaagcagccatgcagaattgagttgcactgctgccccctctctgacctttactttcccctgtctgtacctatttctggtctatgccaggctttttctctgtcacagacataccctttccgaccctaatagcatctatattctctgttgaaaggtgataaccagaagcctctccccagcagttttgctggacttttctttggcatgctgcaatctcatccatacctttgccttctagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcaggtgcctgctttcatttccttcttgttccacacatgcctgtcctgtttcctgagaaacaatgatccccgtgtcacatgcatatgtgtgatatcctcataggactgtgtcttaaactctgggtggcatgcttgctgtgttaatcctattttggtttttaaaaaagccactcaagaaaaagtctaaactggatacagtcaaaatagaagcaatggttttgttatggcc

SEQ ID NO: 7855 - DNA, 1037 bp, Homo sapiens
tcacttgaggtcaggagttcaaaaccagattggccaacacgatgagaccctgtctctactaaaaatacaaaaattagccgggcgtggtggcgggcacctgtaatcccagctcgggaggctgaggcaggagaatcgcttgaacctgagaggcggaggttgcagtacaccgggatggcaccactgcacttcagcctgggcaacagagcaagactccatctcaaaaaaaaaaaaaaaaatgacaggcagtcattcaaaaatggccaaggcaaaatctcaccagccaacaagcagaatttatctcatgactttcttagtttatgtctttcactcaagccatttccctattagaagaaaaatgtttttttcccctgttagaagaaaaatgctgattttgtttgagcgctgtccctaacaccagcctactacctactctatcttgtgagccaactcttccctcaatcattctgaatcccaataattattagtactagtagtcttgttttgataccatttattttaaactgctctttcttttgctgtattgtggatcaaaaatccattgaatcagccttttctattcttccagggagctgttactttgataccctcttaaggttttttggttcgtttgttttttgttttttttttatggttctgacctgctcaggcagctccttcatgtttataatcatggttaggatcaaaagcaaagggatacagaaatcagtaaatggtttcctttgtgtactaaatagtaattcaaatgtagcacaagatcagcaggccaaagaagaatgtatctctttccgtagatcaaaaataaaaacagcgagtgaagcttaaataagaatatttgtgttaaggaagctcctcgcttcttgtgttcatgtgtcaaggtgtgaaaggtgaaaaagagactcttccagattttaaaatcaagagtgtggcaaggctgggtgcctttgtctgtttttctcctccaaaggctttcttattctttttttttaactaacaaattagagttgtaatttggtttt

SEQ ID NO: 7856 - DNA, 1045 bp, Homo sapiens
gtgggggatacatctaggggactcttttatactaagtacataatattttcatctcacactacgttaaatcactcaagaattatttattttgtttatttaccttgagaagatggtagatacgtgttcttaaaaaaataacaatagtagtaattcaaacaatacagaatagcacaaagaaaaagataaaggtaacaaagtctgcctactggctgtgagtactgctaatctagtgaacacaggcttcctctctgcatatccatagtatagagccatttgcagatctgtgtatatggtcacgtggttaagggtacaaaacagggcgatggcatttttaaaagaaaataatttttcattctcacttatgcttttatctgtcttgcttaatttgaaaaagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtgagtggaatgcacagaaggctaagcaatagcccttttcactcactgtcttctgtttagtttattaggtttacataatgttcgggagtcagcttttctccttataaattaggcttaagagcccaacaactgatgtcctattgggaaacggacctctcatctttcattgctatagtagtttcagtaatttcattaaccatactacaatctctggccaatctgagaacataattttttatttcttggtaaataaactaacccttataggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggtgagcctgagaatgcacgcctgccttccgcctgcctcccgcctgcctcttccgcac

SEQ ID NO: 7857 - DNA, 1031 bp, Homo sapiens
cctctgagcccctgtaaggtccatggtgccatcaggactcactgggaactgtgtgtccaacaacctcacccccaaagtctcagcctcactgggcctggagatctgctggtgagacaagagaggacagtgccatcacttcctcgtggcccagagctggaagatgcatcctgctcagcccctgcaggcccagaagtcacctggctccactaggagggcatgggcagtgtggggccgccaggttgtaccaaccttcagagcacactcaagtgctgttaatttccctgtcctgtgggagccaccagcagattggggagaggaccattgctggggcctgggcccaggtttcaggaggcagaaaatctggaggccagcaggatggtgggggtgggaggcttgaggtccctgagggaagcaaaggacttgtgtagggtgcggcgagtatggcctcctaggctgggctgggatgggggcgggtacacagtggggattcccacctgtccaggagctgccttctctgtccccactctccacctctcacttctggaacttaagggagccagggaacatctaaaattgagactagagaggtgggaagaaaatctcattcattgagtacttactgtatgccacgcactttggaaacattcgttgtattctctccacaagccaggtgtcattccctgctaagggaagaggctcagagaggttaagtgacctgctcaagatctcatagctggctgagcatggtggctcatgcctgtaatctgtgcactttaggaggccaaggcagggtagatcacttgagctcaggagttcgagaccagcctgggcaacatagcaagaccttgcctctacaaaaaatacaaaaattaaccaggcatggtggcacatacctgtagtcccagctatttgggaagctgaggtcggaggatcacttgatcctgggaggctgaggctgtagtgagccatgattgtgccactgcactccagactgggcaacagggcatgaccctgtctcataaaaacgaaac

SEQ ID NO: 7858 - DNA, 1066 bp, Homo sapiens
tgcccaggacacacagtctgtccaggacagagcaggactccagacatgttcccatcacccaaccattcctgagagtttcttgtgcaccaggcctgtgctggataaggcccttcccctgtcctcggtggtacagatagaaagagtattggccactctgggggaccagggctgtggtgaggtttactgtgcaggcccagctcagcctggagcttcgtgggaggcctcagagaggaggagcttggatttggagtggggaaggcttccaagcaagcgtgtaaataacaggaatatgctttccgggcactgtgagccctgggccacagcaggcgctcctgggggaggagtgggggtgtggctggaacaggtgatgaagggcttgtgtgacaggctgtgcaaacttggactttatctggaggccagggagaagggttttaggtgacatgctcagattggcattttgaaagatcctgctagtggcaggttggaggctgggctgaaggaggcaagaacgctaaggaagccagcccctgaacatggatagggactgatgactggacacaagacagcggtgagcagaagctgaaggggagggaatggattctggaatggaaaagtaccatctatgggccgtggtgcccagtgagagggaagagggagcaggcagcaaggagggctaccagatctttacggtggctgcctgggcaaatcagctgccaactgggatacaaatacacgtgcataaacaggtaggctcgccttccactctgcagttatttattgaacatctactgtgtgtcagacacatagcaagcattagaggacaccacaatgagcaaaacaggaaaggctccctctgtctaggagcttgtgttgcagttggtgaagtcaggcagtaagtacaaatcagtgggaactagggaactatcagatcagatgaagaacacagaagagtgctttcatagtgtgcactgggctgccttctcctggagtagcaggagttagtagttagtagcatgcatgcttaggcccatgatacttttagggtccacagatatgtttcttttct

SEQ ID NO: 7859 - DNA, 1046 bp, Homo sapiens
tccacaactcttctcaaagatgtggcccatatgttcctaataatggctttctaagaatctgttctgaaggggtaccttctctctgattttcatttgcatttcctgcttagcttacacacttcaccttgcctatccacctgtcctgaccccaataacctccatcatcagacatctcatcttacctacctactttctacttttcccagtccttcccgtgcttcataaaccatgatcatgagctagagacacaaggtcatagctaaggagttgggatcagaaaatcaccttctgtgattttccattattgtcaatacataacttcaacaaaatcaagaaaatcatgaaaggacatcctaaggggtcaggtgaggttgcagtggggttagtcggtcaatagtttctttatgccaattaggatttctgcagaaaacaatgaaatactggtttaaacagtaaaaatattttaattccttacagaagcccatggaacatacactccaggtttaattcatcagctcaatagcatcatcaatgacttaggttctttccactttctgcttgtcatctgtgttggctttattttcaagctagctcctccctggttgcaagataattgcagcaggtttagttatcatattcggacatgctaacgcccagggtagtgatcccttccttgcatttctttctcattttaagaacaaagtgtttaaaaaattatacttaaaattattggcatctctgtcaattgaaagatgtcaatctctttcatttttcctaatcactaataacatctactaaaaacaaaatgtctgtgtaaataatttatttgaataaaattaaagttgttgagtgagctcggcttttgaggagtgggaaaggaggggtgcatagattagtggaagatgagaagctagtggggctcaagtccagcaggagcaggagtttggagccaggacttcctagcctctcagggtttttttttaacttccttacctgaaatgatttgtgctatataacttgtcctggctaaactttcttaatctcaa

SEQ ID NO: 7860 - DNA, 1050 bp, Homo sapiens
ccatgatcagctctgacatatctgggcaataaaaatttttcagctccactgcaatcttaaggaactaccactgtatatgaagtttgtcattgaccaaaaggtcattatatggtgtgtgactgtaatataaaaatagttattgtgataaaattattttaagggagggagacaatggatttggaagtaaaattagtcattttgttagttttttattgctgctgtaacagattatgacaaacttaaacattaaaataacacagattggccaggaactgtgactctcacacttctaagcccagcactttgggaggctgaggcaggaggattgcttgagcccaggagttggagaccagggtgggcaatgtagtgagaccccatctctacaaaaaataaaaaaattagccaggtgtggtggcacatgtctgtagctccacctactcaggaggttgaggcaggaggatcatttgagcctgggaggttgaggctgtagtgagcccagaccatgccactgcactctagcctgagcaacagagcaagacctgtacctaacaaaataaaaataaaaaaaacaacacagatgtattattgtatagatctggagatcagaagtttcaaatgggttggcaaggctcctttccttctggaggctctaggaggagaatccatttccctgtctgtctcagcttctagaggctgcccacattccttggatctagcccccacatcactctgacctctacttcatcacatcaccttctctccctttgtctcacatttcctttttttataaagatccttgtgattacattggggacatcagataacccaggataatctcccaatttcaagatccttaatcacatttgcaaattcccttttgccatataacgtaacagtggtaggttctgaggatttgcatatggaaataatggaggccattatttagtttaacacagtcattaaaaaaaaagaaattggggcatttaaccttctagaaactgaactgaaatttctccataatcaatagaaaactttctattttctcaacac

SEQ ID NO: 7861 - DNA, 1048 bp, Homo sapiens
gaggcaaaggttgcagtgagccaagatcgcgccacttcactgcagcctgggcgacagagtgagactccatctcaaaaaataaataaataaaataaatatgtataaaacatatattaaatattccagttacaaaaataacaattaccaaaaactccaacaaataatatctgtgcctaatatacaatgtggcaatgttcattatgaagttttaatacagagaactttttttcagaatttttaagagaataaatttttcttttaagaatacctaagccttatgaacatctgatgttcaaatacccagcaatggctggtcatcttttgcttgcctaaactccatctgaacaacggcaaagctctgctgaaccaaccaacataaggaattgcacatccccacatttctttccatctttttcttttctgtcagactttcactcttttgctgatagtaagtacccttaatctattaaaagaaatacaaaaatcacttctgacttgcctattctctttcattatatgcatatttacatcaccactgtatgacaaattatttcacctcatagaccctgttttctgatctgtaaaagtggttaatggtacttacctaaaaggttgtaaaatgtttttaaataaagtatgtaaagctttcagtgcaatgccttgtatttggcaagtgcattgtaaatgggagtattatctacatcaacatcttcatcaagattacaatactgctctgactcattcctgattaaggtcatgcattacttaacaaggatatagtctgaaaaattcatcatgaggtgattccatcgttgtgcaaacatcatacagtgcacttacacaaacatagatggtatagtctacaacacatctaggctatatatggcattgtctattgttcctaggctgcaaacctggcagcctattattgtactgaatactgtaagcagttgtaacataatggtcaatatttgtgtacctaaatgtagaaaaggtacagtaaaagtaaactatagaagatataaagtggtacacttaggccaggcac

SEQ ID NO: 7862 - DNA, 1029 bp, Homo sapiens
agacataggagccaacttaaaggagctactaatgcccaaatctagacaatttgaacaacatgatcaactgtgtgaaaggcaagtacagaagtgtatctagaatatattactcttcatggcgttgttttacagttaacttttttttaataagtagaaggagtacactctagaataatgataaaaagtatagtatagtaaatacataaactagtaacatagtcacttattattatgtactgtacataattgtatgtgctatacttttacatagctgacagtgcagtaggtttgtctgcatcgcatcactataatcctgtgagcaatacgctgtgttaccaggttatgaaagctaccatgtcactacatgataggaaattttcagttcaattataatcttatgggaccacccactatcatatatgtggcctgccattgacctaaatgtaattatgaggtgcatgactgtatataaatatacatatgttggacattctgataggaaaatgcctgaatatataagaaacaatgcttttacctctgaaaatctgaataagggaggctagagagatagaaagacttttactcttcatataataatctttttaaaaaataataaacttttaaaaatactgtcaatattatcctaggaagcatagttttatttctgttttcattaattaatttggacccagcattgatgaagtaaagtttaacttttattttagtttttctctattgttgaatgaacactctttctcccagtttccaattatgttatctacattgagtcactgcttgactccatttccatatttgtagtgttagtccctggtaagacaataaacttccttataagcaaatttagaagcaattatttaattcaagcttgcacaattttctcgagtccagcacgagttgttgccacatctaacaatagcaaagtaaaggttgcaatgcttactagtgatgatttcttgaggaagaaaaataagtcttacttaacaatagaaaccttttttgtcttgctgc

SEQ ID NO: 7863 - DNA, 1050 bp, Homo sapiens
cgattaaaggcaaccctccagaacaggcgaaaatgctatgtgtgtcctagcctataatttgtgtgataacatcagggttgttttgatcttatactagggacagtaaataaagtagaaaccagaagttattcatgggactgggtctaatcagaagtcaacatggtggattagcatccaaaatggggtggtttttgtctccacaaccttaacaaggctgttgaaaaagtgatccgtaaatatacatataatcacttttcaaagtcaagaaacaatagatgctggcgaggctgtggagaaaaaggaatgcttttacactgttggtgggaatgtaaattagtacaagcattgtggaagacagtgtggtgattcctcaaggatctagaaccagaaataccatttgacccagcaatcccattactgtgtatataccaaaaggaatataaatcattctattataaagatacatgcatgtgtatgtttactgcagcactattcacaggaggaaggacatggaatcaacccaaatgtccatcaatggtagactggataaagaaaatgtggtacatatacaccatggaatattatgcaaccataaaaaggaatgagatcatgtcctttgcagggacacagatgaagctggaagccatcatcctcagcaaactaacacaggaacagaaaaccaagcacctcatgtttctcactcataagtgtgagctgaacattgagaacacatggacacagggagggaaataacacacactcgggcctgtcagcgggttgggaagagggagagcatcaggataaatagctaatgcatgcagggcttgatacctaggtgacgggttagtaggtgcagcaaaccaccgtggcacacatttacctacgtaataaacctgcatgtcctgcacatgtaccccagaacttaaaatacaattttttaaaaagaaaaatacatatatatacctgtaaagtgcaagttcataactagaaaaatgcagattaaaaaaatgctaagctattatttctcacctatcagatgggtaaaaatta

SEQ ID NO: 7864 - DNA, 1098 bp, Homo sapiens
ttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattataagtaaaactgcctttgctatatagtatgcatagaatattttaaagttattactagaagctgacacattgttgttttctattacaaacaataaaattagtttccatttattgagggcctgtttcatgttaactgctttacaaatattccttatctcatttaattctcccaacaatcctacaagaaagctaatattatcccattttatagatgaggaaattgaggcttacagagggcaagtaacttgcccaaagtcactcagtaccagcaaacggacttttccccctctccctgcccccaaataccagccccccactgcaaaaaaacaaaaacaaaaacaaaacaaaactacttctgtagagctagttgtctatttccaaatgcaaggcttaaattttaagccttggagttttcaatttaaagcctttgccatgaaatacagcatattactttataatagaaaacaaatagaaagagcctttcatgatagatacagtgaacactaaattctttcttttaggctgcatctaacaattctctccttaacccaatagatactatttcaacaaattagcccagttttgatttggatggcaagactcaaagacaacaacaacaataaaatcacaacttgatttaaaagttaaattcaataaactgtagaagcagcatattagtctgttcttacactgctaatgaagacatacctgagactaggtaatgtataaaggaaagaggtttaattgactcacagttccacatggctggggaggcctcacaatcatggtggaaggctaaaggcacgtcttacatggtggcaggcaagacgtcctgtgtaggggaactcccctttataaaaccatcagaacttgtaagacttattcactatcataagaacagcatggaaagaacacaccctcatgat

SEQ ID NO: 7865 - DNA, 1010 bp, Homo sapiens
caccagagagatgtaggtcagcaattcctcagtgcaatcaccccaggatgaagggtctgtgctgtgggctcaagccaggggttctctctggtgatgagtgggggttgggggtgtgggaaccatgggagacagactggcctcctcttcttgggttgattgcagcttgttggaggtataaataaggtacttagggtcttttcttcttcattagtctgagggtagcaagggcagttctactgcagagacagtggcagagaggctttcaggaacagtatttattaaccaattgtttcaacaaatatttattgacaattcaacatgtaccagacactgtgttaggcaaggggtcttcaatgggccacaaatagatgtggtccttgaccatgtcattggagcttaatgggagagactgatagtaagcaagtaaacaacaacaaaaaaataaggtaattcaggttgtgacaacctctctgaaggaaatatataggatgctataaaagtgactagagcaaggaacggcctaattgagctaagataatcaggtagggtctctgtaaggagttgacattaagctaacaactaaagaataagaagccagccatgtaaatagcttggataagagctttccaggctgaagggaatggaaatacacaggcctagaggtaagaaggagatgggtgtcttccggaaactgataaaaagtcagagtggctcagatatgctgatatgtcccctggtattttttaaaatttttggccgggtacagtggctcatgcctgtaatcccagcactttgggaggccgaggtgggcggatcacgaggtcaggagttcaagaccagcctgactaacataatgaaaccccatctctactaaaaatacaaaaattagctgggtgtggtggcacgtgcctgtaatctcagctactcagaaggctgaggcaggagaatctcttgaacttgggaggcggaggttacagtgagttgcgatcgcgccactgcactccagcctg

SEQ ID NO: 7866 - DNA, 1064 bp, Homo sapiens
gaatgactatcaagtggtatctggaaaattttatagaaacctagtatttttatagatgtttttgaaaagaaatactggttattgggtttacttcactcaagaaatccttttgcttaataggggtatataattaatactagttaagtgttggttattgtattgtataagtgttggttattgtattttcacagtgctataaagaactacttgagaatgggtaatttataaagaaaaagaggtttaattgactcacagttctgcagggctggggaaacttacaatcatggcagaaggtgaaggagaagcaagacacatcttacatggtggcaagagagagtaaaagagcaaggggggaattgccacaccttaaaaatatcagatcttttgagaacttactcactatcatgagaacagcaagagagaaatccaccgccatgatccaatcacctccccccatgcctttcctctaacatgtggggattacaatttgaaatgagatttgggtggggacacagagccaaacgatatcagttgtgtagattgaatattgaaatattgaaatcttgagtcatataatgaatactgaaatatatgtaattctcaaattatcaacacttagctggcaaaggttcttatatgtgaatggctcattaagctttggatttcctttccactgtgttgctgctctggatgacaacattgctgtccatacagacagcaccacctattggccagcacccagggcccgctctgagtgatttccttaccacctttcctttttctcaaggtcctcatggccctgcagtgcttgagtacttgtctttgactgctgggaatcagtttgtttggctgaagactgtcacacttatccacacattctttaaaatccctttcttcttcttacacttctcttccaaagcttgcctggttaccttagttgaatctcactctctctctctttctctcttctgtccttccgtccctcttcccttcctttttcttccttccttcctccctcccttcctccctcccttccttccttccttccttccttccttccttcc

SEQ ID NO: 7867 - DNA, 1033 bp, Homo sapiens
acttcaaaattctccagttttgcacgcccatgtttattgcagcactattcacaatagccaagatttggaagcaacctaggagtccatcaacagataaatggacaaaggaaaggttgtaaatacacagtggagtactattcagccataaaaaagaatgagatcctatcatttgcaacaacatggatggaactggagatgattatgttaagtgaactaaaccagacacagaaagacaaacgtcgcatgttctcacttatctgtgggagctaaaaattaaaacaattgaactcatagagatagagagttagaaggatggttaccagaggctaggaagagtaggagaagagtcgggggtacgtgggtgtggttgatgagtacaaacaatagttagaaaggatgaataagatatagtatttgctagcacaacagagtgactatagtcaaaaataattttattgtacatttttaaataattaaaagagtatacttgggttgtttgtaacacaaaaaataaatgcttgaggtgatggataccccttttaccctgatgagattattatgcattacatgcctgtatcaaaatattacatgtaccccataaatatatacatctactatgtacccacaaaaattaaaaattaaaaaattaatctccagctttggagtcaaaagctaaagccatttttttacattttaagatttgggggatgaaaaatacagcattatgcttttaacagccctttacagctttaccattttttaacctttgtctcagccttcttgtgtttaagtataagtgttctctttatggaaacccaaagcttcccttatttaaatttcaaggatgttgaaacattgtaatgtttcattacaattaatgaaacattacattaaaatgtagagtctacatcatgtacctgttttctttttttttcttttttttttttttttgagacagtgtctcactctgtcgcccaggctggagtgcagtggcgccatctcggctcactgcaagctccttcctcctcctggg

SEQ ID NO: 7868 - DNA, 1092 bp, Homo sapiens
tctaggactcagacgcacccttatgaggatactacgtgacccattacaaggcacaaagtaattaccataggcaaaccactgatgagagctcactccagtttggaatatattcacgtttccatataagagaaaaattcgtccctggttcagttcatcttggcatcagtacacgggtgggattcagagacatgtaggtgtggaataccagattccaccaaacttaaaaagctggcatactaagttgataaaacgatgtagagtgtgaagttgagttgagaatgcttatgccatacagtttatgtatcttataatagccttaatcacacttccagtaattttccccatcattgggtgctaaaaaataaaattaaagaattagaataaaaaatatatatacctctttgagtggaagaatgctgtcagcacattttgttattttattccattgtataaagtctccgtagtgctctcttcataaatgtattgaaggtttggctaaattgtatcaaatttgtgattaaatacaaatgtgaatagtataaaacattacaaagggcaatctgaatactatgctataccaattttacaattttacagtgacttacagatgccataaatatttactttaagggagtaaaataagttataaagtcatatttaagaacacctaaatccttgaataaatttaaaatggtattattatttacgtatgaagtcagctgactattgaaagcttatttttcaataacagaaatatatgcattatctaaaacacatattccaatattttcaagaaacaaaatactgaattaaattatctgtatttaaatgtttattttgcttataaaggtccatgaaaatgcttaaaattggtttatttgatctaaaaagttaatatgcaatttttatttttaatgtatcatttttcccatgtattgttttctaaataacactttcatcctaagtagatcactgaagaaacaaaatgctgttttctttatgaactcgtaatacatttcactaataattaggatgctgttcaaggtgttgaagtgtacaatataacaaattgcatttgcagttgaatagtag

SEQ ID NO: 7869 - DNA, 1074 bp, Homo sapiens
aggtctatactgaacacattataattagtttgtccaaagtcaaatacaaagaaaaaaaattgaaagcagcaggagaaaactgacttgtcacataaaagagaacctccaaaagactatcacgagatttctcagtggaaaccctgcagaccaggagagaatgaaatgatatattcaaagtactgaaagaaaaaaaaaaaaaacccacctgtcaatcaggaattctgtacccagcaatgtgtcttttattagtgaaggagagataaaaactatcccagacaaacatatactgagggagtttgtcaccactaggtccaccttgcaagaagtgctaaaggaagttctcgaggttgaaataaaaagaggttaaacagaaacacaaatgcacacaaaagtataagtttcactggtaaaagtaattataaagacaagtagagttttcctttccccaagatggctgtctagagacattggacaccagttctcctcagaacaaagaaccaaaattgcagttgaataatcatggtctgagtggaatactgaggaatgagtgacatgacctattggggaacccacaggaaaaagctgtggtgctgaaaaagaagacagcaagagttttgcagagattgacttccaaggaacatagagtcccatggagagggtaggaggggaagttgctcccctcactcctgtggcagactatggactgctgaacttgttggagaaaccctctgcacctgtgagcccaggcattgctgtcagtggcaatttgggaacttctttagggcagagcattgggtggccagctcatgcaggcacactcgctctcccccaaaacctgagttgaagtggcaggtgtcatactggttatgcacccattgtgggtctgttcttcccaaggaatcccagcccttgtgtttctgcatcactagatcctccatgaacattccccagaacccacttagactgcagcaaccacaggggacgggtgggaccctggggagctatggaattcctagaagtctagctcttaggagaagggagagtgtctgtgccaacgtactcctttggataaaa

SEQ ID NO: 7870 - DNA, 1028 bp, Homo sapiens
ggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaagagagctttgttgtgttttagcttaccctggccccatcccccactccccagcatggcagcagcatcaaaaacaatatccctcattccctgtataggttcctgtcactggaggtagcagattagaccttattttcaagaagtatgttgattttgatttgatttgttgctccctgaaggactggttcaaatgcctttcttttattttgcctaatttggagctctcctaaagtgaagatggcagcctggaaagacgtttcaaggtcagtgtattagtggctcatgcctaggggaaggaataacatttggagcaaacaggagacaaattgaaaagcttcaggaggaaaggctaggaaataagattc

SEQ ID NO: 7871 - DNA, 1018 bp, Homo sapiens
ctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctgacaaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaagaagccacatgccttgccctcaagttgcttagggtggaaggaaatgattagaaatgagccaagccgagcctgcactcttagagtaagtgtagtggcctcagacagaggagagatccctgggacctgggcagtctgagccttccactggacagtcatgtgtgaggagattgcatttcctgagcaggacactgtgttgcgttacattggtaaccccaatttaaggcagcataaatgcactgggaaaacagcaatattggttagccctgggaagtggtttttaggatgattataatttttttttgtgggtattcatttgatgtggatagctggggtg

SEQ ID NO: 7872 - DNA, 1144 bp, Homo sapiens
tcctctggtctggtccttttgctggtcctccttttccggaggaggaaactgaggctcaaaaaggttgagcactgttcccaactgaaagctagaagcagagcccggacaagggcctatactcctggctcggtcttctgtgcccagtcagcacttgcctctgccctggtctcagacctgctgctcctgcagggtctgccttattcagtgtctctctggctggtaacatccattcccattctgggagtcagggctggacacgcctggggctcagggctctggcttttgctccagcgagagttttgcatgccacttttagcggggcaaaaattgtctcatgctctgccttctcagtccagagctgctttggcctcatcttgacctgtgggatctcagcccctgattgctgctttctgctctttttcagggctgctacctgaggcctagcaggcactttagaggccatctagttcagaggttgcaaattggcaaatactttaggctcaaaccttcagaagtttaccaggctctcctgggtgacctgggcctggggtctgggtgtggcctgtgccacatgtgcgtcttcctctctctccaggagctgtatgcggccggggagaaccgcctgggaacagacgagtccaagttcaatgcggttctgtgctcccggagccgggcccacctggtagcaggtaaggcaggctggggtccctcagaggccagttagatgagggcagtcaggggattgtggggaaacaaagctatgggaacacttggtcgttcctccctgcgtggggctttcgcctcctcaaaagagccccctggtgggaatttaaaagacactgtcagagggtttcctgagttctggcaaacatccagttctggaggttctaccggtgtagaaacctggtgtctttgtacgtgggaatgtggaacgtcagagttgggagggtccttcgggagcacccaatccagtgttttccaaagcctggcataagaaacagtcataacaataaaactgggtgccattcatttactcattcattcaacagatgtaaatcgcgctcccgcatgggtcagtctgtcaggtggtggagcaggtgtggggccacggtggggggcagggcactgcagagtgtgttccatg

SEQ ID NO: 7873 - DNA, 1093 bp, Homo sapiens
tgggcagcagcagccagtgccgagctacccaggatacccggggtctgggactgtcacccccgctgtgcccccaacccaggtgagtgtcagcccactgcctcccttggtccaggcctgggccccaaaggctggagacacatggctcagtagatggggagacagggaaaggcgcaggcctccagctgcacttcttgttttaacaaatagtgtcggccgggtgcagtgactcatgcctgtaatcccagcactttgggaagctgaggtgggcagatcgcttgagcccaggagttcaagaccaacctgggcgaaatggtgaaaccctatctctactaaaaatagaaaaaaaattagctgggcatggtggtgcatacctgtaggcccagctactcgggaggctgaggtgggaggatcacctcagcccaggagacagaggttgcagtgagccgggatcatgccgctgcactcactccagcctaggtgacagagtaagacccagtttttaaaacaaaaacaaaaacaaaaaaagacaaacaaagagcgtcaccttcttgcagactccccacctctgggttgtgttgcttaaggcccaagggagctgtcctgtttctcctggtgtgatgagacgctccacatccgagttgggtcagaacacccctggcgagtactccttattcctctgtgtcatttactgcctgggctgtgtgttttgtaagaactgcccaggccacctgtctcaaggctttgtgctcaacagctgtcttcggtcccttgatatgcaccacccccgccccccccggcacagacaggttttggaggattattaaaattccctttgggtagggagaatgttggcagttcctccagggttgatcttggctcattttggagaacagttcgtgtttgcagagcctagaattcgttgtcatggttctgtggcccaaccagccagcacaggggtagtggtatgtgctcaatgactatttttagacagagggtctcctttcctccttcccttccatacccacacgttcccccaccctgtgccatcctccagcctccctcccttatcttttccctgagctgccctcttaat

SEQ ID NO: 7874 - DNA, 1027 bp, Homo sapiens
catttattttctcccattctatggcttgtttttccttcctttcattttattttatttatttattttttatttttttgagacagggtttcacttccatcgcccaggctggagtgcaatggcgtgatctgggctcactgcaacctccacctcccaggctcaaatgattctcctgcctcagcctcctgagtagagtagctgggaccacagtcgcatgccatggtgctcggctaatttttttgtattttatttttgtaacgacagggtctcattatgttgcccaggctggtgtcaaacttctgagctcaaatgatctgcctgcgtcagcctcccaaagtgctgggattataggcatgggccactgtgcctggcctcatcttgtcattttaaagaatatatcagcagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtaagagagagcatgttatacttttgtaacaaacacactggtggtaaggagcccacttcctccataacacattaatccattcgtgagggtagagcctcttaaaagtaccgcctctcagaactgttgtattgaccattaagtttgcagcacatgaactttgggggatacatttaaacaatagcaatgatatatttaaattttatggatacaaccttatggggaaagtattttaaaaaataaattgtgtgtgtgtgtgtaaaaacaggttaaggatctaatgttaaaaaaaaaaaaaactaatatacaaatcaatattccagccaccagactggggaaggccagtggaaaatcactccatgaaagcatccactgtagtcccggtctgcttggtttgctgttaggccctgaggggcagggggtgtcactgct

SEQ ID NO: 7875 - DNA, 1026 bp, Homo sapiens
gattatatttttgtcctctatttctcatcattgtctgtttctttggttctcttctatctctgaggatattattgattatatttttgtcctctacttctcatcgttgtctgtttctttggttccttttcttctgttttggtctctccctttcttggtgtagactttctcagatgtcctgtgaccctttgctgtctatatgaagagggagaccataaaaatctgattagagtgcataggtgaaatgtacaggaggggcaggattttatcacatctcttcccccttcggtgtgtttcctggaaggcagttattccccaatattgcaaaattaatctctcctcagcgctggtcttcccactgtacctgctgttgcctcgggcaggaagcagcaacccaggcttgaactcccatgggctgcccccgtgatggaacaaaaagaatcatcctagagaactgggcctgagtccgccagcagctctgaggacaggaagcctctctacccaccctgccctggggacgatgagctctagcctgggagtgggggattcagcaccagccctcttagggtcttgctgtatcaccttggcatgccacaaccctctctctggttgtcagtgtgaccatttgtgaaatggggtgaggtggggtcggtgggagtgaactgagtcgtctctgaggtgctgagctggcctctggcatccggttgtgaggtcctggctgatggggtgtgatggccctgcctgtgcaaatccgactgggcaaatgctgactgggcatgcgtagcctggccacacggaagccactgagggcccaagtcccctggtgactcatgttgattggtaattcaagttagcacacctgtgccgagcctgttcccgacacatgggagaggcgagcacctggttcctccttgtgccgttggaaagggttttttttgtagtcttggtggtttaatatttcccttgttgaagaaagctggctgagttaggtagacatgttcacagagctcttatgcaaagagaacagag

SEQ ID NO: 7876 - DNA, 1058 bp, Homo sapiens
gagagttccaagaagagtgagcattgtggataggagatcagggtgggcttcctgaaagagatatggtatggtttggctgtgtccccacccaaatctcgaattccctcgtgttgtagaagagacttggtgggaggtaactgaatggggcaggtctttcctgtgctattctcgtgatagtgaataagtctcacaagatctgatgcttttataaagggaaatttccctgcacaaactctcttctcttgtctgctgccatgtgagacgtgcctttcaccttcagccatgattgtgaggcctccccagccacgtggaactgtgagtccattaaacctctttcttttgtaaattgcccagtcttggttatgtctttatcagcagtgtgaaaatggactaatacaaggtggaacttcatctggactcagggaaggccaggagacaggaggtcagaccagctagagggaccacctaagcagaggtgtcctgaaaagggaaagtgctgagctgggctgggctaaggacatgcattttttgtgcttctctccatcatgcatgtccctgaggtaccttctgttttcatgctgttcctcagtggcccagtgtgagtgactcttggctccagactgcttgacacagcttaggatgccagctgcagaagggtcagcccattcccaagtgaaggtgttttctcctccagagtgagctgcaggtccttgaacttccagttgcatgcggctgactggggacattgtcaccatctgaagagcagaccttgataagggatatttggaaaggtttcctgaggcttctaggtagagcaggggtgctcagccatttggagctggaatatacactctgttaagtctcccaggcttgaaggggctgggcttccagagtggtttgaacaggccccgaggactggctgatgggcatcagggcctttccgggagaggctgggggacacactgctgccatcacactcttcagtcttcttcgcctctcttcctcagcctgtggtgagagacgggtctgtgccggccattcataaggagatgagatgg

SEQ ID NO: 7877 - DNA, 1098 bp, Homo sapiens
atttttactattaatatttccacctctgtttttctttgcatttatttggtatgtctttgcccaacccttagttttaaatatttctttctcacttaaaaaagtttatcttggctgggcgcggtagctcacgcctgtaatcccagcactttaggaggccgaggcgggcagatcacgaggtcaggagatagagaccatcctggctaacacggtgaaatcccgcctctactaaaaatataaaaaattatccaggcgtggtagcgggcgcctatagtcccagctactcgggaggctgaggcaggagaatggcatgaacccgggaggcggagcttgcagtggagccgagatcgtgccactgcactccagcctggacgacagatcaagacttggtctcaaaaaaaaaaaaaaaaaaagtttatcttgaagatggaatcttcgtaaataaaatttgtttctcttataatcagaacgtggttgagggtggatggaggttgacagaaggcaatgataacagcaacaaacctaattgcatggtttctgtctttggtagaggaattctgactgttgacataccagatatacttgattttattctttgcatcttgcttattacttattatacttgcatgcattcctttcctgatttttgctgttgggttaagtttctcatcgtcatcttccccacgccacctgtattacgtttcaggtttggttgtgaatgaagagaggagccccgtctctctctctctctctctctcactcactctctcactctttcttgaaaaatcagggtcgaggttaagtgtgtgttccatgagattgtcttggcaccaggctccttatggactgttgtccctagcattctcaagggctgtggttttcaaacttgagcatgtataagaacaatctggaaggcttgttaaagcatagattcttggactgcaccctgaatcattctaatttaggaggtctgtgatgggacctgagcacgttaattgcttacaggctcccatattgtataatgccgccgggccacatgttgggtagcaccgtctaggtgcctcccttaactgcatggcccaagacagctcactttcacat

SEQ ID NO: 7878 - DNA, 1052 bp, Homo sapiens
tctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaagga

SEQ ID NO: 7879 - DNA, 1032 bp, Homo sapiens
agtttacaggctctctggattatttaattgacacaaatcacctaaccgttctgagcctcaagtctctccaccagcaaaattgaggataaaaatttctgttctgtttaactcacaaagtgttggtgacactcaaatgagatattatgtgtgacaatactttgttgaatgtaaacaagttcacctactgtatgggaggcagcattttagatgatgtgggaatacagagaggaataaaccagcccaggcttttaagatgagcataaaggcaaatgcatgagaaactgttattattgatgcattaacaaatgaccccaacatttaacagcttaagagagcaataattttattatattattttatataatattcatcatgttttattttattatatatcatagattctgcaggattggatgggtgactttaactgaggtcacttagctgtactcaggagggttcaagagggcttcacttgcatgcctggtaccttggtgggagttactgaaagactgagatcatctggaactatcttccaggacatctacatgtagcctcttcagcatgctgatctcaagctgttgaatctcttatatggtggctggcttgccccagtgcaacggtcataagtggaaattgaaggccatttagaatgtagactcagaagtcacaaaatgtcacctccacaacaattagaaattacaaataaaaccaatcaatattgaagggagaggggtgaggttaggctttgtatgtaaatgtggaagcgacaaggtcactttctagaagagcataggatgatgttattgctagacttggaacatgcaacctgctatcctgcttctgatggctataatggttcacacccctctcgaatggaaaaaatactctcaactccctctctaaaggaccccaaagactcgtaccatttaggccattgacccaaagtctaggatcttatcatctaagtcaggttgaggtacagatgaagctctttgagtacagattcttggatacatctccccaagtatggtt

SEQ ID NO: 7880 - DNA, 1035 bp, Homo sapiens
aacaatactctgtcctcatgcagcttatattccagtgaggggagatagacaagaaatctataaaagtttagaaactaaataataaaataagttggatcattttatatagttatgaatactattgaaaactacaataggaatacaggacagagaaggacttagtaggggagtctacttaggatgataaggaatccctttagggaaaatgataactgactaatgcaagaagtctattaagagtagttctagggtgaaaatgtttccagaaggagagcatgtacaaaggctctaaactgggaatagttttggactgtctgaggaacagaaagtgggccagtgtggctgttttagattactaggaggaagtgataggatattattagctaggcagtggtcagatcgtatagaatgttgtaggttatgcttgggaatttggatcttattttaaatgggtgccaagggaacattttaaatgaaggagtagtataacatgatttatgtttctggaatgtcactctgtgtcctatgtaggggatgtattatggtcaggataggctagactgttatttttagaggcttaatgcaatagaggtttatttcttgttcacagaaagcctgatgtggccaggtgtttctctagggaatgtcttctccatgcagtgactcagggatccaggcaacatctatcctgttattctaccccatcaacttgtgaactatatggctgccactaaagaagagatggaaggataagcacacaggctcttaagtgctctgagccagaagcaagagaccccattgctaacattcccatttgttagaactcaggcacatggccccaaactcactggaatgaagctgagaaatttagaagaacatattgatatttgatgaatagtaactgcctgtcaccttgaggcccgagtaaaaatagggatatctgttacaaagcagtttcagtgatccaggtgataatggtggctgggatttgggaggtagtaatagatatggtgcagtttctggatagagttctga

SEQ ID NO: 7881 - DNA, 1934 bp, Homo sapiens
caaatataaagcaatacatgagtttccatgctaactttaggtaccaatgctgccattaccaccatgctgatacacagcaagagccctcttaagttgaaagagagcaggggaatatatatatacacacatatgtgtgtgtatatatatataatatacacacagatatacacatattaatacacatacatacacatatatatgtatatatagacacacacaaatatgtagtgaaagagagagattggggggagggagagagagagagagagagagaacttctgtttgcttgtttagttttgactttcattcacaatctgcctgcattacctcacactttagagtcctcaggtaattattttctgcatttttttccagaaattatagctccaactagcagaagggctgggctgtaatggattcctaccagcctagcggaattggaattccagttatgtcttttaagtaaattaagaggtttaaaaaataataaaatgctaatcattgctatctccaagagggcttttacagccactatacatcactgccattatcacaacatatatgtcacctttgtacatacaccctgatcatcattttttgaagcacatttccacaggttatcaagttccaggtttgtaattttctttattttaatactttatgtatgtaatcttattctcatgtcatagtaaggtttgattttttttctctttctcctttgtgtatctgttctaactatgatttttgtaattttgtgtgttttcatgatggtagttatcatcttttcacttccagatgtaggactcccttaatcatttcttttaacaccagtaaagttgtgaatcattcctgtagtttttgcttatctgggaaagactttatttctccctcctttctaaataacagttttgcctagttcttgactggcagtatgtttttctttcagcactttctataaattattccattcttttctggcctgtaagatttcttctgagaaacctactgttggtctaattggaattctcttatacctgacttgctgtttttctcttgctgcttttagaatgctctctttgtctttgattgatgattagctctaatgtacgtgggagaggatgtgtttgtgtttaatctatttggggtcctttgagctttctggacctggatgtccatctctctctttctagacttgggaagttttctgctattattttatcaaaaatgttttcctcacctcttcccttctcttcaccttctgattgctcataatgcaaatagttattcacttaatggttttccataaattctgtaggctttctttatttgttctttctctttttttgtctgcttttgttatttcaaaagatctgtcttgaagtttagaaattctttcttttgcttggtctcgtctgttgttgaagctcttgattgtattttttattccattcattaagtttttcaggtctagaatttttgtttggttctttttaaaaataatatctatctcttgtttaatttttaatgcagatactaagttggcttcctaatttaattgaatcgtttatttatattatcttgtatctcactggcattttgtatatttcctttgatttggggtctattactgcaaaattattgtgttactttggaggtgtcatgtttccttgctttctcaagtttgctgtgtccttacattgatatttatgcacctgagggaatagtagcctcttccaattttatagaataggtttcataggaaaagccttattcctatagatgggtttttatatgtcgattggctgggatgtactgactttggttcttggtacataaagtagtgcagtttcttcagatgtaatccatgttagtgatgtttgatagtgcctcagtggcctaggttgtgaggatttgtggtggtgatgacacagctt

SEQ ID NO: 7882 - DNA, 1030 bp, Homo sapiens
cagagcaggcaccagaatcctcatctcttgttaccaccgtcctcactgttacctcgtcactcaggccaccattcaccctaggcgtgtccggcgaccagagtggtctttctgaggcccagatctgatctccagcttcctgtacactgacccaacaaaggcgtccttctccctacagtcacctctgttgctagtcctccttagtaagtccctaagtctttgcagggctcaatccctgcttctctcttgatcctgctccctctgtattgtacccattgacacagtcgtcttgaactgctttcagttcctttaacccaaggatccgccagcggtggccaatagagcaaatccagtatattgcctcttttggaaaataatgttttattgcacatggcagcacccatatgtttatatattgtctatggctgctttcaagttataacagtagggttgagcagttgcaaaagagactactaagcccaaaatctttatgagctggtcctttacaaaaaactctggtggactgtgctgtacctggccctgtctcttgacaccttcatgcccttgcaaatgctgtgccctccctttatcctactaatccttcaacgctgagctttctgcttatccttccctccatcctcccttacctgagtaggtaacttacctgtgtgcacatctcaatcagctacagataagggttctccttgttgatgtacacatgcacatcccactctagttcctgaggcagggcaaggtcttattccattcaggactctagaagctggctgggtttttgaaagtacacctaaaagccgaggatcttggcatagatactgggcaccacagcttaatgttggcatcctgcattcctcctcctttctgtgggtttctccaaagctctctagaaatgcacctgtggaaagggtttcactgcctctgtctttgcagatctccaacctctatctgtatgacagtgttctgatgctggccaacgcctttcacaggaagctggaggaccggaagtggcatagca

SEQ ID NO: 7883 - DNA, 1029 bp, Homo sapiens
acgtcctcaccagacacagaatctgtaggcaccttgatcttgtacttgccaggcttcagaacggtgagaagttaaatttttgttgcttataagccacccagtctgtgtttttttgttacagtgacctgagtggactaaggcagccttcgcgtctcctcaggagcctcagagcccagagccggtgttgtacgcgatggggagttgggtggggcatttgcattgtagctgctcaagcaggattcagcctttgaagcccctccccgctggggaatgtgcagtgtttctgagcactgcttccctgcccccagtgctccattatctcctcatcttgcttgcttccctgccctccctccatttcctccctctgggtcttggttccttattttctcatgaagatcaatttaaagtctcactggtggcctttgctcctgctgccacaaggtattttcctaaataaaatatagtcactgatgtaatagaaattctggtaataactttttaaaaaatctatttttccatccctggtcctcagtcaacttcttgtgactcatctctaattatccagcagccgagagtgtccatctgggtctctcaagagctgcaagcccccaacaagagctcacggctgagttctctcctgcttcccagagacgcctcctacctttcccattatctttctgaggacccacctcctgcatgggcaactgatgttggaaatttataccttgccaggatcctgctatctcagggaaatgcatagcctgggattctggtgggagatggccaattctacatttattcacacagagctcccatctctttccccagcagcctctatccaccaccacttgtcttctaagaagaggcatcttttttgcaaatgccttgacatctctttaactttatgtttctaagaacatgtttaaaactgttattcaactttcagtaattgcataaatacccatttatgcatttgttatgcatttcttcttatgttagacctttcataaatgttccttcctaattctt

SEQ ID NO: 7884 - DNA, 1029 bp, Homo sapiens
gcagtgtgatggactggccctcaagtggactctgctcaggactcaaacatccagaggcagaaaggtgctgtctcttctaggtcttcttcttaggattcagaaaaccatctaaaaaatccagcatggagaacccccttatgtctcaacaaccagaagtggggccatggctgtctcttaaaactgggacaacccaggtggtctgggaccaggcaggacacagctctgggtctgggaccaggcaggacacagctctggttctgggtatcctggaggggagagccccctggggttgccctagcatggaggaagtgggcaagagtctcaggcaggcaccagatctgctggttagcttcctcttttcccccagggacagctactgtcctgaagctgggtgtgtcctcatctaagtttttattatattatactatacatgtatctttactataaatgtatttatttatcactctgtaacttattcctcttttcctttcttttctgctttccttaactctgtcatccacatctgtgcaggtgacgaagtaacactgcagatgtattcagtcatctttctagctgcatggtagtccatcatattaattcaattacttcttctattatttctttttctgttattacatcagaggcctgaatggatgtgaggaagaaatagctgaatctgacagttagtgaaactcttgtgtctccaaattatcccattggtattatcatcatttttattgttctcataattagcaaaaaggagcactttagaaaccattactagcctccatatcagtaattcatcacatttttgttttgattaaaggcttctttgaaaatccaatatagtctatgggctttctccacaggaaaatgcacatacacactttacactttttggaatggcaagtcctcctgaagccagccatataccctggctgaatatacatgttcctctgaacaggggaaatcacatcttatccccttccttagtgcacactataaaaaggacagttttgcttcgaatca

SEQ ID NO: 7885 - DNA, 1029 bp, Homo sapiens
ccattggccaatactcattggcgcctcctggcttcacttctccaagttgatcttattaaacagatcgtgcctgtgagcaggctccatttcatttttctgctgatattaacgtttccttataaattgtccacatgtagcatattctcactttttattatagtaaattgcactccctgcacagccctggaagctgcctctatttcatctgaaggatccacaaatgatctgtaatgaatcttcattcccccggggctgtgagcgggcgcttctgccatccacatgaacagggaaggcagttcagactggctgtcgagctcagacttggtcaacaagaaggactgaggccagggaggtctaatgatttactagaaattgttcacatctatcagaattttacatgaatttagtcaattattctttctttctttcttgtttttccatagcaacataatagtttttcagagatctgagccaatgtcaaaaaagtctaatgctgaacactctctcttccagtgaactctctttcagtaatatctttttaaatgtcattgaccaaactagtccagaacttactatgttgttaggcatgatatatgggaactagcatcaggaggttcaacgctcagtacaaatgaagaaacaattgtatcctggaggaaaagctctagaatttgatcatgtttccatcacctcctaaaggtcagggcatcttgcattcctccactttaagttcactttgtttctttctcagatcctctcagatgtgtagaaagggggtgttaattgcaaatacaggcagcactaactttgcatggcacaatgttaaccaaaaatcaagtgtataatgaagttcgtgcaaagtgaggacactagttccatatgcatgggttttgtttaccagagtaccatgcaccatgcaaagcaaaggccacctgtacattcatattctttttaactgtagtaaggtttctgtttatgctcctggccttccttctactcagctctggaaatgtgaatcacccattcatt

SEQ ID NO: 7886 - DNA, 1044 bp, Homo sapiens
atttaaagcaatccattggatgagttattatggaagcagtaactgggttttggttgggagaagcctagggtctataaaattcagataaatcattccatagatatatttccagagctgtaagtcacccagacatcgatagaaacggatgtttctccaatttctttttcagaagccacatcagtgtgtgcaccctggaatctgcatttattattcatcccaatagctttggagagggttgccagcagctctgggggtctgcatatgatatcactactctcagctcagcttcctaagagcagagctgaagctaagtgagatgggccctcctttgaagattcactacacatgggttagaaactcagctgcctctgtgggccagacagagaaggtaaataagagcagagtgttggaaaaaacaagagagtcttggggactgaaccaactggagaggcatgtcccatcaaaaggcattcacattcagttaagaaactactatgataattcctctgacagtttgctactacatctaagagttgtggcaggcagaacaatgccccctgcccacagctgtctctctctctctcttttttttttttttttttttttgagagggagtctcactgtgtcgcccaggctgcagtgcagtggtgcaatctctgctcactgcaacctccgcctcccaggttcaagcgattctcctgcttcagcctcccaagtagccaggattacaggtgtgcaccaccatgcccagctaattttttgtatttttagtagagatgggatttcaccatgttggccaggctggtctcgaactcctgacctcaggtgattctcccactttggcctcccaaagtgctgggattataggcatgaaccaccacactcagcctgtctctgtcttaactcttggaaccaatgaatatgttatgttacaggacgaaagaaaattaaggttgcagatggaattactgttgctaatcagctgaccttaaacagggaacttatttgggttatccaggtgggcgcaatggaatcacaagtgac

SEQ ID NO: 7887 - DNA, 1041 bp, Homo sapiens
tcatctgcaaatatagatagttttacttcttcctccctatttccttctagatgttttaaaatttccttttcttgcctgatttgcatgactagaatctccagtacaatattgagtagaagttgcaaaagtggatatccttgtcttgttccttgtcttaggggaaaaacattgagtctttcatcattcagtatgatgttagctgcagatgtttcatagatgtcctttatcaggttgaaggagttttcttctattcctaattcgttgagtgttgttgttgtttttaatcatgaaaagctttgaattttgtcaaatgctttttctgcatctgtaaagataatcatatgttttttgtcctttattctgttaactatggcatattacattgattggttttcagatgttaaacaaatcctgcattcctaggataaatctcacttgacggtcatgtataattcttgttatatgctgctggatttattttgctagcattttgttgaaattttttgtgccgatattcataaaggttactggtctgtagtcctcttttcttgtggtgtctttgtctgattttagtatcagggtaacagtagcctcttagaatgagtttggaagtgttccctcctattctattttttggaagagtttgtgaaggcatggcattaaatcttctttaaatatttgaaagaattcgccagtgaagacatctgggctttgactttactttgtgggaagttttaaaattaccaattcaatttcttaacttgttataggtatattcaggaattctgtttctttttgagagagtttcagcagtttgtgtctttctagaaatatatctagttcgcttatttagtttgttgtcacacagctatttatttttatttttttaaggtcagtagtgaaatcccctcttttatttctgattctagtaatttgaatcttctataatttttaattgataaatctagttaaattttatcaattttgtcagtcttgaaaaaaatcaactctttgcttattgattttctctattatttttct

SEQ ID NO: 7888 - DNA, 1046 bp, Homo sapiens
atgactaatatatgttgccagtttgtagctgggctgggattcaaatccacataatctgacttcagaacccatgctctttggctctttaccatatttcattgaaagaaataagagatgaataatcaaggagacttaatatattccctgctgtagtcttttggttaaatacttaaaaagtctattctcaatttataattgtagcctaatcctcatcaaaatttccattcagtgtcttattagatttttacaaaatgattagaaaataaaactggaaaggaaaagctactttatatagaaatagttagaaaatagcaaataatgaagggggccagtattaacagattttagaacatagaagcccatgttaattaaatctgagaaacactggtacaaacagagacttccagcaacgaaagacaaatctgaaagagttccttatacataaaataagagaagataaaggaggaatcaaataccatggagaaaagaaggatttgtaatgaaggatgttggaagaatgtattagttatttggaaaaaaataactacaaatagcaaaaagtaggctacatgatttttcaggtaacactctaaattttaaagtggtaaaaatatttaaaaagtaaatagatccaatgtacaaaaagtaaaaacttctttataaagacaaaaaataaagaaaaaaaagtgaagggaaaattatttgttacaaatatacaaaatgggaatatttaccttgcctcattcaaattaataggcaaattcaaacctggttaacactggacaaaaggtatgaatgaacaagtgacatcggaatgaataaggttcagttcacctgaaaagtcacgtggtgccaccttgctctgtgcctggccctatgttaaataccaagacttcaaaacaaacatagcaaaatgaacatcttcaggaataaccagtgaatttcaaaataaaatgaaatccatgcaatcatcttatatctattatatctattatagatgattaaaagtagtaatgctatcaaggttgtgataaaactggtgactt

SEQ ID NO: 7889 - DNA, 1032 bp, Homo sapiens
caagcactcttcctgcctcagcttcccaaagcaccagaattacaaacgtgagccactgtgcctggcctctttctagttctttctagcttattctagctcttaccatttgttccccccccacctctcctcatcctcactgccagctctgtcccctctgttatcattccctgaacactctggctcactctttcctcccacctccaatctggctcatgcccagtgacctcctagtgagacctccaaccccacatgttttcacaaaacccttatcttcatgtcttcttagtgaggcttcaagatactgacccataataatctctcccttgcctactcaattttcctgttcccttttctttgtgatattcaccaggcaaaactcccacatgagctaagcctgaccatcctcttttgcatacctgtgcctgagtgctgagtgttgctgtagaaaatgacaaagccagggtgctggtcttccttggtattgctcctcacaaatctccatggcttgcactgtacttccctaaaccccttttccatgctttgtcttctcctttcaacccctcctcctcctccctccttatttagccatcagatgggagccccctcatctcccatctccaaagtcaagcccacctgcacttgcaccagctggctcattgccccatcttgtcacacccagggaagtaagtgttcttgcaacagccacttgccccctgccctgaatccatcccaatttcccctctaggattttgccttttcttttccacatttctcttctgcattactgatctcttcctatccactcctgcattgctgctctgcctagaaacttgttttagaacatttaatctaagaaagcaaccctcctcccacattttccacatcccctttcagtgattgctctgtttctcctgattttgttttctctccttttgtctgattttccacccgccacaatttgtctactgatttcaccctccttctcctgaaatgacctttgtcagggctaaccatcttcctattttccaattt

SEQ ID NO: 7890 - DNA, 1104 bp, Homo sapiens
taagagatggtgctcttaccatcctggctaacacggtgaaaccccgtctctactaaaaatacaaaaaattagccaggcgtggtggtgggcacctgtagtcccagatacttgggaggctgaggcaggagaatggcaagaacccaggaggcagagcttgcagtgaactgagatcgcgccactgcactccagcctgggcaacagagcgagactctgtttcaaaaaaaaaaaaaaaaaagatggtgctctttggggtcagtctgactatttaactcagcctcttgtttacttcctaccactcttctgagactttggtccctggataactgtcttcctcaccagcccaagtccagacataatgctcggtaacttccctgtctatgtggcaacccctcaacacatttccttgacctcctgatttccagtgacccactcctccactgtccctcagcttcctacttccacagccccatcatggtccttagcatcatctgaaatgactccagctcctgctttctggccacatctgtaataatatctgtaataatttcccctgcctcaccttctgtactgtcaggttcagattgcaacgatgaagtccgctcccactaacttaatcagctaaaatgacggattgttaagacactaggcaggtcacagagtcaatgggaagtccagagaacaagattaagaaaatgagcagcaaccaagggagtctgggccccagagcagttggatcccctcagccacagtagggctgagcagtagggctgttgctgaacgtggctgccacttccactcgccctgccacttcctccacagctggacattggcttgcactagcatggtgtcaatattctcttagagtgcttgcatttttgtatcagttttcatcatatttagaaagttgggtaagattatcctgtttccaccttttgccatagctgccagagcattgggagagaaaatatctaaccccattaagcatctttggtaggaggaatgagctttctaagaagactaaagctgtggttgagtttctaaccaactgaaagggagtttggtggctggaaagccaaaggaaagccaaatgttcacgacattatt

SEQ ID NO: 7891 - DNA, 1048 bp, Homo sapiens
ccctcacattggaacaagtttgctcataagtggatgtgcactgtctcaccttggccagggcactgccagccctctgaggggagtgtgcagaatgctaaacgtgcttgttgacattacacctgagacatgtttgtgttataaatgggtacaaattgaatttggcttaggtgatatatgacgtctgtcatggttttccccatggtaagtcagttagaggagagctaatttatttcagattgggcattccaagctttcattgtgcctagcatggccatatttccctctgcaatcactaggatgaagctggcaatgtaccagggctgccagtgagctggctgctgccatcagtgtgctcctcgaaccaccctggccctgggtatacatgctgaggatgcctcgtggccttggccaaatagatttttgccttcttttggcccatgaagacctggcttggagccagacctctgtttgaatcctgacctgccactattagctatcacactagctgtgtggctcaaagcaagtcacacaccttctctgaacctcagcttcttaatctgtgaaagacagagatgccaacttccacccagtggagttctgggaggattaaatggacaatctgcaaagggcctagcatgcatgtgaattgcttttcctcaactgtgaattgagaacacagattccacctgtgttcctggctggccagggtgtggttggaatggaggggggtcatgggcaggaaaggggaaatgccccatgccccgaagccctccagtccccaggagccctctccctgatgggggcactatggacatcctgatgagagcaggtggctgaggcattatgcggtttgtagagaggttcccaggggagcaccaccataccaagggggcacatgcctgtgcagagcacagctggggtggagggggcagctgtgtgaggacaagcattgtcagcgctggggatgcgggtgtgcaggggtccataggcccttctgtggtgcagatgccaaactggtctggttgtgtttctgagtgggctttgaggc

SEQ ID NO: 7892 - DNA, 1147 bp, Homo sapiens
ttagaaaaaattttaagtatgtttggaacaacttgattatgtgactcttctaaagatacattttataaaatataaaatcagatcaagtatttctgatgaaaatttagcgtttagattaagatatgctgtaaatgtacaatacacactggtttagaagactgtatgaatgtaaagtgtcttattaatagtttttatattgattacatgttgaaatgataatattttagacatattgggctaagtaaaatgtggtattaatcggtttctttttacccttttatagtggatgctagacaattttaaattgaatatgcagcttgcattctacttcttttagatgcggctgctctagacagcccgggacccaggctgcagctcaccctcagctgactaagagctagtaagccctttgcagacacacctgagggtgaagctctccaaatcttctggggagggtctagcgtagcctgtggtctgagaagccgatggctccagggttcacttacagaatatactacgcaggtgaatgggaaaattttgcaggtttaaaccagacatcaacctgaatataaactatggacctggggtgaaaatgatgtgtcagtgtaggctcatcagttgtaacaaacatggtactgaggcatgggatggtaataatgtggagatcatgcatgtgtgggggctgaggggatatagaaatctttgtcttttctgtttagttttgctgtggacctaatactgcttttaaaaatgaagtccttttaaaaaacaaaaagcctcaagcagaagaaaagagtaagaaaaacaattaatgaaacaaacaaacaaaaaccctaaacagacatctcagggtgtcatcaatatctttttctgggggaaagaaatctgttcaattaatccctactcatcaggggcggtgtctgctgatcagatcagatcacagcattgttgagcacattatagtattataataaaaggctcagctggagggaggagacacctgttcgccaaggagtctctcctgagattcttaccaggaaacccagagaagcccagatagggagttaatgccttttaaaaatttgcttggcttccatttgggagattaaggccttaaatcacacctgcaattgcaagtggattcctc

SEQ ID NO: 7893 - DNA, 1674 bp, Homo sapiens
gcacttattatgtgcttgccacttgctagactctggggatggagtttaacacagtgtagttcatttcctgaccttgaaaaccctgctatcttgagcagtgtttctgtgtgggggcttggtaaaatatctgacatttctttagtggactattgaaaacagatgtaaaactggtattatataataatctgtaactcactttcttactattgagcacatgtaggtaatgtttattaagtctttcaatgatcatgttaaaagagcttcattttcattttctattggcatgcattaatcatcactaaaatttgaaatctcacatgctcatatcgcttggggataattcaccttgtaggtaaagatccagttatttaaagttctagaaaatgcaagtttttgtagatttgtgagattcagtgtaagggctgacatttgggaaacaaatggaggatgtgagaagaaactgtatttgttaaagtgttcaaaaatcctgtagttggattatttatgatgcattgtacagttccggagcggttttattgaattcaattgagctgtgaatttgccagagatcagattgaagctctggctggatgcagagccaaggtaggtcacctatagcctgcagcctgcccacctgtgccctttcctgctcctccaggccccagcctgccagtaatgagggcaaggatcaccaggctgccagcaacaggcccgcaggagagctgcaggctcaggcctgcaggatgcactcccaggggaggactgccttgggctccctggcttcctccaggtgcagctccatgcccctggctgtcaggaaggtctgccttatgtcagtctaattccatcgaggtatagagggagctcttttccagtgtcttgtccccagattcttgatagccttcttctgaggggtctggcaagatggaggacaagggctggtagagaggagagttccgggagaaagtccctggctggttgcctgtgatgaggggcttggggcttgggagaatgttccccagttggggatttcaggtatatctttgtgtgtacgaaggtatgtaactccactctctgatgtctaataaaatagacactttctttttttttggaaactcagtcttgctctgtcacccaggctggattgcagtggagtgattgatctcggctcgctgctgccttgacctcactggctcaagggatccttccacctcagcctcccgagtagctgggaatacaggcacacaccaccatgcccagctaatttttacttttttgtagagatggggtcttactatgttgccctggctgatcttgaactcctgggctcaagtgatgctattgccccagcctccgaaagcacgaggattgcaagtgtaagccactgtgcccaggctagaataaacatcttgatggcttctcagaaagttttttctctgtgttggcatcttgggctttctatgatgtttagaggtaaagatgaagatgctctgagtacagcttggccattcaagcaagggcagggccaccacctcctcctggcaagtcccctagttcctgtggagttctttggtgcatcctgtaggtcttgagtttgctgttagcctacagtttgggtgttacaataccccctgctatttccaggcccccatgctccagaagcttcttggacca

SEQ ID NO: 7894 - DNA, 1048 bp, Homo sapiens
tagctgctgagggtttgctcaacctttggccttccttggcttgtggcagcatcaccctgatctctggcttcttcttcccatggccttctccctgtgtctgtctcgcaatttctccttcttatgaggatgccagccatgttggattagggcttactctaatgacctcattttaatttgattatctctgtaaaaaccctatttccagataaggccaaattcgcaggtactggagttagaactctggcatatgaattttggaaggggacacaattcaactcatactgagtcaaactggcagggtgggacagtgacaaacgaggagccttccgcggggaccatggtgggtgagttgagctggactctcctcccaggcctctcactgtggggtgtcatgcttagtgaagcttgctcgttccttttgtgcatttggtcattcattcagctgcacagtgatactcagtggctcattcccacactgatttgctcattcacacattatgcacttcatttgttcattcattcagcaactacaataatattcaatgacttcctccttccctgtatcattcatacatcgacactcatcccatcattcattcatttgaacacttctcaagggcagatggagccctgtcctgcaccatctctgtgtaaaagctgaagccaaattttaataacacattcctttccatcagagtgctcttcagggctcagaaagtgggagcactgctgagttctatccaaggaaagggaatcattatatcaaagggttacttgacccctatgtttactgtggcactgttcacaatagcaaagatgtggaatcaacctaagtgtccatcagtggctgaatggataatgaaaatgtggtatactcagtggactattaatcagccataaaaagaatgaaattatgtcatttgcaaattatgtcaatttcatcatcaatgacaatgaaattatgtcattgcataaattaggtcattatcttaagtgaaataagacgggcacaaaaaggcaaatatcacatgttctcatttatatgtgg

SEQ ID NO: 7895 - DNA, 1053 bp, Homo sapiens
ttcacattaggattcactctttggtgctgtaaatgttatgggtttggacaaatgtgtaatgacataagttcaccattattagtagtatgcagaataatatcactgccctgaaaatgctctgtgctctgcctattcataggcaaccactgattcttttactctctctatagttttgccttttctagaatgtcatatggttggaatcatatagtatgtcgccttttcagattggcttctttcacttagcaatatgcatttaagtttcctccgtgccttgtcatggcttgatagctcatttatttttagtgctgaataatattccattgtctggatgtgccacagcttattcattcacttactgaaggacattttagttactttcacattttggcaattgtggacaaagctgctataaacacaatgactttgctttttaatttactgagaaaacgggaatgatgagggcagagctgatctgtgcattcactgccatgtctatcagcttccatcgtctgtggccatgagcctcctcttctgtctgatgttgagcagaaacaccgtgtgctccttctaaaggcaaccccttggatactagaaataattccctgtcacctacataagggtggaattcttgcattgtcagtttctccttttcaaatggatcatatcagtcagctctcaggcacactgtaatacccaccatctctgcacggccctctttgcatccattttcatccccagccccatttctctgctcctctttgagcaaaactcttcaaaatagttaaccttgtcttgaactcctgggccagcctgggcgacagaatgagaccatcacaaaataataataataataatgagatagttacctttacttgctgtttccactgcagctcttcccattctctcaggaacccctctgcagcagatgctggcagtgatcaccgcccatcctcctcctctcccttgtcagtgggctctgcagcatctgcctctctgtgtctggggctttttctggaaccttaaaggccatgttttgcttgcactcagagc

SEQ ID NO: 7896 - DNA, 1023 bp, Homo sapiens
ggtcttcttgatgagcccagccccaccagctcacccactggcctgagttcatcagtagttactgagcacctcctgtgtgtcagatgccctgaagctctgcagggtgtgggggtctggcagggggtaaaccaggcgaggccaccacacctatggaacttgcattttatgtgagagagggagaggcaaaaaagcaaaataatatcatgtggtgaagagttctgtaaggaattagaacagaaccatgtaatgagacatgactggggctactttcggctatgtgaccactctgacttttcagctaacatctgattgctggagtcaggcctgagaaggcctttgcttttgtaagggagacctttaccattgcaaaagtcccaagatggaattaaagctggcctgttagaggaacagagagagaatgcctgtgtggcttgagcttaatgaaaggaggggaggcagcagcatggtggggtcagagaggtgggtgagagaatgccacctggggttatgtgggctagacgaggagttggggttctattttaagtgtgatgggaagtcattggagggtttgtatagggcaatgacatgacccatttcctctttagtgaaccctctggctgatctgtgaagagtctttaagaaggcaagcatgaaagcagaacaaatatcattgcatgcatcagatgagtaagacccttaaagcctcactttaacaagtattggacaaatcggaggctaaaggtctagtctctggcaaaggctgggtcattgagggcttctgagtcttggtactttaaatacccaacttctaggggtgtcttctactcataaactttgtgtgcatcttttcccccctaattttgggtaatcctggccaatgcaaaacatgcatccctcagccaaagcccccaggctgtgagcatggccaggctcacagggagaagaatgctgcatgacaccatctcatcagcagtccctggagttgccttggttctcatgatgtatcgttagaaaacatatcag

SEQ ID NO: 7897 - DNA, 1048 bp, Homo sapiens
ttatgttttcttagtttttgtttgtttgtttgtttttgagacagggtctcactctgtcacccaggctggagtgcagtggcctgatctcagctcactgcaacctctgcctccaaggctcaagcaatcttcccatttcagcctcccaagtagctggaactacaggtacacaccaccatgcccggataatttttgtattttttgtagagacagggtttttccatgttgccaaggttgctcttgaactcctgagctcaagtgatccactgccttagcctctgaaagtgctgggattacagcatgagccactgtgcccggcctatattttcttagtttttactgaatgtccttttgttttgttttgtttgtcttaggatcctatccaggataccacattgcattagttgtcaggtctccttaggcacctcttggatgtgatagtttctcaggcttttcttggcttttgatgaccttgatgttttgagcagtgctggtcaagtattttgtagaattcccctcaactgggatttatctaatgtttttctcatgattagatttgggttatgggtttgggaaggaagaccatggaggtagtgccattctcatcacaccatgtcaagggtacttactattaacatgacttatcactgttggtgtagaccttgaccacctggctgaggcagtgtttgtcaaggtttctccactaaaaaatgaccctttgttcccccatgctgccctctttggaaagatctcactatttgcagcccacacttaaagagtggagaactacactccatctctcaagagtggagtatctacatccgttgtttggaattcttcagcatgggatattctttttttattttaatttttaaaatttttttgttttatttcaataggttcttgggggaacaggtggtgtttggttacatgaataaattctttagtggtgatttctgagattttggtgcacccatcacctgagcagtgtacattgtacccagtgtatagtcttttattccttgccagcccccaccctttcccccgagtc

SEQ ID NO: 7898 - DNA, 1031 bp, Homo sapiens
gtggaagggctgagagaggacgtgccccttttcagtgcatctttcctctttctttcagcagggaattcggagaagcagcaaaagcaacagcaataacaaaccccaaccacacaaaccttccgctcatcacctaatgagaatcaggcagggctgctaccaagcccagtgcagggcctcgcctccccagggctgcgatttgtttgcccttgtgccaataggtaaacaaatcagggatgccagtgtgtggacatgtgtgggtgtgggggtgggtgcagagtttgcatgtgttccacctttgtctgcctgtttccacactggcctttgaaactgtgtgatgcccctacctccaccataaaggactcactgacattgtgggagatagtgatatgggacatcccacaccacatcccattctttgttgctcccaactgcttcccctccactctcagcatcaccggtaggttccaggctatggccctctgccctctgttccctaggtttggattgtagctttgcctttaggacaaggtggtcttgagtaggtcccccttctcctcctgtgacccagtagactccaatcctccccaccgttcattccagatcccccggggcactggcagtgttggggcggagtagtcaggcctggcattgcacggaaccaaaatcatgacatgacttgattcaaaactcaagcagttgcctggttcatcctcaaagctgggcacctttcagagcctttgcaatgatgcttgggtcccttggttctgctgccatggctctgaagtcctgtgtccctggactctggacttgagcactgcccaggcctgcacggcagggcactaagctgcagaaagtggggcccaacagttccaactgggctccccccttgtctccacccctccctcatgtgtgctcacacgtcaggggtggccctcagggtcagtcccatcagaggtagcagctgtggtccaggcatactgggagacttcagaggccagttaaaaggtgaggaaaaaataaatttatctgtg

SEQ ID NO: 7899 - DNA, 1054 bp, Homo sapiens
gagaaaacatacactcaggaagaacagcgactactcagttggagactgccctgtgcctagcgaagcagggtgggaagggggccgcatagctgccccttctctctgccctataatgatcaaatgggaccatcccatccaggctaccacatgaactactcttggataattctgtaacttggagcttgttaagacaatcaaagggtcagagaagaatggctaaagccaccctttggcgtgacagccaggtcataaatccaaatgcctatggcatccaggcagggatattaaggcagacagcaggtgggctgtaagaactgagagtattgcagctgcaggcacctgggggaaacatccttctctgaagaggactgtcaggctctgccaagattcccctgagaaggcctggtgtggtcactatttcttgtgtctcaagaggagccagaaatttggacttcctgtgaaatctcttagtttttaaatgtttgtagctaattacaaaaattctgaactctttgttggccaactctgcctgtggcagggctgataaggcttgcaggctgccaagtggtaatgtctgatttattgcatatatactgtcaacttaagctcattaactatgagaatagtgtgaagcgagccctgttctcctttcccagttctttcttgctgaggataggcagtcattcttagcacagtggtcctaggagttcctatttcttttctttttcttttttttgtttttgagacggagtctcactctgtcgcccaggctggagtgcagaggcacgatctcagctcgctgcaacctctgcccctccaggtttaagcaattctctgcctcagcctctggagtagctgggattacaggcgcgtgccaccacgcctggctaattttttgtatttttagtagagacggggtttcgctatcttggccaggctgatcttgaactgccgacctcatgatccacccgccttggcctcccaaagtgctgggattacaggcgtgagccaccacgcccggccgagttcctgtttctttccttggctcctcaag

SEQ ID NO: 7900 - DNA, 1108 bp, Homo sapiens
attttccctctggcctggtttgttggggaatgagctggtccctgaagggagcagagcctgagcccttgttggcatggggatggcatcagcatagctgaacgggcattctagccatgcagggactcagccttgtgctaggggaaaagtggggtttagatctatgcagcttttctgcttattttctaggcacctttgaattaacttatctttccatctgtgcaatgaagaactagtgcccaacttgctgcagtccatgtaggagccatacacgctcacgcctctattcacttcaccatgtgtgtcactcatcagtactaactgaggatctgcgctataaggggctgcagaggatggacagggcagggcagggcaaaggcctggagtcctcctggagtcttcacccagcccttccatcacccaccaatgggcttttggtgggtctcttccttcaagacttatttcccttccatcaattaggacagggctgggggtggtccctgtgactctgacatctctagttgtgtgtcttatgtagcaactgtgaagttaaagctccttaggagatgggtggtgggaacttctccttgaattattcctcccatgtagctgccttatggaaatgagccgataatggccaattccatgtgcaaatcagctctgggctcagctcagcctgagcaggcgtgatgcctcttgcactataaatacctcccctggaactagcgcagccccaagagtagccccagtgcttctcagcttgcacagatgccaagaacattacctgttcttcctggggctccccagcctctggctgctcctgggaatctcacatttcctggtctcgttcagtgctgggtcccttagggatattcgttaattctcataaaaccctgggaggatagtgtaattagcagcactggatgatgatttagcactcagactctggtgcagactgtctgagttcaaatcctgcctccagcctttctaggtagcatgaacttgggtgaggtactcaatgtctccatgtctcaggttgcctgtaggcgtctacatcatagccttcttgtaaggtatagagagctggcaccagaataacactcagtgcctg

SEQ ID NO: 7901 - DNA, 1031 bp, Homo sapiens
atggacacttaagggttgcttctacctttggtccacttggctttctgagggtgttgggagaggaatgtcgtctcttggagcctccatgtgtgtgtgtgtgcgcaggtgtctgtgggtgtgtgttgctgcaatgggattgtatgtgtttgtgtgtggtgggcatttttgtgccacactgtttggaagacatccattcatccttcattctgccaccaaagtcaccttccttaactcactgccctgcttagacccctgaatgtctccccctctccttaaggatcaagttcagatcccttctcgcagtgcacagggcctccaaggtctgtctctccctggcctttctctcatcactccctcaagacctctgtgtcccagcgacgcaggatggatcagcaggggtgccatcaggaacacatggcccactccaggtcattcagaggaggggatttaacatgaggaactactgacaagtgctggcagagttgaggacaggtggagtggaagcagcccagactaacaactgggcagggctggagtgactcccagggctcgagggatgaatgggagagatggtcctggagccatgactgtccagtgggtactgggacctcatagaggggccaccctgagggaactgggagcatgtgggagacccaaccatggccagagacactggaagcagagagagggtgaaatacctggcttcctcctcctcctgtgcctgagtctcctgaccatgcttctcagtggtcagtggtaatcagcaggatagggagtctgggaaggggaggggtgggcactctagagggaagaacaggggagggtgggggatggatgtgactgcaatctgcactccccaccacacccagggactcaccttcctgaatgtgtcccagtcacaccccaccatcccacatggctccccgacctggaccagccacctcactgcctgaaagctattcctccatcctcaagacttatttgagcgtctccttgttttggaagtttcctctcttctccttgttcccctg

SEQ ID NO: 7902 - DNA, 1048 bp, Homo sapiens
tatcctgcactgagggacatgcctctctggtggaatggagacaagctggcaggaattcagaaaggagggattctgaggtctctgacaggcctggagctgggggatgggctgatgtgagctgaggggtcccaggaatgggactaatgaggaaatggtgcagagaatagggtgcagtatgtcaaggaactttccaactgtcagagttgacctgagctggaaggggctgcctctgtcccccagggacccaccctgggtactatggcaggaaggttcttagctctggtgtgcccacaagcccctggatgattggccatcatgagatagaggttctccctagagaccctggcatggtttcctcaggcctagaggcccaccaaaggccacgtggttgagctttgctaatggatcataaagagaataacgtgccttgcgttgcttctcctaaaggaagggaatcaaacattcactgtgtagttactctgtgccaggcacacaaccacagttcctgtattggtctttatagtaactcaacaaggtaggcatctgccaccaggtcacataaggagcaggctggggggaccccagctgcaggtggcgattcagatctcaagccctcactctcctgactgcaccccaaccaccctgagctacaggtgagtgcgttctggataccatgccctgggaatgaggagagagtggagggtgcaggtagggtgagctcctgaggccccaagttaggagatgctgaggctggatggggctaagggaactgggaggcattttttcattgcctcaccttctcttctgtcttccttgcttcccatcctcccgggctctcctgagacacacgctctggcctctcacacattctgtttgcagagggacccacacacagtggagccttaggcctgggactcaggctctgggaggctgcatcctcactgtggggcctttaaggattttgttgctggagacccctgtggttctgtggaatcaccacatatatcggtgtgaacatcacctgttggccctggtcctgtgtgctgga

SEQ ID NO: 7903 - DNA, 1032 bp, Homo sapiens
aattttcctgctgaaacctccctctctatatggagggcagatattgtccacctggctaggtgtccacagctatggcctggccaggctgtgcctgccctcccctgcccctctgcgagcctagcaagcctacctctctcagcatctgtgggctgatattccttccaccctgacactgctccactttgccatgcctttgggccagtcttttccttggtggcaactgaagaaagctcatgcaaattcagtgcagcctatggcaaggtggttaggaagagcttcctggaggaggtgacatttaagcaggtgcttaaataagagtagtttttactttttattaggcaagcaaagggcactgggggctggaggtgacatttaaacaggtgcttaaataggagtagtttttattttttgttaggcaagcaaagggcactgagggctgtaggaagagtgttctaagcagagggaagaacttgcttccctctttccagaggaaaggtctgggggcaatggagaggaggaaagatcatatggctggaatatgggaattggctagggataagactggagagacagtcggaggaggccttagatgctcaggatccccagaaatctctgggagccatatcttgctacctcgggtggcactcttgggtcctgttctttataccccatccagagatttgaagacagacaaaggcaaagccttcatctctagaaggctctggtcctttcactgcgtcctgtctgaagtcattctctgcaaacaaaagggcagaaactgacacattctcaggaatgatgatccgagttaggacaaaccacagtcccagagtctaagctagaggtaggacccgaatttcccagatgacccaggcgtcatgccagcgggtaacagctccaagtccctctagcccttgcttcatgctgggtgccctgaaagagcgtggagctgcccttgctcacatcatcccaatggcaaccccacatggtgggttctgtactcagagaagtaaagggatttgctctaggcca

SEQ ID NO: 7904 - DNA, 1049 bp, Homo sapiens
gcccaagtctccaccctctctgagccagctgtgcttcatagtcttgggacctgagttgtcctgcctggggccccatggaaccaagggttctcacatctggctgcttgtctctcccttcctttgccagccccaggacagcaccgttgctttctcccaagcttctcgttgtccttttctgaccccgaaccactccctccttcttgggcagaattagataaagtgaattgcccaggactcttgactcattcatgcagggactggattctgaaccaagtctaggaggccccatattccaagatcttttctcattgtgcgctgaaggctaactctagtcttggacaagacagaattttccattgcctcattcctaacataagttccatcccattgattctctgacttactcgtttaccttgaaacactgatatttcaaatgatttccctagtatggatgtttctgtgctttcactcagctcattcaattgttccatatcttctgaatatctctgcttcaggccctgaccctgaagatacacaaagccatgagcctcagctcctcctcttgtgaccttagggattaagcatgagataatatgatatatatgcaatagaagtgtgctaggataaagtattcctggacatgcaggaaaaggaatggttaactttgcctagcaggggaaaagtcaaataatgccaaagagcaagaggcatttgaggtggattttcgggagtgagtggaagtgtgaaaggcaaagtaggggaggaagagcatttcaggaaaagggaatcagcacgtgcaaagatagagattagaatgggcatgtctacatgtagagagcatggggcacgtgaaggttggcaagtacactggtgccattgtgatgtgtggagctggggagcggtggaggatctcacaaactggactttgatcacttgcagtggggagcatggctaatatttcaagggcgtgcttgtcactgactttggtctgtagagtgggttggagaaagaagggctgggaggcagggagaccagttggctgatagggg

SEQ ID NO: 7905 - DNA, 1037 bp, Homo sapiens
cttgggactcactagcctgtgggtggccaaatgccaagccctctctgatctcccaggtctaaccccaggacataggtcctgctgccaagggaggggcatcctgggatcccccatcctctaagaaatagggagatctcagtatgggaccctctccccacctaatcgtggctttccaggcatcgtggctgtcagaaggggaaggtatttgggaacaggagggttttctgggagcccttgtggactgccctgcaccaaagttaagtgctgatctcggccccctggcagtcttggctcctccagtgagggaggcagctatcagacaggctggctccttctccctgggaaactgagggtgggggtggccctgtttcctaggtcctgcacggctcaagtgttgtgagctgatttgctttttcagctccttcaatcttgatagcaactgagaggtaagaatcgtcatgcccaggctgggcactgtattcctaacactttgggaggccaaggcaggtggatcactggagcccaggagttcaagaccaccctgagcaacatagtgagactccatgtctacaaaaaatacaaaaattagctgggtgtggtggtgcatgtttgtagtcccagctactcaggaggctgaagtaggaggatcgcttgagcccaggtggtggaggttgcagtgagttgagattgtgccgctgcagccagggcaacagagtgagaccttgtctcaaaaaaaaaaaaaaaaaaaaaaaaaaaaaaaagaattgtcatgcccgatttgcagacagggagcagaggtctagagagattgggatttatccaacgttttgtacgaccagtgcagaaagaaaactttcaagtctgctgattctgaagctcatagttattttttgttgattgataatatattattgttttaaccactccaggttgcaatccctccgccctccctctcccaatttggttctgtagatctgtctgaatatggccacctgctgaggtggggcccagcatggcagtgggtggtgctgtgcgtg

SEQ ID NO: 7906 - DNA, 1037 bp, Homo sapiens
gctgcaggggcctgagcagtgtgggggcccttctcctcaagtctcagtgactggcatgcctgggccagggaaagacatggggaggtaggcgatggctccttctccctccctggcattggagtgtgtagccccccagccatggcagccctgcatgggccacagggaaagaaagaaggagtgataacaaagctgggaaaggttggagctcgaggaagaccctgggcttcttgagaccctcccacaataacctgcaatggcacatgggttgggcagaggcagcgccggcacagctagggcacaggacacagctctgggctgggcatggtgccaggctcaggagtgagagactgggtctgcagcagggcctctgggagtctgaggtctgtgattttcgtagagtccaggcccagttggctttcttttcacaagggcccatccatctgcccccatccatctcttcacacagacaccctcactcacacccacactcacagagctacattccacactcacatctgccacactcacacactcatacatatacagtcccacacaaactcacgttaacatccacactcacacccacacttgcatacacacacccacagacaccgtcacactcacacccactcccgacactcacacctgcgcacactcgcacccacccacccacatccacactcacactcacccacacttgcacacacagccacactcctcacattcacatgcacacacggaaatgccttggccctgaagagagggaggaaggcaggggtgaagggaggtacagggggacccctccccagcctcagggcagcagattgctgtttgctccatgggaccagaggaggtgccaggggcgacgcttatctgtgagctcaactccagtttaccaacaattgctgtaggagctgctcttcctgagaactgagactttcttcccggcatggtgatgcttccctagggcatgtggctgcagggcaaaaggggaatccattttcccaacagggaaatgtcaccctgtgcatcttggc

SEQ ID NO: 7907 - DNA, 1031 bp, Homo sapiens
tgtccaagtgttgtcattgttcaattccctcctatgagtgagaacatgtggtgtttggatttttgtccttgagatagtttgctgagaatgatggtttccaggaaggggaacttcacacaccagggcctgttgtggggaggggggcgaggggggagggatagcattaggagatatacctaatgtaaatgacgagttaatgggtgcagcacaccaacatggcacatgtatacatatgtaacaaacctgcacattgtgcacatgtaccctagaagttaaagtataatgataaaaaaaaaaaagaaatagagaacaggacatggttaccagaggccaggaaagaagggagaatggggagatgctggtcaaaggatataaagtttatgttatgtaggatgaataaatgtagacatttattatacaaaaaaaaaaaaaagaaatcttattgcccacatggaaagctagttgttgtcctgcagtaccacatggaacaggcaggcaggattggttgtatgtgacgttacctctctgagcttgtgagggcatctataaagtagaggtgatgatagctccccttatagggccgggtgggggtggaatggaataggacatggaactacccccagtgcctcagatatgtgagctcctttcctctgcagctagcccgggagcttctggaagacgggatgctgtccactccttcctcacgtgccacccaggcttggcataaaattgcaggccagggatccgtgagtggtgaacaaaccattaccaatgtcagccttataccaggccagagctcagcaccgggcctccagacacaaactggatagaaccactgccctcaaggaaaccccaggctgggagcagggcacaggacactctggcaactctgtgtctgggagagttgcaggtgccgtaggggtggagtgggattgagaaacagagagggaggtgaggaagcctcgggggcatgtttagctccaggatgagtcctgaaggaggggcctttccagggaggtggggagggcgtt

SEQ ID NO: 7908 - DNA, 1009 bp, Homo sapiens
agagatcctctaaccaagtgtatttaacatacttcccattggacctaatacatttccttctgcagcatagtagatttctcttttgaacaataccaccccatgggagagtctgtggcttgtgaacagtgacccacagtcactctgaggctgggtgtttggtgtttgtatttcaccagttcctttgggcatagacttccttgcctctccaatctgtcaggatgtacagaagcaatgacctgtttcaaccaaatatccacagattctggaagtggctctggggctgggaccaggggctagggcctcatcccaatgtctggtgggccctagttcaggtctggaggtagacggacccagctggccactcagaggtgggctcagtttgcacatccatgaggataaagaggaactgcttctggaggtggggcaggctggaaagtgagtgtctagggtggcacagtcaagatgggcaggatggcagggagtgagagcagaattctggactgcagaattcacactgaggtggaagccaggagtggggatgaagaatggtggtccttgggggaggggatgtagggggctgttgttcaatgggtataaacctacagttgtatgagatgagtaagttccggggatcccctgcacagcatggtgcctgtagttaaaaacaggagattgtatatgtagaaatttgttcagagcgtagatctcatgtttagtgcacaaacatatgcacaaaaacatcaacaaaaacaaaggaacaaaggacattttgtttttacttgattttcctccagctttattagatataatggacaataaaaatatttaaggtgtacaacatggtgttttgatatgcattgtaaagtgatcaccagaatcaggctaatgaacatatcatcacctcatatagttaacatttttcttttttgtggtgaggaaacttaagaaattctctcttagtaaatttgaagtatacagtacattattattaactataatcttcgtgctg

SEQ ID NO: 7909 - DNA, 1017 bp, Homo sapiens
ttctactttgcatgtggtaggttctgtcaatctgaggacttgtgtgtttctgcattttcttttctaatttcccatattctctcaggtctctttttggaattccttttaggtggtggttggagcttatatccttcatgtcttttaatttacttttatccttccatctctgggtttttgtgccatctgggagagttcctgtttcagccccctaggtgactaatttgatcttcatctgttccatgctgctattcagcccctttttaaactttaatgatgaaatgtttggttcccagatctagttcattcgttttaaatggatgtgatagcctctcccctctctctgttttctcgttcaaagtgtcattctgcttgtcctagtacccaagtcctcaggggtgcgttcgtttagcagatgagtttggtgtgcctctttcgacgtgtaatcttcttaataaggtgggtgattctgggttgcctgcttgtctttgtgtttgaaggtttctgttgtcctatctgtgaggctgaactcacatactggatgggaagagctctgcactgttgtgccagctggagcagatcccagtctttgggtatgggctccactgacctcctgtgtgttgttgccactcgagggctgtctcccctactccctgcttctgcctgcgggcagttgcttttgcaggtcactgcttggcatcatggccctgccagccaccctcacatttgatttggggcttcttctgggtcctcacttgctgggcttcccagattggagctgccagcttcatggcagccctctcccggatatgctttgccctgtggtaccatttccaatccgaacccatcaaccttctgccttgcaagcattcttcatgattcctgccctagtaagaacctcattcttcttcttttttaaaaaatccagctcctgcaggaaagaaccccattctggtttttcagcactgctatggatttttaaaaaagtgtttatgttacttttagggttttgtattggga

SEQ ID NO: 7910 - DNA, 1062 bp, Homo sapiens
tcaggaatgcatcctcttcctctccaggggctgttcttgccctcccttcaccgtcctggggcagccccctcctccagcaggaagttggcctggattctggaggggtcaaggaggggctgttaggaagccaatccagccatgggggtggagaggccagggacggcccctctgggccccaccctgccattggccagctgcatgacctcggggaagtcacccctggcctggactcggggtttcccatctctgaaatgaatggtctcacattggcaggtgctgtggtgttgcaggcgtgccctgagccctgcagcctccgtctggtctgtcctgactgtcggtttctgctttctgtgtcattcctgtccaacaggatggccagtgtctcaggcagtaggcccgtgtctgatacatctctgcacaccatacagttcccagtctgacctggcagagacagcggctggatgctcatcactggagaataggcagtggctttgcttttactgagcgcttgttctgtgccagaccagttactagcagtaggtgtatgtttctcatggcaacttgtctgcagatgaggaaatggaaactcagacacttggtacctgccccagggaccagaactgggatagaagtgactgctgagctggggacccaggcttggtgaccccaaagtctgaactctttctgttccccctgctcctggggtcccaagtcagtgttttggggagactaggagtctctgtctctccagccctgtccagtggagggcactggtggaatgtctggcactgtgttgactccagccctccagcttccaatggggttgtgggcactttgtacaccttgtggagagggtgggggcatcacaattgctaccaagcccacatactgctctgggccacccccttggctgcacacggagctgctcaggctcagcaggtagtggcctccctgggtagttggggaaggggggctctgcaggctgggaggccctgtcaggacggctctgtgtgcctcctgccccagccagggctgtctagcatgggagtccaaggctggaat

SEQ ID NO: 7911 - DNA, 1050 bp, Homo sapiens
ttcacagatgttcactggtgtcttgtttgggccaggcaccaggcactgtgttgggtgctggggttcagggtggacatggtacgtggagcttgcctttgaattgagagaggaggtgagagatagcactttggaggcagaccagctggatctgaaccccagctctgtcaccgactagtttttgaccttgagcaacttactgaagctctctgagcttcactttcctcatctataaaatggggataaacataggccctgccacccagggtatttgtgtgaattaaatacccagggtatttgtgtgaattaaaatgggagccaggcgcggtggctcacacctgtaatcctagcactttgggaggccgaggcaggcggatcacttgaggtcaggagttcaagatcagcctgaccaacatggcgaaaccctgtctctactaaaaacacaaaaattatctgggtgtggtggtgtgcacctgtaatctcagctactcgggaggctgaggcaggagaactgtttgaacccgggaggcggaggttgcattgagccgagattgcgccactgaactccagcctgggggatagagcgagactcccccctcccctggggggctgttactgtggactcttaggtgggagggaccagcaagtttcccaaatgaattccagctgtggtttcttcggttgtacaggacaaagatccaattcaccctggcctttgccaaaaggggattcagggcaggctggattcggggctgtagagtatctctttgtggctctgcttgacttcattttgtacaggctccttccacgtcatccactattcgggcttagcaaaaatggcagagaaaagaccacattccctttccactcgaggggaaagaggtcttcagaggactctgattggcccaccctggttcatgtgcttatccatgaaccaatcagtgcaacaagggaatggatatcctgattggcccagcctgggtcatgtgcctatccatgaaccaatgagtgttaccagggatgggagtatcctgacgggcacagcctgggtca

SEQ ID NO: 7912 - DNA, 1024 bp, Homo sapiens
gagttgctgactgactttttggtggttcggggctttgcttgctatgcatctctcctcatttcatccccgcactctcagctgggcgtctgagtgtccccttgctctgatccttgctcagcaactcctgggctttccattccgctgcttggctgcttgaccttctcccctggagcctcccaactgctgcaaggggcactctccctcatctgtgaggctcactctcccctcctccagtccctgctgtctccgcctctgtgagttcttccctgggatccatgcagaatttcaccctgctccccaccccactgccgcccctcccgtcctcctggtgctgcctgtctttctccgtagttctcatctccttttaataggccacttggctggacgatgggttaaccttgttgttgctcgttcacctctatcccaagtggaagcgttaggagggcagggattgctgtcttttgggtcctcatctctagcgccgtgccttgcatacagcaggtgttccatcaatgcaggttgcatggaggactaaatacctctgagctggctgccagaccccagaccttgacacctcctcttgaggtcactttggtctgctgactcccagcctccccactctgctcgttccctcctttgctgtcgtgggttcctcagaaaggtgcagctggcctcctcactgcctgtgaggctgctcacatggccatgcctgagggccggctctaggttctcctccccagcgggaggcaaaggcctaagctttcttcctcggtgtgcatcctgcagtgtggttctgcctgcctagcccagccacagggtgcagtgggaactaccacacccctgggagctgcaagttaattagtgtaggtggagccagcactgggtaatcaccgaatccactccccatgggcaggcccgtgccaatccccaggcttcccgcatggggctttgaggtgccctggcctggcctctgccagccttggtggcttctctcaccccatacctcctcctcctcctcccctgc

SEQ ID NO: 7913 - DNA, 1098 bp, Homo sapiens
taactgatatcttcagcacatgagtactttagcagtgttttgattagatcttttctgaagctgtattcatctcatttttttgctgctttctaattttgcgagtaccctggcatgggaataggaaaaagggggtgggtagtggcaaatttctgaagagaaatatgtcatctctccttttttgcccccgctaacaaaagtcgaattgggagcttttgtgtgttttctttttgttttttggttggttttgtttaaccctttaccttgtgtccccaaacttgggacagtatactttcttttgccccttactacaggtgaaccttcctaaaagattttttctttttattctccgtaaaacatttaaagcattctttaatgaaatagttttttaagcaggttgtgtaatgttttccatgtaacagattggtttatatatagtttggctgcttcttgctaataatgaagggttttctctcctgatattgtctgagaatctatcatagatgaggttagattgcctttggaaagatgcttctagttaattcctgtcctatataattagttgaattcatctgtgaaggatgtgaatttttctttgatctttttatttcatgagcagctttgtgagtacattctcaggtctaaagtcctcaccctcttctcctattcccccagggcccccagtgaaacacacacatacattaaacagtgcagtttgttatttcaggcctttttctttgcatttatgaaagtaggtcggcatgctgcctcacacctgtaattccagcactttgggaggccaaggtgcgtggattacttgagcccaggagctcgagaccagcctggccaacatgatgaaaccacgtctctgctaaaaatacaaaaattagccaggcatggtggcacgtgcctttaatcccggctacccgggaggctgaggcatgggaatcacttgaacccaggaggtagaggttgcagtgagctgagattacaccactgcactccagcctgggtaacagagtgactgtttcatttaaaaaaaaaaaaaaaaaagtaaatgtgtacacaaatatttctttgtagcttttgccaactttacct

SEQ ID NO: 7914 - DNA, 2192 bp, Homo sapiens
caattttcaaattgctgcagtgtaggggacccaagtttcccttgtgtggtggtattctaccatttctggactattgattaagatagaaggaactagaagggaaggcaatgaaccatccctagaagccaggacccagaaggtgtacctcacttctcttcacacttcattggcaagagcttagtcacatgcccatgcaagcatcaagatgttgagaaatctatgtgagcatttgtccagctaaatgtttttaaaggaaaatgaaggggagaatggatattctctaatcacaggtggtgttgtctcaagatatttatagcttccggtttttttatttctaaatttgataatcatctttctaatacaacttgtcatcaatatttaatggtatttttagttgtgagaactgttattttagctgattttggtcatggctctcatactagtatcttttagttttaattgttgaattataggctaagttatgttctcacaaaatgccaactactgaattttatggttttttgcatggactttttagaacttatgaccaagttatgctatttcctggtgatattctgaagtgacagttacctacttttaataaaaccgtggctaccaattatgcttttgaagttctactcacagtagtggtgtgcattgttcttcatgaagataggaattgacaattttttcataaaaatggcagctgtctttaaaagtcattactacctgttgtatgcagttgattcgggcagagaagaaagactttgcagctttatttcttctcgttagatgtggattagattctctacagtgtttcatattgcatattacaatttctaattcttgatagtacagatgctgttggttttaatttaggagtttctgtagtcttccttcaaataattcaatactctggatatttaacatgtgttatgttttttatagtttaagaccatttgagattgtatgattatgcttaaaaggaagttgtaaagagctcaaagattctttgtaagacttttcttctcctgcttctgattccaattgtcttttttaaaggatttttataaatcctttaaagaaatttttgacaatccagatccaaattgtttttttctacttcccccttttgaattgccgctaaagtactgtgcacacatacacacatagttatgcattgcagtacttcttcagagttcatttagttgtacttcgtgctgattgattgaattactggtgatatccttgggtggataaagctggatgaattcttatcagcttactattttgtcttcatatagcacatagtttttaaaacgtataaataaatttgctcttcttgttcataaagtatttatggcttaaaaacattccttttttttggctgtgcgctgtggctcacgccagtagtcccagcactttgggaggccaaggcaggtggatcacctgaggtcaggagttcaagaccagcctggccaacatggcaaaaccccatctctactagaaatacaaaaattagccaggcgtgctggcgcttgtaatcccagctactcgggaggctgaggcaggagaatcgcttgaacccgggaggcgcaggttacagtgagccgaaatcacaccattgcactccagcctgggcagtaagagcgagaaactttgtctcaaaaacaaaacaaaacaagaacaaaagaaacccattcctttttttcctggcttttatgagccagcccagtgggggataacatgtcatttcctcttagattttcaggaaggaatgctttctttcctctgtttttgttgttgttgttttgttttttttgtttgtttttgtttttttgagatggagtgtcactctgtcacccaggctgtagtgcagtggtgcagtcttggctcactgcaacctccatctcccaaggctcaagtgattctccttcctcagcctcccggggtagctggaattacagatgtgtgccaccacacccggctaatttttttgtatttttagtagagatggggtttcactatgttggacagcctggtctcaaactcctgacctcaagtggtctgcccacctcggcctcccaaagtgctgggattacagacgtgagccaccacgcccggccttttcctctggtttatagttgtgattcagtaatccagtctgttaacaacaacctttgtggtgttat

SEQ ID NO: 7915 - DNA, 1030 bp, Homo sapiens
ggggtaggggttggggggtgagtggggggagatgggagggacgggggaggggagagagagagcacgagtgagcacacgcacatgcgtgtgtgcctgtgtgtgtgttagggtgtttatagtttggaatttcatttgtttttccattttgtactacagtcacgcattacttaatgacagggttacattctgagaaatgcatcattaggcgatttcattgtgcacacagaacacaaagctagatgggatagtctgccacacacctaggctatatggtatagcctgttgcttctgatatgttgccgtactgaatattgtaggcagttgtaacacagtggtaagtatttgtgtatctaaacctagaaaaggtacagtaaaaatacatataaaaatggtacacctatataggacacttaaccatgaatggagcttgcaggattgcaagtttctttgggagtcagtgagtgaatgtgaaagcttaggacactactgtagactttataaagactgtacacgtatgctgcactaaagttataatagtttcttcaatgataaattaaccttagcttactgtaatggcttgtttttttctttttgctttttgttttgagacaatctccctctgtcacctaggttgaagtgcagtggtgtgaacactgttcattgcagccttgacctcctgggctcaactgatcctcccacctcagcgtccctagtagctgggactacaggtggacatcaccacaccctggtgatcttgtattttttgtagaggtggggtttcaccatgttgtcgaggctggtcttgaactcctgggctcaagcaatcctcccagcttggcctcccaaagtgttgggattacagacgtgaggcactgtggccaaccagcttactgtaactttttaacattataaacgttttaatttgtttaaaactttttggctattgttaataacacatagcttaaaacaaacacactgtactactgtacaaaaatattttcattctttatatctttattccgtaagcttt

SEQ ID NO: 7916 - DNA, 2015 bp, Homo sapiens
tctggtttccattatcctccacatgtgttcttattttcacaatcgtcatgtatgtaactagtttcttgactatgctgaccatcttcctcaccttagttctgctgacatagtctggccaagaggtcccccttccctctacctacccctctaccctgtgttagaaagcattaactctttttttgtttgtttgtttgttttgagacagagtcttgctctgttgcccaggctggagtgcagtggtgcgatctcagctcactgcaagctccgcctcccaggttcactccattctcctgcctcagcctcccaagtagctgggactacaggcgcccaccaccatgcccggctaatttttttttggtattttttagtagaggtggggtttcaccgtgttagccaggatggtcttgctctcctgacctcgtgatccacccgcctcggcctcctaaagtggtgggattacaggcgtgagccaccacacctggcccagaaagcatgaactcttaagcatacgtgtctgtgagaatttcctttagtgtctcccaggaatatagagttgttaatatcaggattgagggctgactcagaaagaagatgagggtgaagaaaacttgtagtaagaacatagttgaaatgatgattcagaaaagttgtcacttgctggtgagaaaaagaaagataggatttgataaatagggttgaaacatacctggatttaactacctattgtttctaggtaaggttttgatcattgagcagttcttggtactttcgttcatgaaatgtcatccagtttctgatttctggctacagcttccctacatgccattatttgtagctgtcatatgtgtgctgatatacttagattatttcttctgcttgccctgcttgtggtttgacttctaccttttcattcagctgctgcctgtcatccctgcttgtaagcattcattgtctgtatagtcaggctgactgtacaggttttcagtgcttgcggggttggttgtgttttacctgggatgttggccatcttgttttgcagttaagactgctgctgggtcattgatgaaactaaccataacgtcaatctcagtttcaattctccaatatttatacctttacgttctttttttgttgttgagacagggtttcactccagttgctcaggctggagtgcaatggtgtgatcatgtctcactgcagcctcgacttcctgggctcaagtgattcctgtgcttcagcctctagggtagctgggactataggcacacgccactgcgtccagctaattttttgtattttttgtagagatggggtttcaccatttttcccaggctagtctcgggctcctgagtctagccatctgccggtctcggcctcccaaagtggtgggattacaggcataagccatcatgcccagcctatacctttactttcatcattcccctgtggtttaaagctaggcccttctagcactatcttttgtctaactctttaaggaacattctggacttaattttttcttcccatctgtccttcaatatgacactggatagggggcttctgggcaattaaaatttatcagtataaatcatggttacatatttagttgttttagaatgttgtaattacataaacctgcagttttaaagttgaatatagctttatactttgataaacttcattttttgttttataaaatgagtttatacgggttgtcaacttactagcaaaatcttacaattgaagagactttaaaggacaagtactcccacatctcacccaagaacaaatgttccttccacacagtgtcttcctttagcagttagaacccactctcatgaaatagcatatttttctgtcagaacagttttacccagtgttacctttgttatatgtatggggactcactgactatcttgagatccagtcatcatgtggtattgtgagatccactatattctcaagtactagaaacctgatatattaattgatatgaagcctgaaaaaaagaatga

SEQ ID NO: 7917 - DNA, 1050 bp, Homo sapiens
tatgcactgtttaacacttgtatttgatgattatatgttttcttaaattttttttcacagagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcaggtaagttttgattttctttattctccgccaagagagctttgtgcaaccaatttatttaaatgatttaaattctaaaatatatattgtgttttctttctgcacttatgatacatggggaccattgatagttttgtaaaagacatttaagaactttaaagaaaccagttggaggttgaaataaacaacttggatgttaacatttatagactgttgcgcagggtacgttttgggaacagtcataagtttataaccccaattccaataagaaatatctctttttgttgtgttaggatcacaaagtatctcatttctattactgtggaggatttggatggttattgataatgaaaatgagatgagtatttaaaatgaggattagttaccaatggtagactctctgccaaaactagttcagaaagattaagggggtattgagtggagacatttaaagaattgaacttgattccaa

SEQ ID NO: 7918 - DNA, 1592 bp, Homo sapiens
aacattccatctttgttggtgtgtatgtgtacgtacacttacagacctgcaggatctcagctttacattcttgaaggaacagagaatcgatttttattttgttgtccgtggtagttgcccagtatcctgttttgtttaggctgtacttaacaagaaagacagtaagacttgttagtgttagagctgcagtggaagatgaaatacatctccttcaggaacactgttttctcttaacgcagatatgtatgatgactaaattattaccttgtcaaattaaaattgggttctcaccaaacatgggggggggtctactactgaatttatataaaactcagacagtgactcattataaatggtaagaatttaagttaatcaagggaaaacaagtgtagatcaaaacatattcaaaagtataggtcaaatataatttcaattcttgtagctttcaaagtaatgatttttcattccttaggcccttgttcactttttaaagttatattcgatgtattcatgtttgaactgtagaaaggtcaaagtgttagacaaacggttactgattgatcatgtttaaaaagtactataactttttaataggcacagaactaatgcaagtaacttgttttaaaaaatgtttgactcttgatttactgccctaaagatttttttttttgtcctgtgaagtagataaatcaggtgaatcgatttgccatttataaattgaaaaggaaaataaaagttgtatgtttctatgtctgtattaatccatgaaacagtgtaatatgctggagctcactagccccagaaaatataactcagcaaatgagcacagcactatcgggacaaggcagataggataaggatagtttctttccctagggagatgaccatctaaggaacatttttaaagtcacagcgcaaattacattacaccaagaagcagaatcttcaagattgggttaaaagctgcaggttgtaaaacatgagaaaaagcaccattttggggaccttttttctcatgtgaattagtgccatgaaatttcaaagaactaaatttaatcaagtattggatatttctgaggccctgaaaaaaactaacattctgtgcttaagattttatataagtaattaccctatacaggttatcattatatcactgcaacctccatctcctgagttcaagcggttcttctgctccagcttctcaagtagctgggattacaggtgcgtgccaccactcccagctaatttttgtatttttagtagagatggggtttcaccgtgttgggcaggctggtctcaaactcctggcctcaagtgagctgcctgcctcggcctcccagcctctatacagataattttttaaggtaaaaatgatgtttataagaatagtaaattaattcatttggaacttaatatgcttcattttaagttagctttatggatatcgtattataagttggttaatcattaagtttttttactttgtaagtagcgtaggaatatgtactcattgtggaggaaaattgacatggaagcatgtagggtaataaatcagcctttctttataccccttcctcatatttgtttattta

SEQ ID NO: 7919 - DNA, 1041 bp, Homo sapiens
gtattctgtaagaatttacttaataaaatatttggggttttgaatagaatttgtttgtgaaaaacagcactttgttctcagctaagcaataacaattatggcattctttggttatttcaattatgttttttttttttttttgagatggagttttgctcttgttgcccaggctggagtgcaatggtgcaatctcagctcaccacaacctccgcctcccaggttcaagtgattctcctgcctcagcctcccaagtagctgggattacaggcatgcgccaccacgcccggctaattttgtattttagtagagatggggtttcactatgttggccaggctaatctcgaactcccgacctcaggtgatccaccctcctcggcctcccaaagggctggggttacaggcatgagccaccgagcccgacccaaatggttatttctatgtaaacagacagtttttaaataatgtgaaaatacaggagtgttttggaaataccgaggtgggaacaccggcccgctgtggccaggacgatggcacatcatgagaaggtagcacttgcggttgagaagtgaggctggagagacacagcggcctggcatatgggacttgtaaatgcaggttagtttgggctctgttgagggataatgagaagacatttataagttgtgcaggtccattagatggtcagatttatttttggagagatcctgaatgggaacggattcgggggtggatacggagcaaaatggagacaaggagatcagttaggaagctgctgagatgatgcagaggagagatgttttttaaaggcaggagtcctgaggatgagaggagaaaacaaattcaagacaggttcaggaagtacatgggcagcctgtggtggttatttgttgtcagagcaatatgggagaagacactaggatgatcccagatatttagtttcaatgaccgggtggtgcctacaattcactgaaagaaagaatacaagaggagaagcaggttggctaggaggatggagaactaagtcagtggcagccctggaat

SEQ ID NO: 7920 - DNA, 1043 bp, Homo sapiens
tgggcgtggtggcgcgcacctgtagtcccagctactcgcaaggctgaggcaggagaatggcgtgaacccgggaggcagagtttgcagtgagctgagatcacgcctctacactccagcctgggtgacagaccacgactctgtctgtataagtttttgggttacagttatagtttgggactacttttgattctacttttttttttttttttctgttagcaatatcttgatctcttgttatttttttgtagtgtctgttcaagagagtttagaaagaaaatttggaaagcatggtggaactattcccattgtacccacggcagagttccaagacaggatatcggtgagtgtggtgaccccacagttgtacttcacacatgctccctgctctttccttcagacagagctggttagatggatttcatctgcggcatagtctttgtaattagcttgacagtaagtgcgtgacatgtgtgttttgtacctttccttttcattacattctaaaactggagtaagaatcctactgactactaacaaatataaaataaataaatttggtatttttcacgcacgtgttttaacagtgaaggattattatgtattttaattattttaagcttcagagaaataggaagaattgaaaagcaagcattagattgaactatatgggagtccaagagtttgagaccaacctggggaacatagtgagtccccatctctacaaaaataaagaaagaaacaagaggccaggcatggtggcacacgcctgtaatcccagcactttgggaggtcaaggcgggtggatcacgaagtcaagtcatcgacaccatcctggccaacatggtgaccccgtctctactaaaaatacaaaaattagccaggcgtggtgctacacgcctatagtcccagctacttgggaggctaaggcaggagaatcacttgaacccgggaggtggaggttgcagttagccgagattgcaccactgcactctagcctgagcaacagagagatactccgttcccgccgccgccacccccctccc

SEQ ID NO: 7921 - DNA, 1033 bp, Homo sapiens
aatacggaaatgtgttgcccttatgcctttttatttcatggaagccaaatgcgtcttttctcccaaagtatactagaaaatgaagacgcttggtaatggtagtgatctgtacatcagatttcagtctttctgtcacttgcgtgtatgaatccatttagcaagtttgcttttggcagtaaagccccacgtgcaggaagacaaacagctgctcactcattatccaaagtatactttgtaagaattagggcatcaaaaattggatcctaagcaccaatatatattaaagttcagtacaacttgtagtgtttaagtacaagaaataaaaattgagcctgaacttttggcatatagtgggaagaaattaggtttaccgctgttaataattcagagtgcttaggaaaatcggtttttatttacttatgttaaaaatactaagggttctgtaaccattaaaaactaaaatactaacctgtagatgttgaaaaaatcctagacactagtctctgccacgtgactgttcttcttttctatttattttacccaataattaggcttttacaatgtaagtaataaagagaaaaatctctagtatcactttagagcacattgattcataaatagcccataaattttgtactcagcaacccataaaatacacatgcatgattcacataatcaaatagtaacgaaagttacaaaatgaaaagtgaagcagctctaccccaagtccttcccccaatataaccatgaacagtcttaaatctaatgccgctgtctaaaactgactagttattcaaatgaatcaatattttcccctttccagaggcagaaattaatacagattcaagtgttcactatcaagtcggaattgttaatatgtgaaatactactgttaaaggcaggaaaggctttattaaggacaagaagacaaactaggagaaggagctactcaagaccttccgattatctttacaaaaaggcaactacacctagaagattctgcagccacacacattctgccttcacttgaggt

SEQ ID NO: 7922 - DNA, 1097 bp, Homo sapiens
ccccgcccacttctaggacttaactttggagcttaattatcccctagctctggttgcctcagccaaaaccaatgtttgaaccactttgacctctgatttcctttctagcttcaaaattgtataaaatgtacacaccgtcagtctcctacatttgcctgccttcttcctaccactcccttattatccaaaccaggaaaacaagttcagactccaaagaaaggcaaataaggatgttggaggaagttcaggcaatgtttagcaaatattgagttgcatcgttttcttaaaacggacatcaagtttattttttactatcttgctggcagcatttgccagtcctttaaaaggtgtacagataaatcagtgtatgtggttttctgcaggatgatttggtctctgaaatcctttttcttcgattcttcagatgcccagctctctcctgtttttataagtcgcagctccgcaaactcactgaagcaactcgtttaccatagtttgtgagtcctctttctcttgttgccacagcagttttaatgccaaaatattgaacctagcaacaaattgggtcagccataccaaagcactgttactgtagcacttgcttgtactagagtgtaagatacaattttctgttccgtttatcccatttacaaaaaaacatgctattaacccccagcatataaacagggagaaactgaattgttactagtaaactgttgcaagcattgatagaacatcaaagaaaattggcctctacaaagtgacaaatttattatcttcaggaatttgaaaggctttctggattggggaagattacatagctatgaaagcccttaaatattttagtttgcttaataaacagtatactaaacagatgatcagcaaaatttgggtactatagccttccatgctttgtgttcaagacatccccagatctatctacccatttatcacccttgtttgcagagaatgtgcattgtaagagagacaggtcttctttcttaaagcttttttaacgtctaagaaattgttaacctttgtagtcccactctagtcttagaaacacagaatatattaggtgattgagatttttttaa

SEQ ID NO: 7923 - DNA, 1049 bp, Homo sapiens
aggagttcaaaaccagtcttgccaacataacaagaatctgtctctatataagaagattaaaaattagctgggcatggtggcatgtgcttgtagccctagctacttgggaggctgcggtggaaggatcacttgggcccaggcattccagcttatgatttcagtgagttatgatcacaacactgaattccaacctaatggatggagagagactatgtctctaaaaataaaaaataaagagattaggaactgtctgcactaagatgactttactattccaagaaatccttgcctaagaaagtaaagttgaaattacttttttgtcctggaaactttccgatctatgtatctgtactcatacagcctcatcgggctaaacagccttcttttcagaacagtagatcactcaactgggttttcaagtgactgtttacctttcaaggctggctttataggtcttgcctcactgtatccagcaatccaaactttaccctatcccagtcaggactgcacacctcatgttgaaagacataccttagaaccagactccccaaagcttaccaatatcccacccttgactcccttttctgaggctactaagattatgtgaagacagtcatcttccttactgcagtgagcaataaacttggtttttgttcatcagtaaaccattttggtggtttctggaggagccagcagttggcaatggttataaatctaaatctaaaagccatttataaaagactgatgaatctagtaacataaaaataaactgcatgataaatatcataaacaaagtcaaaagacaactgacaaccaggttaaaaacatgctttcaacatatattacaggaaaagggctaatattcctaatatgtaaataattgttagaaattaagagatcaagcaccaagcacccattagaaaaaatgggaaaagggcatcaatagacaattcacacacacacacagagacacacaaatggctttaacaactctatagaaacagaaagtaggtcatatctttgttctgtgaaaaggctgtgcacacaaa

SEQ ID NO: 7924 - DNA, 1092 bp, Homo sapiens
agatgagttttaatgtaatgtgaggcagctttattctctgagtcatctgtagtacttcttgttactacagccaaagacctcatcagcattttcattttcattataaattccaaaccatcaataaaaattaaaaactcaacaccagtttatgaaacaagggggagaagagaaaaatatgtatattttcttgcatattttgggatcgtgtataagagaaaatgattttttctgcaaagacaagattgaattgggcattctgaatacatgttgttgagataagccaaatatttggtcctagaagctgagaggatatgatactgaatgattatttagcactaaaggtttatcttcaaagaggtcttgaaataagaatatgtaattaggctgggcacagtggctcacaactgtagtcctagcacttttggaggccaaggcaggtggatcacttgagctcaggagttgaagaccagactgggcaatatggcaaaaccttgtatttttgtagaaaaagtataaaaattagccaggtatggtggtgtgtgcctgtagtcccagctactcagaaagctgaggtggaaaaattacctgagcctagtggggtcaaggctgcagtgagctgtgatcaggccaccgcactccagcctgggtaacagaaagagtaagacaaagaaaaggaaaaggaaaaggaaaggaaggaagaagaatatataattagtttctacttgagtcttaccggaatgcattttactgaatttcacttatgcaaacatacactggcttacaaaaatgtatgcaacatctttatgaggcagatactttgttatgaaacacaagaggcaaacaatgtagaagattcctctttctgttaagtttatagtccagaggagaagaaatacattacatatacaacctctaattcattcatttattcttttcttttcttttctagttgttgagacagagacttgctctgttacccaggctggagtacagtggtgcaatcatggctcactgcagcctccacctcctgggctcaaacagtcctcccacttcagcctcctgagtagctgggaccacagtcatgcaccacca

SEQ ID NO: 7925 - DNA, 1022 bp, Homo sapiens
gtgtcgtataccatctatttgcacataacactttttaatttaggtaaaattattaatcataaagctatatgaatttattttattccatgttattttattattccatgttattatttatgtattgttaggaacatttgcttaaaaatcatatttggacatagtatcagatactttacatccttcgaatcagttattttataacagtatatactaaacatcattactccttttcaaacataaataacgcaatacaaattggacaaaaaattcaggaaagatctgggatcaaaaaggaggtattgaaacatcacatgtactccataattatatacaaatattttgtacccataatatttaaaatacagaaaattaaaaggtacattttcctcaaagtgcatgcttcttttgctatgcaaaactgcaggatatggaaagaagtgtattaaaacactaaatcactttatgtggaagataaaagggatggtacccaatgtacaacttcatgtagtgcactgatatattcaatataaatgatgtattaacttcaagataacatgagaaagttaaattatctaacttatttcaaactaggggatagtatgttctcattattagaagccagaattctgcttatccatttctattattagaaaaaaacataatttttattcttgtcttagaaatagacaccttgatataattctctgtaaatgtagcatgatagtctgtttacagagtttatatcattccaagactgcacttctaaagtgagaaaatattaaaggatataaactcactcctctctacaaaattccttattttttatgcaatggctttaaaatgtatggaaggggagttatggaaacaatccatacctggaaagcattctatccatgcctttgaaatggttatctagtactagattcttatcggtgcctagctatgtaatgtgtgtagcttaagatttttaagaaagaaggataaaatgctcaatataaatttaaaaagcacttttattggaa

SEQ ID NO: 7926 - DNA, 1110 bp, Homo sapiens
gacaaatacatttcccattacagcttgccaatgtaacacagccttatttcatttttgttgtaaatagaatcacattctaatatgttttagctgaaaacagcaaagtatatattcaactacttcccaatagggaaaattttttaaaaaagttatttctttagcccagagctttattttccttttacataacagaaaaatacttggtgtgaaataaaaccttcttacacgtaatgagaccccatagaattttaatgaaagacaattgaagacccatttttaaataagccattgggaagaattaatataattaagaatagaaaaaaactagataaagttacaagaacaacctaggaacatttctatatttcttcctcattttctggagttctaaaagatgttgaaacattttgacagctatagaaaatgacctagggacaaatatactctctattcctgacataaaatgatatgcttattgtgtttctcataaaactcagcataaaactatatacctaatagttatttaaaaggagttcctaaaaataaatatattcattattaatatgtgacatgactgagttacttttgaaaaactacgaattattcaacatactttaacataggatttagtatcaatatggtatccatttcttgattctgtttttcatagtgcacttaaatatatatgttaatacttttgaataagtgcattatgctatgaaatgttttaatgagaaaaatgaatctatacaaagcaacttcatttatattttgttcctgtcacgttacattgctgatattttgtattatactagacatgactcatttttaaatatgtaattgtatatgaagttctcagtgttaatgtctggaggatacggaataaaaacagaagaaaagttaaaaaattaaaagtaaactatattttgcatatgaataagaatattacaaataccatatttatatactatgtttatatatctttacactatgccaaaaggtatatatggcatatatgcatatataccttttttatgcagagaaataatatctctgcataagcataaaatcaagatacataatattttaaaatgtttttcattgaagtgt

SEQ ID NO: 7927 - DNA, 1050 bp, Homo sapiens
agtgctgccaaaagaaattgctacaaaatttgtggcttaaaatagtaaaaaaagaaaaaaaattctcaattatagaggccagaagaccaaaatcaaggtggaggcagagccatacaccctctgacggctctagggaagaatccttccttgcctcttctagattctgttggctcctggcactccttggcttgtgacagcataactccaaccttagtctctatcttcacatgaccttgcttgtgtttctgtgtcccaaatacccatgactcactctaaattcaggatgatctcaccctgagatctttattatatctgtaaagctcctatttcaaaataaggtgatatttacaggtactggaatgggagagggtctaggactcagacgcacccttatgaggatactacatgacccattacaaggcacaaagtaattaccataggcaaaccgctgatgagagctcactccagtttggaatatattcatgtttccatataagagaaaaattcatccctggttcagttcatcttggcatcagtacacggatgggattcagagacatgtaggtgtggaataccagattccaccaaacttaaaaagctggcatactaagttgataaaacgatgtagagtgtgaagttgagttgagaatgcttatgccatacagtttatgtatcttataatagccttaatcacacttccagtaattttccctatcattgggtgctaaaaaataaaattaaagaattagaataaaaaatatatatatacctctttgagtggaagaatgctgtcagcacattttgttattttattccattgtataaagtctcggtagtgctctcttcataaatgtgttgaaggtttggctaaattgtatcaaatttgtgattaaatacaaatgtgaatagtataaaacattacaaaggacaatctgaatactatgctataccaattttacaattttacaatgacttacagatgccataaatatttactttaagggagtaaaataagttataaagtcatatttaagaacacctaaatccttg

SEQ ID NO: 7928 - DNA, 1253 bp, Homo sapiens
atatatgacacagatgctgtgtgcagatgatatcaaacctaaaaccacttagcaatgtgagaagaaacagaaaacatcccagttaccctggtgtaaaatttatactatttattaatggccgataagggtctcattactaaaacactgaagtgggattatatttttgtaatcgtctaatatttacagtcataaacctgcatgagaatactttcaaatactagcttttgtgcttttaaaataggtaacagtgaatgttagtattgggtgtgggatgcatcagggacacaggtttgtaaaccatgacaattcagttgtaaaactaaagccaagtgcacctgtagtcccagctgctggggaggatcacttgagcctaggaggtgaaaattgcagtgaactgatattgtgccattgcactccagactgggtgacatagtgagaccctgtctctacaaaaaaaaaaaaaaaaaaccctaaagccaaaacattgaaataagttactgacatgcaaatttggaactgaaactagaacacagtggtgtatatctcactgttctgaaaatacacagtttccagaaattcaaagaatggccaagataactcaaataggggattggctatatccagtaaaacaaaatcacttgcagtcatgtctaagggagatgagggtcatctgttaggccatagtcatagacttacaaagaataccagttaggattctgtttgtagcaaccaactctagctaacctaagcaataaagaatttatttgaaggatataagatcaaacggaagctaaagaaccagactcaggatagaaacttagctcccgaagatttttttaagcagaaattgctcaataatcttgcttttattcatcatggattaaattaactccagctgcttaaaatgcccattcaagatttaaatgcctggacgtgagtgtgcaaacctaggtcagaaatcacccctggcagtcttggagctttgagaggactctacaggaactacttcggcttaaatggtttgaggcaaagcagctgggtttactgattcatcaagactaaatgtgaaaggagaggtaatttattcaaaggaaattgtgggaaagactgttagacaaacaaaatctgacaaatgaccaggtggttacttgaagccctgacattgaaatatgttgggtgttgggtatatactaaatgaagggcaatattataacaagtggacatgctggaagtatgagcaacttacgtatgta

SEQ ID NO: 7929 - DNA, 2424 bp, Homo sapiens
accttatggtaatattgtgtacttatagatgtgaagtctttgtagctattttagcttcctacttcttagcactcagtgcttttaaaaaattccttatgatttctctatgtgtagataattcctggaagcatttacatgaagctgttcattgtggttgtctttggggtcttgaatggtaaagagatttcatttttatacccttttctacagttgaaaacaaaattttttttttaccacatgcatctcttttaaatcttggtaaaatattttagggaggcatattctaaagttatttgagtatttgatggttttgtttgcattttagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaa

SEQ ID NO: 7930 - DNA, 1030 bp, Homo sapiens
ctcactgtattacccaggctaaagtgctgtgatatgatcatagtgcactgcaaccttgatctcctgggctcaagtgatcctcccacctcagtctcccaagtagttaggactgcaggcatgcttcaccacgcacagctagttgttttttgttttttaaaaatcttcttgtagagaaagggtctcgctctgttatccaggcaggttttgaactcctgacctcgaggtatcctcctgccctggactcccaaagtgctaggattataggcatgaaccaccattcttgacctattgccttaaaacatatcaaaataacatatagtgtatgcaaaagcttaaagaacctagcaaattacaaagattaggatcagtggttatgaatcattttggggggagcatgtcatagagccctttaagaatgagataaaagtagtcttttctaagaaagctacgtatgtacatgaaatatgtacagtttcagagaaattcctaaaattctccatgttttttaggtaaggaactttggtcctagataagaaatcagtaaattatattttgcctttttttttttttttttttttttttgtgacagagtctcgctctgtcgcccaggctggagtgcagtggcatgatcttggctcactgcaactttcacctcctgggttcaagcgattctcctgcctcagccacctaagtagctgggattataggcgcgcgccaccacacccggcttatatatatatatatttttttttttttagtagagacggggtttcaccatgttgatcaggctggtctcggactcctgacctcatgatccgcccgcctcagcctcctaaagtgctgggattacaggcatgagccaccgtgcccggttgacttttaattgaatttttgataactgctttcaaaaaaacattgtgtaatcctggcactttgggaggccaaggcaggcagatcacctgaggtcaggagttcgaaaccagcctggccaacatggtgaaaccctgtctctactaaaaatacaaaaaaa

SEQ ID NO: 7931 - DNA, 1089 bp, Homo sapiens
ataaagagtgcctcttttcctatagtcttgccaacagaatgttatggaacttcgtgccaacatgatagatagaaaatggttatctctctgtttttttgtttttgttttttttcttttttgtgacatgatctctctctgttgcctagcctgaagtgcagtggtgtgatcagggctcactgcagccttaaactcctgggcccaagtaatcttcccgcctcaccctcccaagcagattacaggcatgtaccagcaagcctggctaattctgtttatttatttagttatttattttgttgagatggtatcttgctgtgttgcccaggctggtgttgaactcctgggttcaagcaatccccccgccttggcctcccaaggctggaattataggcatgaaccaccacagctggtcaaaaatggttatctcattaaagttttaatttgcattctttagggatggaatgaatattgtatgtttaagaagcatttgaatttttttctgtgaactgtatattcatatattttgcccatttttctattgcagtgctccttttcataataaatctgtaggaactctttgtattatggagatttgccctttgtatgatttgaaaatatttttttccaagttgtcttccgattttattggagttttcttcccccccacccaccccccctatggcttctggattttgaatataaatttaaaggcctttcctactcccaagtttataaagtaattttccacactttccaaactcttgctacctgttttcccaaaactcgataactgcatataattgaataacgtggtattcctctttatcccaaacttgatatctaaactcactgttacaactcactgtataaactaataaatcaaatagattctgatagtgaatgaaccttagtagagatactacttttatcaaaatacttgtatttttatggcttccctccttccttgaactaccagaaaccccatggctaattcttctccagccatgccctacttccacacttcctattttttcccattatatctcacccataaatgttttagttgtatctctaaaagaaaaggattctttt

SEQ ID NO: 7932 - DNA, 1034 bp, Homo sapiens
ttaagatttgtttgttttaaatttggaagaaattttttcttttttattaattttattgagttgtaaaaagtcaataaagaggctgggtgtggtgtttcacatctgtaatcccagcactttgggaggctgagtggggaggatcgcttgagcccagaggtttcagaccagcataggcaacatagtgagaccttgtctctactaaagacggaaaaatcagctaggcacagtggcatgtgcctgtagtcccagctactttctgtcttcaaaaaaaaaaagaaagaaagaaagaaaataaagaaaaataaatatgagcattaatattttgattttaggaccacttaacacaaatacaaacttgcattatgttgtgttgtggaactaacatttttcaaatttgtgtttatattttcttcctctaggtggcaaactctcacagttaattgaaagtaattgggctctgaggctcctgaatgtcattcagtgtagagtagaagtaggatataagatttggattatttcagaaatgtaaaacctcttagggagaaataaggtaatgttagagaaatgtgtttccatggaataccaataaatttcactttggatagcagatgtgtattgttactgggttatactgaagtatcaacagtaaaggtaatattgatgtccttcagaaattaacttgttttatatatctttgtttttattcatgtttatttttaaagttctttttttttttttaatctctacatcctttataaataagtgacatagactcagaggttggcagggctgccagcatttttaaaaagagttcttcccagcattttgatgtttgcttatactctgttatctttgtttaaagttggattacttgagactttatttcgcattgagaagctatcacctgcagtgctgatagtaccatgagatgatgatgtgaaatatagagaaaaagtacacagtatctattacagttaccagaatcttcagacttattaaggggaaatgattctctccataatattattatttaa

SEQ ID NO: 7933 - DNA, 1088 bp, Homo sapiens
gttagcccatgtaagagaaaatatcttaatattatgtaccctgtcagagcatagtgttcaactattttcagcaggggatatagaggcaattggatgaagtcttctccagagccacttcatctatagctccacagtatgattctggtacagcataacttaaaacagagttttcagaaccaaaattccttattgcactaatagcaattactgttttcattatgatgagttttgatttgagagagcaaatgctgctgcctttttattaaactgcggtcactttttaacctttattgtattttgggggcgggggttaaagttgatattattaattttgagtaatagttttagacatattctactttcatatgaaccagttagctcttctctagaattgtcttttctatgattatgaagagagcccagtaccctagctagctttcttgtaatatggtcaccaaggaaatagaaatagagaacggctcaatgaaaccggtcactgtttctggaaaccttggtgactgatgacatattcttcctcttgagagacatgagacataaaagatagtgtttttagggtattcattgatgaagttaaagttttgggatgtaaatttaggtctgattattttaaatgtgaaatgataaaaaaattatgttttgttttaaagagttttttttaaacttttattttaaattcaggggtatatgtgcaggtttgttacatagataaatttgtgtcttggggagttcgttgtacagattatttcatacccaggtattaagcctagtatccattagttatttttcctgatcctctccctcctccagatgaagctggaggccatgattcttggcaaatgaaggcaggaacagaaaataaagatttttttaaaagtttgaacaactaacacataaaaggagcattgattttgtttcttaagtagtaaaaaattactgtcacttcctgttttatattttagctcatttgtattgaattaatatatatgaaaaggttctctgcttttgctgcttaaaattactccttagaatttgcttctttatgtgaaactacacgtgatttcaatcac

SEQ ID NO: 7934 - DNA, 1034 bp, Homo sapiens
tagtaaaacttttatgtatttgcctttgtggtgtataaagcgtactgctttaagtcatgtggatttttgttttatagagtttaaacctaaattttcataatatggtatgataacacaggatactaaatcccaggttttccattaatggccttggcaaatgatttcctctttgagtctcagttccctcatgtataatctagagataataatacctactttacctacttcataaggattattttgaggatgagattgatgtaatgtataagatcctatatcaatattttgtaacaataagtatacatttataaattctataaatagaaaatatttgcctaatacattaatgttatattgctataaataagtagaatgaagtagtcccatctccatatctagaaaataaaagtctgcaatgtcttaatatctgtgtatacagagacatacacacaccctagaattaagcctgcatttgaatttggtttatagatttacaatggtaccttcttggaaccctgcctatattaatttctgaataaatctgtactaacagacttagttttttgttgctgttacagtgaaagttattttttttttcagatctggctgctggtttgcaccttccctttttatcatttttttttacattttgaaggaaatgaatctattgtaaagtattgcttctgattggccccaactccagctcctttcaggacaagtgccagtcctttcaggacaagttgaatcaggtttttcttgtctattttgaaaatacgtatgccctgtttttatttataaagatacttccttaagttttaacatagttgtaattttttttttttttttttgagacagagtctcactctgtcacctaggatggagtgcagtggcatgatcttggctcactgtaacctccgcctcccaggttctggcaattctcctgcctcagcctcccaagtagctgggactacaggcacacaccactacacctggttaatttttttttttttttttttttttttgtaattttagta

SEQ ID NO: 7935 - DNA, 1048 bp, Homo sapiens
tgccctaagcaattcccagcttgacttttccctttagtgatttggggtctccaagatttattttcctttcatatttcctccctttttaaaaatcttttggagaaagcatatttagaagaaaatgagtctctggtctcaagtttcgtctgatctctcatggctaggatggtttattccttgacggataggtcctgagttattaggaaagctcaattttagctggttgtgaagtctcatgtcttgtgaagagaaaacggggaggaagggagaaaaacaacaaaaaacaaaaaacaaatcctggaaaatttatataggccacattacctgaagtccatatgtcagtaggcaggtattaaagtggcttatgtatgtaactaagttgctgttcttttcttctgaagtttaagtgtctagcttcagttcttagggcattaagaaagcacagcttagttttcagtgactccaaattaggaaaaatgggggaaaaaagaagggaaataaattgaaaacattattttgaagacttgtagccaagaaaagtttgaattctgtctaaactatagaaaataataaaaattgaaaaatattaggcaggactagaatctaacaataggtatactatagtttttgaaacataatttctctgtctccagtttctcattttcactaaagacaaattatggtaggactgatttgctttcttctaattggccagattgtttgtatatagtgcagcaagaataattattttgttacataggctttttttttttttcgtgacatagtcttgctctgtcacccaggctggagtgcggtggcgggatctcgggggtgatctgcctgccctggcctcccaaagtgctgggattacaggcatgagccactgcgccctgcctacataggcttttaaattggctttgatagaactttgttccatagaaataatctcaggtaagacttttttaaagccaagcccagccatggatttgtaccatcaaatacctgtgaattgggtgaattcctctcctcttgattccaagataaactt

SEQ ID NO: 7936 - DNA, 1025 bp, Homo sapiens
gttcacaatttgaatttcactcaaaaattacctggtatatgatacagttaatagaagaaattcttaccgtcacattagtattgttgggctgcctttcttcagttggattagtgttatagttgatactttcctagactctgaaatagttctttaaagctgttttgagtaaataccttaagatatttactgtatttttcaaataaaatgattaattctactaccaaataaatcttaatttctagtctacttctagtttgcaagaggagctttaaatgtatttgtttacttaacatttaaaaatccatttctccttaaaatgaaacactttttttaaggtaggtaatattttaatttgactagaagttagtttttctttcttagtttaagctactttgttagtcttacaattttaataagtatagttattacctagtgacatttctgtttgtttttttaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggtatgattgaaatgtttgaagatcatttttcttgtggctaacaagtattttcccctcaaactaaaaatttggtagagttcacaaattaatgagaaattctataagacccacatgaaaatgtattggtactcatagttttattactcttacaaagtactagtttattatgacattatttcaagtcattttttactatataaacaacttatcagaagaaaaatgaataaacaataaaatattgtgaacatcttcattagaatatttttgtcagctttggaggtaggatctagataaaagtttttaggctaacccaaaatatttatcttcagtaatgatatgccttttgctgtgtatgacatctgaaatgtggataatactgaaacgctctcagt

SEQ ID NO: 7937 - DNA, 1053 bp, Homo sapiens
gcccttagtatctagaggattaacctccaagggcgtcccgggcctcgccttggcgtccggcccggcctgggcccttagggtctgcttagctcttccccaagactcgtgccattcccgagggaatctttgtcggcatcctggtcactgtgggggtttgaggtcgtcccggaagacttcagaaccaggcgaacctagacgaaggcggctggaatgaaccaggtctgattgtcgcacaggcgcggccaccaccttgtgcaaaatcgaaggtggttcttcagggccgggcacgctttcacaaaagatggtgatgttaataataacctgccctctttgtgaagattggcaggccttcattgtcataggctgtattcgtagggcctttatgcctgcaaaactgggacttttgagtttgagaaacgatttgtgaaatactgcaatgaattaggagagaaatactacagtgaatgctatgctatgaatgctatacatgtcaataaattgctcatagatgaggtagtacgatttcacggttttccactcggaaatggagaacttaaaatgaaacgacctgataccatatttgcctaacaaataactctaggttatagtgttttaggatgtttcttagttgcatacagcactatcatcgtatatgtacatatttgtgtattcattttgttgaacctaatgtttatacaggattgaaatacgctccctgctgttgtatgcgcatgcagcttttattgtatgttcgctggtgatggtattgctgctgtaacagccttacattttaggtatatcaataccaaatgaatgatacatgagtgtacaataaagtatatatagttacagtctacaaaacaagtttcagtttcattgaaggattttgaagtaatttaaaaaggtagactactattttacaagtggccttagtagacctaagtctttattacattaaaaatttcagaattgggaaggatataaacgggttttgtgtgttgaccttttatgggattaaaagttgttactatcttgatgactgggatgtgttca

SEQ ID NO: 7938 - DNA, 1050 bp, Homo sapiens
acatccctgattatatggcagtattcctggtgggaaagccagaagtagtgaaggatggattttagcatgtcctatgtgcttatttatggtgcagcacatcatcaaacaacacttcacaggctctaagctggcaaactggagggctttgaagagaaataatgagctgagaggttcatgacatgccattaaaaagtttgtgattggatttggaaagtcagatgagtctccaagggaaagggactagttctgagctgttgcacttagaatatttttgagccccagagcagatatttatgagaagggagagttgtttttgtctcaaatccaggttctgactctgatgtgtagtgaggaagccgctttgcactgcagacctgaagtcccggaatatccatgatgtcacctttttctactgatctgcctgccactgcacagaggcacgctattagctctgtgatgttttagcttaattctcccacatgtgggttgcaattctagccaaaacaaagtcggcaggagattttatagccactgaattgctcaaggtgctacaggctcagtgaaatcaggaaattaggttgggatgcatgaacaaaaagataaacagaaagaaaaagcatcaggatggtgggattcgaggttgcctgttacgtgatttccaaatcaggaatcaagccttcggttttgcaatgggtgatttgatgctctgggttttcacctttgagattttaatgcttttctggcatatatgatagaagaaagcaccctgttccaggtggtgaaccagaagtccctctcactaaattagaaaggagacattttaggatatgagatcatgaaatagaatagtatttgaaaagaaaaaaaaatgaaaagaaaaagaaaagaaaatcacatatatgcaataacacacaactagcccagcacagggtgaatttgtggttaagccatttttttcccattgcagatgatactttaactctttgaatctcagagtcctcctgcacacatgcagcatgaaaagacgtttctgcggctgccatcataaag

SEQ ID NO: 7939 - DNA, 1068 bp, Homo sapiens
ttttaaatgctgtacaaaaatacagctgtcaacagagatgaaacatatgactacaaaagcactctcaaggacttggtgtccaataattaatttttctttttttataatgcaatccagtatgcctttgtgtcaaacttcattttctaagaaaagcatctttttgaaacaaactatccctgtagtaaagaggaaaatactaaatcagaaaaataccaactttatagatggactagaaattttagggacttctttgcagtctcaacaatgaaatatagccatgaatgcatatgccttcttaagcttgagtggcttattataatcagactaagttctcataccatgtaattccattgtagtttatgacttaattccgtaagaattataactgaaagagccttgcctaatcaaaataaaatttaattacatattcacattataatctaaagaacaaaggttttagtttaaaatcagctttatctctttgtcctgaatggaaaataaagaattataattttttcctcagttgtgactttcttgccagaactcatgaatgtttctgtattcctctaatgtccagatttagatatttccttatccaaccatttttccttctatatcttctaaccctttgtgttagtttgctagggctgccataacaaaatggcacagactggatagcttaaacaacagaaatttattttctcacggttctggagctagaagtccaagatcaaggtgatggcaggttggtttcatctgaggcttctctctgtggcttgcagatggttgccttctcgctgtgtccttacaaggtctttattttgtgttgtgcatccttggtgtatttcttagtgtccacatttcctgtcctcttaaggacaccagtcaaattggattagggcccaccctaaaggcttcactttatcctaatcacctttctaaatgctctatctcctaatacagtcacattctgagacaccaggggttagggcttcaacacatgaacttaagggagacacaattcagcccatattgccctctatgtttcactcccactctctctccatc

SEQ ID NO: 7940 - DNA, 1066 bp, Homo sapiens
cagcaaacattgatttagcctgttgtccttttttaaaaatgttagttaattgccatcattttaaatgaagggatttttgcacaaaggttacaatttctaccttctcataaaaagtggaagatctggcaactctgaactagcattacaacaacagatggggctgagtggtggccaatcccttgcaggagacctaggtcctctgtttatcagaagtaccacttggccttttcagtcatccttgccccaataggcatctgaatttgcaaaacttgtcttagattttggaatatagattactgatgcatggcaaaaatatcatataaagggtgtgcacacagagaagttaagaagttaagaagtagaaaggcaaatcaatgcagccattataatcctgtcatttatattttctaaggcaccatcagtaaacactaaggtttgtgattttcactgaataataaagcctagtaccttttcattgaaacctagcaaacaccatcagagaataaggacaaagggaagactgcatagaatgtcagaactagaagaaaactgagaggtgaattagcacaaagtcttcattttaggaaagattattgagattcagagatgtaaagatcttgtcctctttcataatagcatcttgatggcaaagtcaggactgtggatctctacactgagggtctctctcttactctgtggctattcttgcctaagttatgtcttcctctgatgtgtataaatcagccagtttaagaaaagcatcacactcttctaagtgcacattgcatatgtgtaacagctgacactgatgaagaaacagagatgagcagtgacatcccagacagttggcaaggtgtcactcatactatatcaagaggatggaaagtgaaagaattaaaggatacttaaaagtctcttcacattttctacatagtacacaaaccttttctataatagccctgaggtcatcttgcatccacttacttaattcaatggacaaaacactcactatcccataaggcaatctgtcctctgtgttgctaggttgttagaaactttaacttat

SEQ ID NO: 7941 - DNA, 1032 bp, Homo sapiens
catgtgaagagaccaccaaacaggctttgtgtgagcaataaagctttttaatcacctgggtgcaggcgagctgagtccaaaaagagagtcagtgaagggagatgggatgggctgtttttataagatttgggtagatagtggaaaattacagtcaaaggcggatgttctctggctggcaggggtggggggcacaaggtgctcagtgggggagcttttgagccaggaagagctgggagaaggaatttcacaaggtaatgtcatcagttaaggcagggacaggccattttcacttcttttgtgattcttcagttacttcaggtcatccggatttatacgtgcaggtcacagggtatatgatggcttagcttgggctcagaggcctgacatatagcgtatacaggtgtacacagaagcataatgtttaaatattttaatttcagtgggtgatataaggggcagtatgattttttttcgcttatacttgctggcatttttccaaagtttctttagtgtgcctatagtattcatatcctgagaaaaatctttcatgattctaatctttttattattattattttttaaagatcactgagaactaagagcaaaatgcaaagggagatctttttgaggtctgatcaagcccagcttcactggaggcttttaggggcctcagaggtgtagatgctggtttagtgcctgactgtggctccttagaaaagaaccagctaaatgcagcctgtcctttgctagagctgccaatgctgagctctgacacagagaaaccctgcctctatgatgaatatagcctcatgctcctgactttcaaatgaaaaacagaaacacacatgcttgttaagaacgtttcagcctggtttgcatcattaactgatgaaaatgtgcctgcaaggacagaatgaaatagatttgcccctcctcctccagcaacccctcctatgagggacgttcgtctctggctccaggctctggccacttcctggttaggattgctaaaggcttccatcagggaatgtt

SEQ ID NO: 7942 - DNA, 1050 bp, Homo sapiens
tctggggagggaagaagagctagaaagtgagttcagtcaccagtggccaatgattcaatcagtcatcaaaatcttacctatatattgtgaacctccataaaaacccctcaagcagcaatccccaacctttttggcaccagggactggttttgtggaagtcagtttttccacagactgggcagggatggtttcaggatgattcaagcacattacatttattgtgcactttatttctattattattacattgtaatataaacgaaataattatacaactcactataatgtagaatcagtgggagccctgagcttgttttcctgcaactagacggtcccatctgggggtgatgggagacagtggcagatcagcaggcattagattctcataaggaatgcgcaacctaggttcatcggatgcagagttcacaatagggttcgtgctcttttgagaatctaatgcctctgttgatctgacaggaggcggaactcagacagtaatgtgagtgatggggaatggctgttaatacagaggaagctttgattgctcgcctgctgctcacctcctgctgtatagcccagttcctaacaggcctcggactactaccagtctgtagcccagggattggggacacctgctttaaaggatggggttctgagaggttttgagttggtgaacacattgaggtgctggaagagtagcatcccaagcaaaaacatggaagctccatgcccacccttcctccccctactcaccccataccttgccctatgcaactcttccatttggttgttccttagttgtgttacaggaaaggggtcccaatacagactcaaaaagggggttcttggagctcacacaagaaagaaatcagggcaagtccacagagtaaagtgaaagcaagtttattaagaaagtaaaggaataaaagaaagcctactccataggcagagcagcagcatgggcttttcaactgtgtatacttaaagttatttcttgattatatgctacacaggggatggattattcatgagtattctgggaaaaaggca

SEQ ID NO: 7943 - DNA, 1138 bp, Homo sapiens
tggcttcatatgctggctagagcaatttccagccaagtaactattctgtacttatgagtcctatttgtagaatggagataatgatagtatttatcacactgggtttggtgaggattaataaacttatatgtgtcaagcacttagagcatattatatgctatataagagtttcttattttaatattaagataattaggacagaggtcagttagaaatgcagaaccttaggaaacattgacttcaggaccttactctgcatgtaatgcaacaaattaagaccacatgaaacagataatatttgacccgggttttttttttttcattttttttttacttggaaataattacagattcacggaaagttgcaaagacagtacagagatccagtgtatccttcacccactttctccaatgattatatcttacacaactataatacagtagctcaaaactagaaaattgacattggtacaacaatgcttttgtatagtgctatgtcatttttttcacgtaagcctatgagaccaccactttgataaagaaacgaaactcctcttcactaccacatctccctcatattacccctttatggtcacatctgtcacctcctcacctgtactcccctaacccttggtaaccactaatttgttcttcatctctgtaattttgtcatttcaagaatgtcatataggctgggtgcggtggctcacacctgtaatcccagaactttgggaggccgaggcaggtggatcatttgaggtcaggagtttgagaccagctgaccaacatggtgaaatcctgtctctactaaaaatacaaaaaaaaaattaggtgggcatggtggtgcatgcctgtagtcccagctacttcggaggctgaggcaggagaatcgcttgagtctgagaggcagaggttgcagtgagctgagatcgcgccactgcactctggcctaggtaacagagagaaactcagtctcaaaaaaaaaaaaaaagtcatctaaatggagactttcatataaaaggatagttcaatatacaaaaattaatcaatgtaatataccacattaacagaatgaagggaataaatacatgaccatctcaattgatgcaggaaaagcatttgacaaaattcaacaccc

SEQ ID NO: 7944 - DNA, 1031 bp, Homo sapiens
gtaaggcttggactaatttaagtgcctttgcaagagctactgagggaagtttagggttttctctcatgaaatatagctttaaagtcagacagatttggtattgagccctggtacaagacctgtgaccctgcaagggtaatttactttattaccttccatttctcatatgtgaaataatagtcagtgttttgccatgacaaagataaagatgaaatagttataatactaacaaccctggcacacacttagcacacatgtaccagacatagttctaagcatttacatatgtgaatgtatttaatatatataagtaggtgtccaataaattatagttgttattattctgccatgttttgtgacacacaatttaggttttaaatttctcttttatcgatattagtggcattcctagaattattaaaaacaatacatatttggctaaggttcagagatcatcgttttgtattgttttcgtagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgtt

SEQ ID NO: 7945 - DNA, 1085 bp, Homo sapiens
taaaatgagtaatcattaatgaaagctttcttcaaccattttattataccttaaaatgtgtaaatgtgcacttacttaccaatcttttgatgtgagaccaacgcctatttttgagcatggtttctccgattggagtcctgtagttatctttctttcataatctacaatattatgcacctcctttgatttccagtttgtttccttaaagtggattaagaagataaagatacttatgaagtaaattggttgcagaatgtttacaggtttttctctctctctttcacgttgtggcatccacctaagtagacagcaattatttctgactacctttttcaatatttctcaagaatttaactgaattttcatagaactgaccattaatttgtgctctttttattgatttaggtggtatatagttaaactagattattacattacaatcaacctgtcataaacaaatttaaggataaacacagctgactcttggcaagtaagcaattcagctggtaagaacagaagtgcttgggctactaagagtagcttattggccttgagaggtcagtgtacctgaccattagtgaacctctttacaaaggaaatggagagtgtcagtaaattcagagtcccttattggagtttcttttttttttttgagacagagtctccctctgtcacccaggctggagtgcagtggcgcaatcttggctcactgctacctccacctcccaggttcaagcaattctcgagcctcagcctcccaagtagctgggattacagacgtgcgccaccacacctggctaattttcatatttttagtagagggtttcaccatgttggccaggatggtctcgaactcctgacctcaggtaatccacccgcctcagcctcctaaagtgctgggattacaggcgtgagccaccccggcccccttacttggagtttctaccataatataaaccaaaaagtgggggcccttctctcttccacctcctctgtcacctcctttaaaatcaatgctgcagtgctgcaatgagctatcactggaggtatctaatctcttgtatacactgcagcagaaaaacatt

SEQ ID NO: 7946 - DNA, 1009 bp, Homo sapiens
accactcatagatggcccctttcgtcatttgatggagggtggaaaaagctatctggggttggggcccagcagcctgcattttaaccaaccctccaggtgattctgatgcacttaaagtttgagaaccccactgtacccctacttacttaagtaactttggtattagaaataacattgctagtttttcagagttgtagttggaaaattttctctactttacctcttcccctacttgttagtcttaggaacaggagtaggtaacttaacccactgacccacagtgatgcattttatctgcaaaataggtaatagtgatagcttccttgcttaaagtcccacagccaggatctatacagtctttgattagcttccattatttacagagtttgagtcttaggacaagctttgttttgttgtttttaagtttgaggagtggcttaaatttaacctaataatttaggaattggcagaactgatactctccaaaagtgctaaggagagttacaagcagagggatgctacagccagcacctactgggttaaaagagtccatgtatgcatctcttcccaattatgtgtttattgacatcacattggtagcttgaaattggtcatggtcgggggtgattatacgatggaaattagtaaatgctataaactagggcttttagtttcagagagctggttgttaaacatttaccagcatatcttagttacaaagtatgttcaaatgacctgaagcttcatttgcatatttgctggatctagcagttcagatttctgatcatttaaggctcattataggatcagcattaggatatatatagataaaattggtaatatgggaatcagattcagcccacagacatgttttgttggtctgcaatgtatttttttaatgttaaattacctgtcagcccttaaaaattggaagatttaacataaaaatttggatttctggctcttgaaaaatagggtcatctggtaacactgggccctcaacatcaca

SEQ ID NO: 7947 - DNA, 1048 bp, Homo sapiens
agaggccgggcgcagtggctcaggcctgtaattccagcacttcggaaggccgaggcgggcggatcacgaggtcaggagatcgagaccatcctggctaacacagtgaaactcagtctctactaaaaatacaaaaaattagccgggcgaggtgacgggtgcctgtagtctcagctactcgggaggctgaggcaggagaaaggtgtgaacccgggaggcagagcttgcagtacaccaagatcgcgccgctgcactccagcctgggtgacagagcgagactccgtctcaaaaaaaaaaacaaaaaaactgcacattagagatcacctaatgtttgagggagttctctgagcctcaattttgtaatctgtaaaatgggaataataatagtgccaacttcattgggttatgagaactgaattaaataatgcatggaaagctgctagcacagcgcctgacacatagtatgtcctaaatgttaattgatataatgttgctgctgctgctggattaactcatttttcacagtcgttggaataaacttcttctgaattcttataaataaactatttattggcaagtttgtagctctaaagtcttaacgtttggccggtatatatctgtccacatcagattgcataagataatatataccacttcagcacacgtgtaccacactcaattaaattttagtcaaggcttagacatattttcttggcaaaccctctcaccctcaccctggcttaggtcagttacataacaagtaaatgggtaacctgtcaagtcctggtaatgctgtcttagagttttagcactaatcaaaaggtttggatgttttttgtttgatttttatatgtgttgcaagcaaagtgagttgttaggtatttttagtattcagcaagaagctgaaacattttcagtaaatcttttcaaactactgaatcagttttgattcaggaaatccctgagtttgcaagggaagctgttcaaaagaacagttatgatttgcagctgctgtctctgaatcaaacttttcttcaaattgtgtaatcca

SEQ ID NO: 7948 - DNA, 1072 bp, Homo sapiens
cagaggctgttcattaggacaatggaagaatgactctgaaggcattttggaaattactggtgctgtccctcccatcacaggcacagggtgccatgacctcggagaaggaaatacagtcatgccccacatatagaccttttcaccaaggaaggagcacatatacaaaggtagtcctataagattataatggaactgaaaaattcttattgcccagtggtatcataaccattgaacatcataactcaatgtgttgctcatctgtttttgatgatgatggtataaacctactggctgctagtcatataaaaatatagcacacacaattatgtataatacataataccttctagtgggacaagatgtgggtgtggaagaccgtgatattgatgaccctgactttgtgtagacctaggttaatgtgtgtgtttgcatctttgtttttaacaaataagtttaaaaagtaaaaaaaaaaactaaaaaattttaaaaatagaaaaaagcttgtagaatgagaatataaagaaaatatttttgtacacctatacaatatgtttgtgttttaagccaagtgttattacaagagtcaaaaaatttttaaaattagaaagtttataaagtaaaactgttatagtaagctaagtataattgattactgaagaaataaatttctttttataaatttagagtagcctaagtgaacaatgtttgtaaagtctacagtgtgtacagtgatgtcctaggccttcacatttactcaccactcactcacccagagcaactgtcagtcctggaagctcttgtatgtgccctatacaggtatgccacgttttgtcttttagactgtacttttactgtaccttttctatgtttaggtatgtttagatacacaaatactaaccattgttacaattgcctatagtactaagcacagtaacatgctgtacaggtttacagcttaggaacaatagggtttaccatatagcctaggtctgtagtaggctatagcgtctagggttgtgtaagtacactctatgctgtttgcacaatgacagaattgcctaatgacacttct

SEQ ID NO: 7949 - DNA, 1021 bp, Homo sapiens
gataggggctgtcattctcttccttttacaaatgaggaaactgagggctcaggactcagggtaaaactatttaagattttgactttgctgggcagggccctagtgggttccatgaagcaagtgtgggtagggttctgtggtgtaaagagctttgttgccaccaggcctggattcaggtccgcatttcctacttactagcaatgaagccttaggtgagattcttaacttcctcaaggctcactgttgaatagagataatggtggccatcttatcagttgtagtaagaacccaatgtggaaaatgtatatcaagtatagtaccatgcctggaccctagtacatgcatagtaaaagatatcttactatttaccacggtttgaatgtgtcccccagaactcatgtgttggaaatgtaatctccaatgcaacagtgttagaaggtggggcttaatgggggatgtttaggtcatgagggcttcaccctcatgtatgggttaatgccaattgtaaaaggacttgaggctgcaagttcaatctcttgccctttctcaagcatgctcttttgcctttctgccatgggatgatgcagcaagaaggccttcaccagatgcagtccctcgatcttggacttctcagcctccagaactgtaagccaaataaatttctgttcattattaattacccagtcacaggtattctattatagcaacacaaactggacaaagacagaaaactggtactgagaaatggggctgttgctataacaaatacctgaaaatgtgaaagcggttttggaactgggtaacaggtagaggctggaagaatgtggggaagcaggctatgaaaagcctatgttgctatgaaaagcctatgttgctatgaacagagcattaaatgtggttctggtgaaggctgagaagaggaggagagctgtagtaaaagtctaaatctccttagagattacttatgtgatggtgatgagaatgttggtagaaataagagcaataaaggcaattctgatga

SEQ ID NO: 7950 - DNA, 1033 bp, Homo sapiens
atcattgtttaactgtctgctatctgtgttgacacaatctgtgtttctgggtgaattttccttaattactaacacagataaaatttgctttagttagctgtggtccctggacagtctgttttagaaggctctgcttagtgaaagagaatgacattgatatttcagagcttaacatttattgttagattctttttatcatgctcaaaaattaaaccaagttttgagcataattttaaaaatcctttaaaaatctaagacttgcttatggcattaattacaaagtcatcacttagagaccagatcgtgtcctcaattggtcaagggctgattctacaagcaacagaagtaaagatgatggcaattagctgaaaattagactcccagataaatatctgaataagaaatccctaaaatgaagtcaaagatttatataatttttaaaaaatgtttttgctcaaactgttcacatgtttatctcagaccttgcagatttagtttagacacaaccagaatgcttgtcagtagaactcaccatatttttgaaatacgaatttcttttttagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattgtaagggctttttttttggtttccagtaatacatgtccagtgttgtgctacaggggagcaaatatctgtggagggtttgattgaatgctggcaagctcacggtaactctcatgctatatatatatatatatatatatatttatttattttggctttagacggaacctgtggatgtgcctacgtttctgaaggctgctctggagaataaactgccagtagtagaaaaattcttgtcagacaagaacaatccagatgtttgtgatgaggtaagactcatgcaaagcactgcaaaatccagctcattaattttatgtttcttatgctttactcca

SEQ ID NO: 7951 - DNA, 1026 bp, Homo sapiens
caaacaccttgaaaggattatcagaggagtttcctgcttcctgctccttatgatttatttatagcacgactacaatttctctatatcctgaaatacaacagagtgattttgctataaatttaaaaaccatattaccaaactaaagtatgcttatgtggggatccattctttacgttattgctcaggtaatgtggtcatccacttaaaacttgaaaaatgaaaatcgaaaagaatggtaagaataaggaatctggaaataaaggccaatttaattcttcagtttttaattctgtcccatgtgtctgtcattctggtgtttcctcctccccctgtttgtatatgagtgggatctgtagcacttttcattcacacctctttggttacaaaagcagtccagatccttttcccagctatttaagaccttcccaatctggcttcaattttttccaactttgcttttttctgctttccttctgaaccccatattttaaccaaacagaaatatctatgctctcatcttgattcctttcttccttccttcctttttctttttttcttttttctttctttcttttttttttttttttttttttttttgagacagagtcttgctcttttgcctaggctggagtgcagtggtgcgatctcagcacactgcaacctctgccttctgagttcaagtgattcacctgccttagtctcccaggtagctgggattacaggcatgtgtcaccacacctggctaatttttgtatttttagtagagacggggtttcaccatgttggccaggctggtctcgaactcctcacctcaggtgatccacccgccttggactcccaaagtgctaggattacaagcgtgagccaccgcacctggcctcccatctcaatttctaattcctacccttaaagactccttacaaatgccatctctttcatgaatccttccctgatcaccacatcatgtatcgtgaatgttacctattatcgtagctatctccatccctatctagagccatcttttta

SEQ ID NO: 7952 - DNA, 1085 bp, Homo sapiens
cctgccttagcctcccgagtagcggggactacaggtgcatgccaccacacccagctaatttttttgtatttttagtagagatggggtttcaccacgttggccaggatggtctttatctcttgacctcttgatccgactgcctcggcctcccaaagtgttgggattacaggcgtgagccacggtgcccagcctggagtttcttataaaatcttttgttgctcactttcatccagagacctgctgaagtcaaagaggtcaaagaattagagagaataccaagaaaggtaaaaagtgttctgcttttcaccaattagtgatactttcaatctgcaaaacactgcctaaggctcttgttttactgcatcataaggaagtttaggttggaagtaatcagcgtacgatagagaataataatttgaaaactaccaagcttcctttcagtttcatctttccaagctgaaaagttctaggagcttatggaaagggtcaaaaaggatccatgtaggtatgtttaacttctggaggacaaaaagggtacccctttacatttgggaaactaagtagttataggaacatgtaaaaactttatttgatatagtggttgtaaactacataattctttaccgtaaatggtagacacaggaaagaaaagaagtcaaataaggatcagctaaatttgggtttgcatgatttccttgataaccctttattattattctagaaatatttagggaatattgctaactttttagatagcacaccctcctctaaatattccttggttaaagtttgaaaagatcctccatatatgcgatttccttaagttctgatgggcagtgattttgaagtcttgatgggcttttaggtagactttccagtgactggctaatcattgttatatttgaataccccagaaaaggatgaaagctggtttagagtaaatcacatatagttttcatagatattaatattttttgataatgaatccaaataaggtcttgattatccaaaaacgatggtgagaacattgagatagctagttgaaatgagaatatactttctccctactgagtgaaagccttgtt

SEQ ID NO: 7953 - DNA, 1023 bp, Homo sapiens
tgcatttggaatcctcagctgaaccgggataattcatttaagtccatgtatatatactgcaaggagctgtgagagttagtaaagcagtcttcaaaaattgcttcagaaaactgcatataaaggacttctattttattacagcataatccccttcctagtataggaagtatcaccacacaggcttaggggcagctagtgaccctttgcagtctctgaggccaaatcacaagaaaaatatcttaaagtacataaatgttttgggttaaatataaggcagaaagtctcaaagttagcaatattaggacttcctgtttttacagcctgtgtaaattcaggatagatgttggtatttaattcataattacagatagttctttttatgggttataggactttttagataccttaagatatttaaaaatactgtaatgcaaattacctatggaaatatccattatacttgggttaagatctaaatttccgaaaactgtgaagaggtagccatggggatgcccatcttgtatgaaccattatgtctttcaaaattgtgagaaattcaatcccctccggttctctctaggcccatattatagtgtgaatgactgtgaacacctgatgctcatttcctcaagccacaccagaaatctctttcatcattttcttgtcacactcatgattttcttctgctttcctcattttccagtgaaaagaaagtagtcaataggttataaagaaaagaaggggtttttggggaaagtgagtttattttttttttattttttattttttttattttttatttttttgagacagtggagtgcagtggcacaatcttggctcactgaaacttcctcctcctaggttcaaatgattattctgcctcagccttccaagtagctgggattacaggtgcccgccacctcgccctgctggtttttgtatttttaatagagatgggatttcatcatgttggccaggctgttctcagactcctgacctctagtgatctgcccacctcggcct

SEQ ID NO: 7954 - DNA, 1022 bp, Homo sapiens
aactctgcctccccggttcaagagattctcctgcctcagcctcgtgagtagctgggattacaggtgcgtgctaccatgcccagctaatttttatatttttagtagagacggggtttaccatattggtcaggctggtcttgaactcttgacctcgtgatctgccacctcgccctcccaaagtgctgggattacaggcatgagccactgtgcccggcctattatccttgttatattgacaaataaattgaggttcagtgcatttacactgtttgcttaagatcacagccagtaattggcaaagttgcctccagagcccatggctcctactcccttgactattctgtctctaggacatcgcttaatagtgcagtgtagatgtaagaagctggactgaatctgtacttgaccctatgagataccctggaagctgtgtttttaaaaaattttgtatttgtagaaatgcagaaagaaaaaaatacagtgactgtaagtatgccaccatgaagattcatcggttataattttttctgttttttactttacatattttactttacatattttttaatattatgaaatcaaagtcccaaaataggaagtgacttacccaggttctggttgataatttgtcacagaagcaggctttagcagcagattgcctggattcaaatttaatttggaaaaaaaaatcaaattattccatactttctgtctgtatctctgcctttatccttctcctttttttttttttttttttgagacaaagtctcactctgttccccaagctggagtacagtggtatgatctcggcttactgcaacctccatctctgggttcaagcgattctcctgcctcagcctcccaagtagctgggactacaggcacgtgccaccatgcctggctgatttttgtatttttaatagagacggggtttcactatgttggccaggctggtcctgaactcctgactttggatctgcccgcatctgcctcccaaagtgctgggattaccggcatgagcc

SEQ ID NO: 7955 - DNA, 1049 bp, Homo sapiens
acagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggtaatactctgctgcacctacacactccttccctctgccccgctccttttgccacttctctgacttttaatcatccacccgcttatatttaaaaagggcagcaatgtccagctcctctttccccttccgaagcctccagttctttagggctgttccattatcagaggatgaggttgggagaacattgtgattactggaggaatcgtattcgtcccttcagggtagaagaagcctttttcttttagtttattttctccttcatggtgtttgtacctcttattttgacttcctttgacaagtaaagctgcaagtgtgtggcaaggtgccggcatagtcccaggatgagtaggctgagattcctatcattttgagtagctacacatttcaggttatgcaatcctgagctcagggtgccgcctgcaagcggtccacacccaaaccaccctgactttactcttaaagaggttaacaacccttgagtggtgctatttcagacggttgcgtatgctcagttaaactaatgtgaacacatgtgtttatgtctcgctaaggtgctagaatcattaataac

SEQ ID NO: 7956 - DNA, 1006 bp, Homo sapiens
ctggccaacatgtcaaaatcctgtctctactaaaaatacaaaaattagccaggtgtggtggcgggtgcctttaatcccagctactcaggaggctgaggcaggataattgcatgaacccgggaggtggaggttgcagtgagccgagatggtacaccattgcactccagcctgggtgacagagcgagacttggtttcagaaaaaaaaaaaggaaagaaaaaaatacatatattaggatgttaaaagggacttaatattatttggcatattgaaagagttgagaggccgggcacgataactcacgcttgtaatcccagcactttggtaggctgaggttggcgaatcatctgaggtcaggagtgtgagaccagcctggccaacatggcgaaaccccatctctatcaaaaatacaaaaattagctgggcatggtggtgggcgcctgtgatcccagctactcagggggctgaggcaggagaatcgcttgaacctaggaggcagaggttgcagtgagctgagattgtgccactgcactccatcctgggtgacaagagtgaaactccatctcaaaaaaaaaaaaaaaaaagagttgaggtccttttctacattattacattatcaggaaccggattctgtttttttatactatttatacattgtttttatgtagaagctaatttctagtggaagtatacactgctgcaagctttctaaagcaatttgttggcaaggtggttcacccctgtaatcctagcacttgggaggccaaggcaggaggattgcctgagcccaggagtttgaaaccagcctgggcaacatggcaaaactctatctatactaaaaatacaaaaaattagctgggtgtggtggcccaagcctgtaatcccagctacttgggggactgaggcaggaggatcacttgagcctgcgaggttgaggctgcagtgagctctgatggtaccactgcactccaacctgggagacagaggccctgccttaaaaaaaaaata

SEQ ID NO: 7957 - DNA, 1052 bp, Homo sapiens
tttttgtatttttagtggagatggggtttcaccatgttggcctggctgggctcgaactcctgacctcaggtgatccaccccacctcagcctcccaaagtgccgggattacaggcgtcagccaccacgcccggcctacaggtaacatttaatgataaaatattgaacactttcccccttagatctgcaccaagataccacttctcttcaagtagtaaggcataaacattggaaaggatgaagtaaaactgttcacggactacatgatcacatacgtagagaatactaaaaatcctaccactaataacaatgaacaaggtgcaggatataactcaacattaacaattcaattgtctatatactagcaacaaaattaaaatagaatttttgatcacatcaaaatataaggaatttaggggtaaatttctaaaaatgtgtgaaacctgtacactgaaaacttcaaagcattgctaagagaaaaatttaaagatctaagaggatgtttgctcacatttatggattggaaggtgatggacaggaggaaaaatatttatttctcacttgtcttgggatcgtaactgaggtcctatgatactgtaatgtaataagatatgccaggctcagtggctcatgcctttaatcctagcattttgagaggccaaggtgggaggatcacttgaagccaggaatttgagaccagcctgggcaacatagcgagacccccactgccatcactacaaaaaaataaaatttagccaggcctggtggtgcaaacctgtagtcctagctaattgggaggctgaggcaggaggatcccttgagcccaggaattcagggttaaagtgagctatgatcacaccactgcactctagcctggacgacagaccgagaccctgtctcaaaaataaaatcaactgggcacattgactcatgcctgtaatctcaacactgggaggctaaggtggttgaattgcttgagtccaggagtttcagaccagcctgggcaacatggtgaaaccccatctctacaaaaaatacaaaaattagccaggtg

SEQ ID NO: 7958 - DNA, 1972 bp, Homo sapiens
aaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacctctcaacatcccagtttgaccagatttcttgctttcattgttcataatgcagaaagcagtgaattatattaacattttaaaagtgtttctgggtaacaatgatttttgtcaaatagaagactcaatttcacaaccttaagaatagatcacttttgtaaaacaagaatctcagtatttgatgttggactccttgctgtgagtattgtcactgactccaaacccagaaagatttgttcctgcccttacagggatgaaaataaaaaggatagaaaaaatatttctctcctctacaatgagtccttaca

SEQ ID NO: 7959 - DNA, 1049 bp, Homo sapiens
tatgcttagtaccctgatgtgatcactatacattatatgtatatataataacattatatactctatgaatatctacaattattatttgtcaattaaaaataaaatgtaaaaaaacagtggtggctttgaagtggtttttgcattcaggcaggttagccacatttactgttttcaatctggacctacaccagttaattattactacttttagatttctgcagaagggctgggttgcacatacctgtaatcctagtacttttgggaggcggagaaaggaggatcgcttgatcccaggagtttgagaccaccctgggcaatatagtgagactctgtctctacaaaaaataataaaactattagctggatatggtggcttacacctgtggtcccacttactcaagaggctgtggttgagaggattgcttgagcccgggaagttgaggctgcagtgagccatgattacgccactgtgctccagcttggatgacagagcaagactctgtctctgcctccaaaaaaaaatttttttttctgcagactaaatgctctgacccaagtactaaccttgttaatattgaaggatttttatttggtgtttttttttttaaagacggagtctgctctgttgcccaggctggagtgcagtggtgcaatctcagctcattgcaacctccacctcccaggttcaagcagttttcctgcctcagcctcccgagtagctgggattacaggtgtataccaccacacctggcaaactttttgtatttttagtagggacagggtttcaccatgttggccaggctggtcttgaactcctgacctccggtgatccgcctgccttggcctcccagcatgctgggattacaggcatgagccaccgcgaccggccaatattgaagttttaagaaaaagttagctgaacttcaaagtcttaacacacaatgttcaggtttttttttttttcctgctttagcatccttagatcagttcagttaaaaattggaaaatgtgaaagcctaaagagtcatcttttgttgtttttttcccta

SEQ ID NO: 7960 - DNA, 1031 bp, Homo sapiens
ttgttgcccaggctggagtataatggcatgatctcggctcactgtaacttccgcctcccaagttcaagtgattctcctgccttagcctcccaagtagctgggattacaggcacccgccaccacatccagctgattttttgtatttttagtagagacagggtttcaccatgttagccaggctggcctcgaactcttgacctcaggggagccacctgcctcggcctcccaaagtgctgggattagaggcatgagccaccacgccggacccgtttttctttaaaaatgacattttaaagagttttatattagcttatgcaaagagaaagttcatttacctcagctgttttttatgtattgtttatcttatcttatcttatttatttatttatttatggagacagggtctctctgttgcccaggctggagtgcagtggtgggatcatagctcactgcagcctcaaactcctgggttcaaaccatcttctggcctcagcctcctaagtagctggattacagacgcacaccacacccagctagtttgtttttaattttttgtagagatgggatcttgctatgttgcctgggctggtctagaactcctggcctcaagtgatcctcccccttcagcctctcaagtagctggaattataggtgtgagctaccatatccgacttttgctgtttgttttaaataggccttcccagagcaaactaacgagaacattaaaccatttatatctcttcccagagtttcaaggtagtttcaagtgactaaagccattcttagcatagcatgagtgaagtggagaggcaagataagtagcttatttgttcatccttggccatgttggttatccatggttgcatattaaattattccaaaatttagcagcttaaaaccacaacatttaagttaggccagatgcagtggctcacgcctgtaatcccagcactttgggaggctgaggcgagtggatcatgaggtcaggagttcgagaccagcctgaccaaaatggtgaagccccgtctcta

SEQ ID NO: 7961 - DNA, 1120 bp, Homo sapiens
aagaaccagggtgtaaaatggattcagggagtgaggacagtaaaaaaaaagcatactctgtaatgctatgtgcttgcttcaggtaggtgggtttagaatgttaaaatatcacttgctgtttagaacccagtcctgggattaggtgccaaagctgggtgtttttttttttttttaatctatgttgtatttgagattaaacacatgatttcagtaaacatttaataggcaagtaacaatggcaatagatgaatcaaacctgatccctgtcctcagaatgttcttggtttagtggaaatgacagaataagaatctaaaaaataaagtgtctcaattctctgatccatacacatcactctcccattgtgactgacttcctgtgctgaaccagagagagatgtctttacagtatagaggtatgaggaggaaactggatctcttggaggattaaaagataatccactccttcttttgacgggaggagagaggaagagtaaccatgtggaaggatctctgtcacaagggaacaaaaagtttttctgttcttgcctggagctgtctccctagttgtggaagcactaattatctgaacacttgccacataggtaatcatcaagtacagacactgaggttgccaaaccttgatgatatgaaggtgagtgggactcagttccctgatgtctggggagctcacagtttagtggggtagacagactgtgcaatagtgtttagctcccttacctttaaaaagtgacactgtgaatttatgcttttagggtagaaatacgcaagaggaaagatacacctggtagaaccttgctcagggtgttgctgtcaccagtactgcaggcccacaaacctttattgactgctcaccttgtttcaagtcatatgtcccatctgcaaaaagatgtctctgacatctcttgctacaatattccttctccattcctaaattcacttgtcatataataggcagccactgatctgccttttatttggctctggacattttggagtccttcatacatgtcaaaaaaattgaggcaaaagtaggtatattttataaataaaatgcaaatgcctacacttaaaggcacaaaagagaattttacaccatata

SEQ ID NO: 7962 - DNA, 1059 bp, Homo sapiens
tttcagagaacatataaaattataatgggttataactatcaagttgacctttccctgagaacatactattggagaaacctgtggtttctaagacgtttctaaaacttaaaactcattccttcccagtataagaaatatattgctggcttcagaattttccaggaaaataaattttattcccttgaaaatcagtattcatatacattagtgctgagtttgtaagctttatttgttctaaacagaatttaaaatagttgttaaaatgaaaatataaagtagcacttactggattttacaatttaccaacccctcttcgcatccattattacatttcttaggcttcacaaaaccccatgttaatattcagtaattattgtctgatagatgctatgctgagccttaacatggattatttatttatttatgagatggagtcttgctctgtcacccaggctggagtgcagtggcttgatttcggcttactgcaacctccacctcccaggttcaagcgattctcctgcctcggcctccccgagtagctgggactacaggtgaccaccaccatgcctggctaatttttgtatttttagtaggacggggttttgccatgttggccaggctggtctcaagctcctgacctcaggtgatccgcctgcctcagcctcctaaagtgttgtgattacaggtgtcagccaccgcgcctggcagattatttatattttaattctcacagcaatcctgtgaggttggtcctcttattatgcccatttatgaataagtaaactgaggcgtaagagaggttaagaaacctgcctgtgtctcacagctaggaaatgaaggagagtcagggattgagcctttccttgcttttagcacctggacatatatccatattatccctattttacagatgaaataaatgaccccttggagatatttggagacttttccaaggttgcttaattagcacatgatggagtcaggacaagaatccctgaattcctaaatgccaaggcagtgttctctcctagcaggcgtagagtggaagggtcacagtag

SEQ ID NO: 7963 - DNA, 1041 bp, Homo sapiens
ttataggtgatttcagagaggaaaatataatggtgaaagcaaactagattttttttcctctctcaatctctagagattttaacacagaaaaaacttatctaaaataattgtatgcctatttcttccccctcttacttacgtttaaatctagctgtcagtctttaaggaacagtcagatctgtttagttttgtcttgtaggtaagaagcagatgtgctcatagagggttatttttcctctgtagttccagatatgtttttggctttacttaattatatactggcagtatattaacctgccagtagtagcagtttcagtttttttttttttttgtctattaagcaatctccagtatagacaaaagttacatctaccctactctcaaaaaacatgcgtaccccagactctggaaagtcccttcactgcactaattgcaaccaacatccctacatgattctgtgtactgatagtcctttcccatcactgtaatctagcctttgtagagaagaaagaagactgtcagaggaagccctttgcaagagaatttttctgacatttctgttaagattgccagacttttcctgctctggcattcagctcttcagcaggttacaaaaatacttggggtccttccaactttttgtttgtttgttttatgtccttgttattgctgccgtcataggacagcaccggtctcttattttatattagaactttacaggattgttcctcattgggggttgttccctatgggagttgttccctatgttctgagcatgtgtatgtcagacctgcgagttccagatctaccctatctttcaatatcatcagtttgagcagtgtttgggctaacccagtaataattcttacacaacatctcacctcacttattctagcagatacctctgaaatagtgtgaaataaaactctattctaggtcggggcgtagtggctcacacttgtaatcctagcacattgggaggctgaggtggacagacggcttgagctcaggagttcaagaccagcatgggtaacaagttga

SEQ ID NO: 7964 - DNA, 1047 bp, Homo sapiens
tgagggtttaactctgagctttctgttctgttccattaatctgtatggttttttttgagatggagtctttctcccaggctggactgcagtggcactatcttggcttactgcaagctccgcctctcaggttcacaccattctcctgcctcagcctcctgagtagctgggactacaggcgcccgccaccaagcctggctaattttttgtatttttagtagagatggggttgcaccatgttatccaggttgttctcgatctcctgacctcgtgatccacccccctcggcctcccaaagtgctgggattacaggtgtgagccgccgtgcctggcccattaatctgtatgtttatcctgatgccagtaccacactattttgcttacaattgttttgaagtcaggcagtttgagtcttccagctttgttcttctttctcaagacttttttgaccattctgggtcctctgcatttccaaacaagttttaggatcaatttgtcaatttctgcaaaaaaggaggcttaggtgggattttaatctatttggggattactgttatcttaaaaatactgtcttcccatccatgaacatgggagtctttccatttaaagtttaagttttacatttcttttgttaaatttatgcataagttttttttttttttttttgaggcggagtctcactctgtagcccaggtggagtgcaatggcaagatcttggctcactgcaacctccacctcccaggttcaagcaattctcctgtctcagcctccctagtagctgggattacaggcgcccaccaccgtgttcagctaatttttgtttttgtttttgagacagactttcgctctgttgcccaggctggagtgcagtggcgcgatctcagctcactgcaacctccgcctcctgggtccaagcgattctcctgcctcagcctcccgagtagctgggattacaggtacccaccaccacgcccggctaatttttgtagttttagtagagacagggtttcaccatgttggccaggctggtctcgaactcctgacctcagg

SEQ ID NO: 7965 - DNA, 1065 bp, Homo sapiens
caggtgtgtgccaccacacacaactaatttttgtatttttagtagagctgggatttcaccatgatggccaggctggtcttgaactcctgacttcaggtgatctgcccaccttggcctcccaaagtgctcggattacaggcgtgagccactgcgctcggaataactttttaaagtaggactcacaatctgctttctgaagggaaggcatcacactctgcctgacacatagtaggtactcagtacatatttactgcataacttaattgattaatggtcttttttcaaaacaatttttttctgtagagtccttagttttgctatgttgttatcattttttcagtttagcttgaaaatgagagttttcagtttagcttgaaaatctttgaatctttttccctcattgcctattcccaagacccaatcctcctgagtctttcatcctaaagattcctaaagtttcttggagtgatcttgaccctcatcaccatcctagttcaggccatgatcatcttcgtaacatcttacatcagtgagattatctcacctgaacaggttttagaactgacttttccagccttctgtctccctactagttgattcttatcatcacatcagattaataaaccacttttcccaagctgttgtctcgcctaaatatcaccagtggttctgtgctatttcaagatcaagttcaaacttcttgacccagcatgtaagcattctgttggctggcttagcccaacttttcagcctaactcttctccagtcagacttaccaatttgctgtctccttttacatgacctattcattcccaattccgagatgccctttctgtcttttctttatatgactaaatcctttattctttttaggccttgttatacaggtcacacaattactcttcctttttctcaacttaataatttttaaaaacattgtgaaacatctatttgatgtttatatattgcctcttatttttttactctcttatttaatattgtacatgccagagtatataggacaaagaagaaaaaaacacctgtgtaccatctactttaggaaac

SEQ ID NO: 7966 - DNA, 2442 bp, Homo sapiens
tacagaccatatgagcacataagatatgatctctgcctaaaagaacgtaacattttaatgagggagataagactaaggaacatgaaagattagaaaacagtgaagtgcttatctgtaagactataagcaaactagaatattgctaagaattctggttatagctacaatgattgcactattacaagatgatagttaataaatcaatgatgtttccttttcaggacattcatcttcaaagaaatctgaagattctctacttagtaagtaacaagtgtttatttaataaaaatatgcatttgaggtatttgcaatttagatttcccatgaatcgtatcttgctgtgatgtgaattattttttgtttttgttaattatttttgtacatgagaaaaactgtagaaaaaaggccaaaagtgtataggatttattccccaattaagggcattaagaagtttcttattttaagtatagagagcattaaaaatttttccagtaaatacaatggatatatctttcaatttcatgttataaaatgtgaaggaagaaagataaagggatgaggttgaaatggatttaaattaggcctatggttttcactagtttggatcaaaacagattggatttcgttgagtatttgctgcaaattttattattttttccctgcaatattccaaaaagtattcacaatgacttataaaaacatacacaataagtttttttaaggttaaaaaagtcagaataatggaaaaataaggtagaatagcaatgtaaaactacaggtgaaatttatacacacaaatgtattccaaaaagtcctgcataattgcagagatagatcacagatttgtcagtgttcttcctaacaaccaaacctaagagtgaaaccagcaatagaaagattaattgtacccataagataataatgagaactcctggagtgttcagctttttgctggcagttttgagagaagagtcttctatgggtttataaaagggtacatccatttgtgtcataacaaacagtagctttgaatctaaacagtaatataatgttgaattttttaaagacttgtagtaggctcaaggcctaataataaggtgtagttcaatagcatatctaattcattttatactctctggacttatctcatagaaatttagaaacttgagatttctaggcttacttagttattttattttatttttttggagatggagtcatgctctttcacccaggttggagtgcagtggcgcgatctcagctgactgcagcccctgcttcccaggttcaagtgattctcctgcctcagcctcccaagtcgccgggactgcagacacccatcactatgcccagctaatttttgtgtatttagtagagatggggtttcaccatgttggccaggctggtcttgaactcctgaccttgtgatctgcctgcctcggcctcccaaagtgctgggattacaggcgtgagccaccacgcctggtcacttggttatttataaacctaagaattaagaaaaaattttttatgactttaaaataatatttattgtggcaaactcagggaaaaaagtttgatgattattctaaatttcaaaactcaaatataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagtgtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacatt

SEQ ID NO: 7967 - DNA, 1119 bp, Homo sapiens
gttgttactatttccatttttatacatgaagaggaagtagagaagttaagtaactttcccaaggttaagacctaatgagtgacaagagcttcttgagttgggtacaggtatgcatgtttctagactggagtggttttttatttgttgttattttttgttgttgtagtttttgtttgtttgttttgagacaggctcttgttcagttgcccagggtggatggaatgcagtggcatgatcatggctcactgcagcctccacctcccaggttcaagtaatcttcccaagtgtattttttgtttgcttttaatttttagagcatttttaggtttacaacaaaattgagcagaaagcacagaattcccatataccccctgctctcatacatgcataacatcccctactgtcagcatcccacaccagaggggtacatttgttacaatcagtgaacctacgttgatacatcattatttgaagtccatagcttacattagggttcactcttggtattgtacattcaactgctttgacaaatgtgtaatgacgtgtgtctaccattatagtaccatagagaatacttgcactgccctaaaaatcctctgtgctccacctgttcatcccaccctccttcctaatccctggcaactactgatcttgctacttcctccatagttttgccttttctggaatatcatacagttgaaatcatatatatgtagtcttttcagattgggttttttcactttgtaatatgtacttaagtttctccatgtcttcatggtttgatatttcttcttaccactgaataatattaattgtctggatgtaccacagttgtttatccattcacttaatgaagaacatcttggttgcttccaagtttcagcaattagaaataaagttgctgtaaacatctatatttaggttttcatgtggacattagttttcagctcatttgagtaaataccaagaagcatgattgttggagtatactagttactattctaagtgtttcatatgtattatctcatttaaacctctttaaacctctgtgagtaccaaggaagtaggtactcatatttctactttacatatatgaggaagctgaggcaaaaaagagat

SEQ ID NO: 7968 - DNA, 1350 bp, Homo sapiens
acatgaggcccatgggttgggcgagctggatctgtggtttgtgttctctataatcagccttgctttttgtgtatcattaattaccaaaaacttccttatcactatgttacagatagagaaatgaagaaacaaagagataaataattgaatcttattaagattaaggtagtaattgacagaattaggatttgaatcaggaagctaggtgatatgacactagagtccatgcttttgttagtttcatcttccccgtgttataggtattaaaataatgttaaggtattaattaagctatttaaggaaatgtaaaatatctcattaaagatcagtgagtcttcttaaagttaagacttacattctttaaagtatattccagttatgaaaatataaagaattagaaaataacctttgaaaaaagtgaactcttattttcttcttaatatatcaggacagttgaagatgacttactgctccaaaaaccatttcagaaagaaaaacatggaaaggtggcccataaacaagttgcagcagaattgctggataggtatggtatttcagtgtcaattctatttcttggtttaagttgcttcggattaggggatttgattatgttaatttgaatataaacattttgaattttcttaaaaaaatttgttttaacagggaagaagcaagaaatagaaggtttcatctcatagctatggatgctgtatcctttttttatttccagatttttataactagtagaatattttaaaatctgcttttttgttttataaaatcttgtgaagtcaaataggcttttttatttttaaagataagtatttagtgatgtaggattttgccatttatacttttgggtacaattctcttttactaatatataggaaagatttagagacaaaaataataaaacatattactagtactctataaataggtttataaagtacatgaatctgcaaatatattttccaaattgttttttcaagctttcaacatttccttttcctatacttatctttagtctcattttaatttattctcttcctacctggttctttgctatttaaggtctctataaaacttgtatttaaaattaggtctatccagtctgtccctggatctaaggaaaaaataaaaataaaatgaggcctgcctgtggactgtcctcaggcctgccatggctttaatttttaggcatgacttaaagctatctttaagataaaccctgcttcctggttatagccatttgtcaactcagttttttaataagactggctgatgacactaactgctacgctggccatccatactgctgttgagaatattggagaatttaagagatac

SEQ ID NO: 7969 - DNA, 1028 bp, Homo sapiens
ttggtttggtttttttttttttggatgacagattctggagacacctggcatctccgtttttgagtttctccccgctcttgtcagttgattcgtaggcctgaagtgagtgagagctttttagttcaaccagtgagttaagataggtatgggtcggatggagcggccagcgaataaagaaatgggagagtgggagcaagaataggaagtcgtgtcctggggcgagggaaaagatgatgatgatgatgtaacatttactgggtttcactgtacaagacaccgttaaaaccctttagatgaggcaactcttttaatctccattcgtatgaggtcagccatcttactagcctctttttataaatgaggacactgaggcttggagaggttaaggaacaggcccaaagaaagacaaatggaaagtgcagagccaagcagtgaaatctagtaggctgatcctagaatatatctctaaacacactacagctgtcccccatcaagatgtaaagaacgtgaggacataggacaaagagtgagaggacaatatggcttgaacagatgtggtaagacagctggagttgacctaaaaaagggtgtaaaatccaggtgtgtaaggcaataacagatgtaagggagggtagagttggaactcgggctttcaaaccttcatctccaaccttaactagcatcttcctatctaggattttagtggggcagagaagagaggtatatacccacacacctatgtttgaaaatggaattacagactttaaaggttatttaaagatttaaacaacttaaagattatttcatgtagctatcttatttaatagatgaagtccagggagatgaaatgacttattcaaggtagccaggactagaaacatgtcgtttaccctagatccaatgcaatgaagtttagagagttctttcctctttttccagctgcacttgctgtcgttatattagttttaacaatttgatatatcatttaacctggactgttccttccagccatgtaaattagttatgta

SEQ ID NO: 7970 - DNA, 1089 bp, Homo sapiens
acaaaacaaaacaaaacaaacaaacgaacaaaccaaaccaagctatgcaggctgcaggagtgaaagtcagcagtgatggacagtaggagcccaggacgtggagtcagaaggataggccggagtccaagagccacacagagaggccgtgtaagggttaatgtcataatgtatgtgaaaggctctgcttaagtgtaaagctgtggtgtaaatgtgcacattagttgacaaatggtttaaatttaagtatacttcaaattttttccctaagattggttgttggtttccatagctaaaaattaagaaaacatattttatacagcaacagagaacttcttaggaattattaaaggactataaatatacaggttttttattctctctacttatagggaatatttgttgcatttgtacacttgattgacccaaatagagaactatcacaaatacaagacaaattttacttttcattgaggagaatattttacaaattacaaaatgacttataacaagaccactataacatgaattatggtgctggggggtgggaggatgtgatttaagggaactgggacctcatggtagctgtgagtacctagggaagggggcaagtgggttccatggtagctgtgcgtacctagggaccagggcagtgagatggagaaaagaagagggggttgtaggggctggaaatgtcaacaaacttcttggctggatttttgtctagggccagtccggcatgttttccaccctaatgatttacatacaactttagtgtctgtctaactttcaaagtatgaggtgtgatgaaaaggaatgaaacttgtgttcgcgtgaggcttatggaatctgaatcgtgggattaagatttcaccttgtaagtccatgtgccagggcaggagggatccagactcatcacccacagcatctgtactgctttgacctgcggctgagtcctcattctttccctgctccttccctggcccttgaggaatctgtggccaagctgcttggggaggctgaggcattaaggcccagacccacctcctctactacagtttccaaaagcacactctgtaatgggtaccgagc

SEQ ID NO: 7971 - DNA, 1034 bp, Homo sapiens
taaggatgaattttcctgcacctttccacttgctttgggcttgaaacacacactcctgatccagaaggacccgctgagaggactttggtgtggtagtcttcttgttggtagtgtctttcaccacctcttccaaaagcacatagtcgcttggattggggttgctcaggatgctgtaggaatatttggctttgcataaggtctgaaaggtaagttatgatcaactgaataaagacacagaatctccaacatttgcattcattctatatgaaactttaaggtggaaaaatggcccagactagagatgaaggggatcttccagatcatttcatccaactcattttgcagttgtatagttgtagcttgtaatgtaatttcccacgttacctcatttagctttgcaacagtctatgaattaggtgttattatcctgaatttcagacgaggaagcttatacttaagacaggttaagtagattccaggatatatacagctataatagtaacaataaaggtctgaaccagattttctgcatgtaccagcgctcacagacatgaaagtcagccagtgaggaatagaatcttgctcttcaggagcgtctctgtcccactgggctatctctatcacagagtcttggatgttgaaagaattttagaagtcaactgatctctcttttcatttaatataagaatgtctttcattgatgcatttgttaattcattaaatgtttagtgagggccaattatgtcccagatactgtgctgtacttttaggggagacaaagataagttaaagaaatgtaagtctgggccctttggaattcaaagtcagttgaataagatggctaatattaactaagttatcatacagtaagaacagcaagtaacccttaagtaatgtttaccatttgctaggcattgtattaaacatcttacatatacttaaccttcaaggaaagtactatcatactatctccatattgtctatgtggtggtctatgtggtgacttaccatgtagtgttttgctggagccaacg

SEQ ID NO: 7972 - DNA, 1086 bp, Homo sapiens
ttcctaaggttaaatctctcagttcttgactctttctgcactgtgtagtcaattgcccatcgtcatagtttgagtggatcatgcagatgactcttaagtctattttaacccggctgtacatcatttctctagttctgtgtaatgtgtttctgctaagatagatcttttggtgtattcactcaacactaatggccttgtcaggatgtgagctagagtaagggttgtggttgtcatgatagcgttccacaattttttgaggtggtatcctatagaacattgctattcggtaaaaatataatgtgaacttacatatataatttaaaattttctattagccacattaaaaagataaaaagaaacaggtgaaattaatttttatatattttactggatttgatttatctgaagtattttaacacaatattaaacattaatgagttgtttggtgttttttcataacatattttcgaacacttatattttacgcttgtgtcttaatttggactagctacattttaagtgcctaacagccacatgtggctagtggctaccattgttgggcagtacaactttaggaatagagttggaaataggactgatggctagaagatatagaaaaggcaagttctgtttatcataagaaattactttctaataactggagctatttggcaatggtatgcatttccttatatggtgatacggtccttgtggttaaaaatcttcagagaggctggtcagagaagggattattcctacattgtgtaggacttgctgtttttatttttgtttttaaatagagacaagctctcaccatattgcccaggctgatcttgaactcctgagtgagtcatcctccagccttggcctcacaaagtgctaggattacaggcgtgagccaccatgctcgacccagctatttgttttttaataactaattcctttatttaaaaaagtttaaaaaataatatatggtcatttaaaaaatttaaataatgcaaaagaatatacaatttaaaattgcaagctccccctcctatatatgtatgtagtctgtctgcgtgccatctgccacctttttttttt

SEQ ID NO: 7973 - DNA, 1025 bp, Homo sapiens
ttcagccttatatatgaagctatattttttgttatgcacatagtctcctcaatcccaatttacggagtctctccgagatttttaattttaatttttatatttaaatatttaaaccatttgacatctttgtatgtgtggtatgagtacagatttaatatctgtgtttaatatatgtaatgaatatatattttatatagtttaatatatattgaatatttatattatgtatatatttgatataatctgacagccagttatttcatcaccattttttttctgctgatataaaatgctgcttaattattgtgttatatctatagtatatttgggtatgtggtacaataataatcagaaagggtataattgataaaagacatgactattcttttttctccacaatattcttatttatttcagtatattactccaggcagtttagaatccatttttcacttccttccctcaaaatagtccacacagagaatctgattagaatcgattcaatgtattgattagtttggatgaattaaaatatttacagaattgatttttttctattcaagaatatcatatcttgccatttatttaagacttcttttatgttcttaagtaaaattttatagttttcttcactgaggtcttagatattttaatttgtctttagtaatacagttttgggtgttaagctgttctaccattttatttctggatttcacagttttcctttggcatcagattcctttttattttcttaaatctgatttcagttgaattgctaaaattataaacattaaatgaaagtaacagagcatatttagcatctttacttagaattgtagagcaatcagataaggcttgaacatgaaactcagccataggaaaaccctttaactttcgtgatgctagagtaaaaactacatcatttgatttggagttatttttcgttggtaggtgatattttgagcacatacagtacctacaaaatattcagagttggtctttctgatacctagaatgacttcagg

SEQ ID NO: 7974 - DNA, 1029 bp, Homo sapiens
aggacacacgtactttaggaaaatccagcaaaaaagaatttcccaaaatagctaaataataaatgtaaactaattttttaaggtctgtatgtttctaactatatgacaaaaatatgattactgatatagtttggaggtgtgtcccctccaaatcttatgttgaaatgtgacctctgatgttggaagtgggcctggtgggaggtgtttagattataggggtggatccctcatgaatggcttggtgccatccttgtggtaacaagtgacttctcactctggtagttcatgtgagagctggttgtttaaaagagcttagaacctcccctatctttcctgtgacaccctggctccccctttgccttctgccttgatcgtaagtttcctgaggcctcaccaggagtagacgcaggcaccgagcttcctctacagcctgcagaactataagccaaaataaacctcttttctttataaattatccagcctcaggcatttctttctagcaatacaagaacggactaatacaattactttatgactttagtgacttatctcttggtaaagtgagcagggtctggagtttggtgtggcatgactagacttggagtcattgtgtgaattccgcttgttttgccggatgtggggctgttgtcttttgttcataattgtttcgtcatgatttctccagctttataagctatttctttaacagattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaaggtaatgctagattgctagatataattactatctaaaataactaaacattttggagagatagactttttttttttgaggcagagttttactctgtcgcccagactagagtgcagtggcgtgatcttggctcactgcaacctctgccttccgggttcaag

SEQ ID NO: 7975 - DNA, 1106 bp, Homo sapiens
atgatttcacttaatcctcattaccctgctggtaggtcttattcccatttccagagaggaaactgatggttccctgcagtcacaagtatctggaatttaaagttggaccttttaaactccaaagtctatgctatactctaaagattttgggaaagtaagagtcacacttggttttatgaactgttcttcataaagaatctgctgtaactttcacctttattttgcatctagagggaaaactggatgtagccaaagtttgagtttgtatggtaggttgtttacccatttcttttattcatttgctgtttgagtgcctgctatgtgccagacactagcctaagtgctactatccatatacctattgaaagttggctggtggtttttctgtacttttgaaatgataggtctctagataactttttagatctattaagactgaaaattgatctttttttcccctgcagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccaggtgagtctaataaactggtaatattagttgaacttttacccccttactgatatcatgtttttttttcactcaaaatttaattttactttgattttacccatatctagaaaatattcaattagtcttatagcaagcttgatgatttgggccagaattatagattatctcaggtaccaatttgtactgtgaggacaactgaagctacaaggttcaggtgattttcttttcactaaattttgttgtttctaaaattagagcatattaactgttcttgattagctttcttttttaatgtatcttcttttgtatgtgaaataaaacagaaaagttcagatatcaaagatgtgaagttacatggtttataacaaagcgcatacctataaaactactattcagacaaggaaaaaaaactactgctagcttccagaatcctcccttgtgctcacctcaatcactaattgtgctcttcccataaaagtaactg

SEQ ID NO: 7976 - DNA, 1048 bp, Homo sapiens
tcaccatgttggccaggctggttttgaactccttgcctcaagcaatccacccgtctcggcctcccaaagtgctaagattacaggtgtgagccaccgcgctcagccaagatttacgagttttaatgggtcaggaagaattgtaagttctactaggaaagatgctaagattgttttattcatagttgaatcctcagcacttcaaatagtgcctggcacttagttgactttttttttttttaaataaaaagaggagatggagaaagagagcaagacgcagacagtgagcagaaagagaagttagaatgatctgttgttgggattttgttagatgtgagtgcctgaagtgttgaaagaaaaatagttgaggatattggcaagagtgtggttgaagtgataatcttgcagtctaagtgagggagtgaagacagaacacacaggtagatagaaagtggagtggtcagtggattgaaaggttacataattggttaaggaagaagtgctgtggaagtaactgaatgggagctggaaggataaaagcttgtggtcagagagaggggtgagcactagggtttggaatgtggccattagagaggctggctgaaatggaatacgaagtgaaagtaattggagatgagaaggagctgaggggctaagtcattggtttccaaacgtcctgaaaggcatttcagagtatgtggagacatttagtttttggttgttacaataacctgggaatgctattggcatttagattgcaggagtcagagatgctagcatttttccagactcagaacatcccagtacgacaaagaattgtttgcctagcatatcagtagttcttccatttagaagcactgggctcagctgtgagccatggcccactccctgtaatcccagcattttgggaggctggagtgggaggattgcttcagaaagcgtaagcttttcctgtttaaacccaaaatgcagagagttctacatctctgatacttgtttctaatttttctttgtgtgtgtgtgtgtgtggtacaggtaaaaggattgagag

SEQ ID NO: 7977 - DNA, 1017 bp, Homo sapiens
ttgtttaacttagcataatggcctttagtttcatccatgttgttgcacacaggatctcattcttttttgtggctgaataatactacattgtgtacatgtaccatattttcttttattattattattattattttttttgagatggagtctctctctgttgccaggctggagtgcagtggcacgatcccggctcactgcaacccccgactccccagttcaagtgattctcctgccttagcctcccgagtagctaggattacaggcgcacaccaccacatctggctgatttttgtgtttttagtagagccggggtttcaccatgttggctgggatggtcttgatctcctgatctcgtgatctgcccgccttggcctcccaaagtgctgggattacaggcgtgagccaccgcgcctggccccgtattttctttatccattcatctgtttatgaacacttaggttgtttccaaatcttggctcttgtggatagtgctgaatgaacatgggagtgcagatatctgttcggtatactgatttcttttttttggattcatgcctggcagtgggtgggattgatggattatatagtagttccatttttagttttagttttttgaggaacttccaaacttttctccatagtggttgtgctaatttacattcccaccaagagtgtatgagagttcccttttctctacatccttgccagcattgttactgcctgtcttttggataaaagcctttttaactaggatgagatgatatctcattgtaattttgatttacatttccctgatgatcaatgatgttgagcaccttttcatatacctgtttgccatttgtatgtcttcttttgagaaatgtctattcatatcttttgcccattttttaatgggattattaaatttagaaggctcatttaaagtagataggagtgccattctgtgcagtgtgtacatttatatagcaagatttactagggtctttttttgtttttttttttgagacggagtttcac

SEQ ID NO: 7978 - DNA, 1029 bp, Homo sapiens
cagctgaacagtcccgaagttaattttaagacttaatttaggatttttgactctggggaaacctgtcaaagattgaaaacatttgatcaaaacagaatcacaggtcactgttaaaagaatagtcatttaaccagagacttaaaagctatacagaaagttatgtggatatgaaaactcgaacccttttaaagcttagttttcctgagtaatcaaaaagggtacttgaatttaatcagacacaggaagagtatgtacggggatatgagtgtacactgtattttagaggaatgtaaacaaggaaattagtaccatgagccagggaatacatggctgttagtaacagcatgggaagtttcctggttacatggaacaacaatttagacataggaagaaaagccaaaagtacagattcaagttatgttggaggaaaacattggttttccagaccttcatgctaaccatttcagtgtcaggccataacagcagaactagaaccagagaaaaaatgttacaggagttgacaaaaatgttgaaagacagagctaccactgttaccattgtggccatgcaaaaagatacacctttttaaagggggagaaaacagaaggcagtggtttatgacctgcaatgtggtacagagaaagttgaatttcggatataaatctgagaagtttgaaaaagaaaaatgttacctctagaaatgaaatggccattctgaaagaaagacaccgcatttccaatctgaaactagggaagttagttagatctcaggaagaattagaactagtttaaatcttctattaaataagattttagaattaaaaataaaacctcttaaaattttactaagagcaaatcagtaagcaaactgtcattctaacataggggaccaacttattttgttgttttgtattaatgtattttaatgtcaaatttcaatctttagaaagacttctgttaccaaaattacatcttaatatccataactttctttacatctgtctcctacttactagttcttttctagct

SEQ ID NO: 7979 - DNA, 1076 bp, Homo sapiens
actaatatttgtttcattcaggttgagaacttactatttccttttgaccaatgttaaaaaaaggcgagataggcgtgaaagcaaaggactatcttaaaatgaataatggtaatttcataagtgctgctaatttgagtctgcttttatgtaataaaatcctagacacagcatttgccctaccatcttagtattgcttcctatgcccatactgtgaattcagctacatcatttgggaatcacattacagtatttataataatcgacacccgagcagctgactagtggcttagacttcccactttagtatatttttagttcaagtacagaatgcttattatggtgcattcaaaatagttgtctttattttgcacatatctttttaatagcaattttttttattcgatttctccatatttgaaacttgaactacattaaagggatattctgcaaaattgtcagcatctccttccctcattcctgtgtctgggctttgtattccaaaaggatattgaggtggaaataaaagcaataatgtgagattatccttggggtgaatttagagaatggtggactttcctcattgcctacctttatgtcagaaatttagataaacaactgtaagagctcacttaataatatctgtcataatcattactatgatctcctacctggacaatataaggtggcaatggcttccccagagagcttggcttcaattttattgttttggaagtggcacagagtagaccctgttcaaagaaatgcagacaagtttttctttaaaaaagcaataaattaatggatctagttattgatcataaccagacattatgtgcctcctaacagaacaacattacacagtctaacaagtaatcttgattaaaaaaaaatcaagcaggagtgtgactaaattaacctctaggtcaatttacaggaaatgcaggggaacagaagaacatgtaaaccatactgcaattagcaaaatccaggctgtgaaatattcaaaagaaccaacaactcagttttttaaaataacaaattcaaggaaaaaagaaggtaatgaggaaattcataga

SEQ ID NO: 7980 - DNA, 1027 bp, Homo sapiens
tgctccagagccatgggcgtactgctttccatcctcctcgtccttctgaccctcaccccagctgcccttttggctggagcaggtgtgagaaacacataaggtctgcaggctcagcctccaaaatcctcctctgggaggtgggctcaaggggagtttctgcttatgttctaaagaccactaggatcctcctacgcctggctgtgtcagccatcttatttggcagggatgggagtggcttggctagaataaccctggggccctcaggtcacgtcctaaaatagtgggagaaaatattaaacatttaggaaacagatacacatcagctcccagggagaaacaagaactaggaaactttgtgtaacgtattgttactccaaagtagttgaatttgcttaaactcgttattaaaactgtatagagtgggttcagaagaaagtgttcattttcactgttacgccgtcaaaactttttctcctggagactgagtggtgtgtattatattttctgaagccatatcactgtaatattctttcattgctgtttttaatataaaaacgagaaattttttgctccatttctccttcatatttttgtcatcattttttaagatattgtggtatcatgtcaataccttgtaatctagtgtctaagacttagacgttggatcttaggatgttatttttgagtcaggtgtatcaataccttaagtaaggtaatagatattgagagtcctttataaattgtccagtggtttaaagatactatcattatttgagaaaaatggtaagtttttttttttttttaaattatagaaatccctcacaaggtgatttgctggaagaatatgtgatggccttgtggtctgggttctgtcatttttttggtgtgttccattggtggcttccagacataacatacaccaaagaagaagaaaaatctttcccaagaacattccatagtctgatctcaattttaaaatagtcctaagtgtaatagaaaaaagatttatccaaaaataatgtaatat

SEQ ID NO: 7981 - DNA, 1093 bp, Homo sapiens
ggatcgcattaaaaccttctgtattcactggcttcctctcagatatgggattggggatgctgcctcattactgacaggtgggggtagaaagtccactttccccactctgcctatgtcacacctgaggtcattggggccactcattactgctggatggggtgggagttctggctccccatatggcttccactgacaccttatgggtgagtggtggcctagacactgctgagcagtggtgagagtcctgattctctcctaggttttcttcattacagctgggtaaggatgaaatatggactctctattgggctttctctgaatctaccccagtgagatagttggggaaccacatcatagcctggtgagactagaagtctggaccccccacttggccttttctggcatttggctggagaatagtgttgtttcaatgtgttgtgttttgctgggctgcccctttctggttatttggtcagatacagcaggctcctcttgagacttcttctgtctgtgcccattgccctttccaggttgctgccctccgctccatgtctgggatgtccaaggaaacaagaacaccctgggagctcaccatcgtggtcctcaggacgtggggtccctagccagtgtggcttccgttgccctgtcagagtcttctcatgttgttttatatgtaatgtccagggtttttggttttactgggtgaaacagggaaaaatatgtctacctcatcttctcagacaggaaaaatatttttatgaggagaccatcttctcctgtctggatgctttcaataattcacgtaatccccgtttctattccaatttttatctcacatacaggtagttttattaaagtatcaaaatgttcttactgtgtgagaaaatgaccctactaaggttgtatcagcaatgaggatttttttcttatggctgtcttgttttagcaacttctgcctcctaggttcaagcgattctactgcctcagccttccaagtagctgggattacaggcacacgctgcagcacctggctaattttttttggattttagtagagataggagtttcaccgtgttgcctaggctggtctcga

SEQ ID NO: 7982 - DNA, 1032 bp, Homo sapiens
taattgtagattcacttgcagttataggaaataatacagagatcccctataccctttaccaatttccctcaatggtaacatcttgaaaacacaatagtaacaaaattaggatattgacatcaatacactcaagatactgaacatttccatctctgcaagggtttctcatgtcgctcttttatagccacactcgcttccctccttttccctcatcctccttaacccctggcaacttacttatctactctttatatttttattatttcaaaaatgttatattaatggaatcatacagtatgtaacctgggattagcttttctactcagtatattgtctggagatttatttaggtttttgtatcgataggtttatgtatcaatagtttgttccttttttttctgttttatgggtttgtctttttttattgtgttaaaaaacatgaaatttatgatcttaaacgtttttaagtgtattgtaatgtttactatgtgtacattgttgtgcaacacatctctagaacttttttatcctgaaaaactgaaattctgtacccattgaaaaacaacctcaccttaaagtccccatctctcaagcccctagcaaccactataatactttctaagtttgattactttagatatctcatataattggagtcatgcatttgtcttttttcaattaccataatgtcctcaaggttttcccatgttgtaatatatgacagaatttccttcttcttttcttttttttgagacagagtctcgctctgtcccccaggctggagtgcagtggcgcgatcttggcttactacaaactctgcccctccaggtttaagcaattctctgcctcagcctcccgagtagctgggattacaggcgtgtgccaccatgcccggctaatttttttggtatttttttagtagagatggggccttctttttttaaggctgaataatatcccatttttttttcacattttctttattcatgttgatatggtttgtctgtgtccccgccgagatcccatcttgaa

SEQ ID NO: 7983 - DNA, 1033 bp, Homo sapiens
aggggacgctgctccttggctccagccacgtgcctcatgcaggtctcatttctgctaattatttccattaaaacagaagttggaaagcctctttttttcggaaatctcctgatttttaattattggtgacatttaaattttgttggaaaacactgtgtggtccaaacttgccttagctctgagaacctttctcacttggaatcatcaatttttgtattgcctctgaagcccgctttgccattcagtttctccccaattcacctttaacaagaacctgctcaactcttagggtaattaaattgcaaaccaatggcttcaaatgcaggttgagagaggttaagatactagaggttccaaactacttaaatgtttggaaagggctgttgtagcaacacctctcaagggctccttgggcattccttgcatatagtcacccctcccctccccagagagagacagatgtcattggacacccatgacatgtgcatccctgttccctgtgcctgacactgagaggacactaagatttctttctttctttttttttttttttgagacggagtttcactcttgttgcctaggctagagtgcaatggagtgatctctgctcaccacaacctccgcctcccgggttcaagcgattcttctgcatcagcctcccgagtagctgggattacaggcatgcgccaccacgcccggataattttgtgtttttagtatagatggggtttctccatgttgatcaggctggtctcaaactcccgacctcaggtgatctgcctgcctcggcctcccaaagtgctgggcttacagacgtgagccactgcgcccagctgacactaagatttcttttaacatttctttgagtctggtagggcagacttttttctgtgtgactttggctttagaagatgttaaaggttactggccatttatcatagtaaccaaggcagtctccaccaatgtttcttcttccctcaaattctggttcttgcaagggcttactggcttgagatgatgattctcttccagg

SEQ ID NO: 7984 - DNA, 1026 bp, Homo sapiens
tttgtgctttctgccttatttttactgtaacaaatcaagaattaaagacatcttaatgtcaagggaaaaatacatttttgatatctgctagatctagttcaaaccttatcttgtccatttactagcttgtatgttcttggacaggttaacccctgaaaattcagtgtcctcatttgcaatgtgggaataatagcgcttgtcttcaaaggttgtggtgaggattaagatgatatatagagagagcctagtggtactattaaactattaaatattaaaaatattaatggtagctactatatattgagtgtttattacgtgccaggcattgttctgaactctttacaaatgcagtctcatttaagccttccagcaacctgatgaggttgatgcattataaatttcatttgataaatgaagatactgagtcagagagagtaattccctcaaggtttagtgagtgtttaggctttgggttatgggtggtagctgttggagctatttaaaagcacgtagggttcataggagcttgtttggaaacttttgaggaactcgacgacttcttgacggagtctcgctctgtcgcctgggctggagtgcagtggcatgatctcggctcattgcaacctccatctcctgggttcaagtgatcctcccacctcagcctcccaagtagctgagattacaagcgtgcgccatcacacctggctaattttttgtatttttagtagagatggggtttcaccatgttggtgaacaggctggccttgaactcctgacttcaagtgatccgcccatctcggcctcccaaagtgctgggattaccggcatgagccaccacgcctggcctcgatgacttcttaagaatttagtcagagtattctatttggctacctgttttattatattcctgtctgagaaatggtggtcggtctttcagactgagagagcagcacgtctctttgaactgtcaccccttagcactaataacttctttttgcaccatgcatagtgtgaagctggattaag

SEQ ID NO: 7985 - DNA, 1063 bp, Homo sapiens
tcctagaatttttgaattaaagagaatatttagagaccatctactccagtaactgacaactttttctggatcacagaacctttgagaatctgaggtcagccaaggactctaggccagtagtttggggaggagagtgacacacagttttgcatcatttcaaaaggcccacacccaagtctacctgtgacagatcaccaggttaagagcctccagtcttttacaatgagatgaggaaaccaaggcctgaggaaagtgacagaaattttgtgatgtcagtttggttcctaaagggaaggaagctaatcaaataaaatctcaatatactggaaagctatgtgtccttaaagcatctgtctgagaagcataagaacaaactataggcttagagaaaggagaaggagggaaagtgactcaacttgagacagaaagatgtgacttcagagggaacacttctcaacacaaggaaactaaattagttcccagaaagataagaacagaggcataggcctgccttgaggatggaaatcagaaatagaaaaggaagctgtgatggaacctgcaagaaaaaaagaaattttaaatgttaagatactcaagtaaatataggaaacattttcctttgactcactcagaagggaaatctctaaatagagggcgtttaacagcttacgggatggggagagacgttggctgcggtacttacaaaaataagcagcaggtattctctcatcactaacggtagggaactggccaggcacggtgactcacacctgtaatcctaacactttcagaggccagcacaggaggatgtcttgagctcaggagtttgagaccagcctgggcagcacagggagactacgtctctacaaaaaaacattagccaagtgtggtggcgagtgcctgtggttccagctacttgggaagctgagatgggaagagcgcttgggtctgggaggtcaaggctacagtgagccatgatcacaccactgcactctagtctggacaatagaaaaaaaaaagggtaagggactaagacccaaagctaaagtgtctacccttataa

SEQ ID NO: 7986 - DNA, 1050 bp, Homo sapiens
gcatagtattccatggtgtatatgtgccacgttttcttaatccagtctatcattgatggacgtttgggttggttccaagtctttgctattgtgaatagtgccacaataaacatacgtgtgcatgtgtctttacagtagcatgatttataatcctttgggtatatacccagtaatgggatggctgggtcaaatcgtatttctagttctagatccttgaggaattgccacactgtcttccacaatggttgaactagtttacactcccaccaacagtgtaaaagtgttcctgtttctccacatcctctccagcatcttgtttcctgactttttaatgaatgccattctaacaggcatgagatggtatctcattgtggttttgatttgcatttctctgatgaccagtgacgatgaacattttttcatgtgtctgttggctgcataaatgtcttcttttgagaagtgtctgttcatatcctttgcacactttttgatggggttgtttttttctcgtaaatttgtttgagttatttgaagattctggatattagccctttgtcaaataggtagattgcaaaaattttctccattctgtaggttgcctgttcactctcatggtagtttcttttgccatgcagaagctctttagtttaattagatcccatttgtctattttggcttttgctgtcattgcttttggtgttttagtcatgaagtccttgcccatgcctatgtcctgaatgatattgcctaggttttcttctagggtttttatggttttaggtctaacatttaagtttttaatccatcttgaattaatttttgtataaggtgtaaggaagggatccagtttcagctctctacatatggctagccagttttcccagcaccatttattaaatagggaatcctttccccatttcttgtttttgtcaggtttgtcaaaaatcagatggttgtagatgtgtggtgttatttcttaggcctctgttctgttccattggtctatctctctgttttggtaccagtaccatgctgttttggttactgtag

SEQ ID NO: 7987 - DNA, 1023 bp, Homo sapiens
gtttctaagttgaggcacagtaaatcaaatgtagaagttatgagtcccatactagagagactgaagagagaacagactggaaacaaaggataggttggtttacctttaagtaacacaggccaaggttgagctggaaagtgtgtgaactgttatgtgttttcagagcttctaagcttttaaaaacattctctcatatacttaagttgttcaatatcaacttgtattttatatctttttgcaagtttaaaatgtgggtgaataggtctgaatctcatctttactggatctaacctgtctcattaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggtaaatagttcttcataaggtcccaaggcctgtgatgggaactagtgacacctggcttagttagagatcacaaaattgatatgctaatattatgaaatatggcattgttttgaacgctatttgcaaaatcggattttgctttgcttttgtgaaattctatctaacctgcctatctagacctattctctgcaaaatcactcggttaaaatatataagcattgattttctcaagaaacatttgctaggcctatgttagatgccaagtgctaaataagcactagagatgcaaagatgcatatgatacagtatgtgctctcgagtgttcacaaaggacagaattgcctcataatctgcattcagaagtgtaaacacattaaaaaatatcgccaaagtggaattcagaagaattctagaaaacaaagtatattgtctgccccagaaatacaggcaagttcttatgtttatacctgagtgaatctggcacattcttttgctattttattggtcatggtgatcccctgtgtgaaacaagcataccaagacatcatgtgttccttctgtgggcgtgatgagct

SEQ ID NO: 7988 - DNA, 1028 bp, Homo sapiens
tcttattgtgattatcctaattcattttctactgagtgttgattttttagaacagtatctgaattttaactatgctcttggtggggtaaggggaaaagaggagtaggcacattatcagaatgctaggaacccctcactgtctttggagaaggtttggctagaattgtccaatctttcctgtactaatatatgaaactgaaacagcttccaaatctaaatctgtgatctcatagcactgtatcttctgggaagatcctaaccctaaatcctggagagttgtggagtagtaggttgagactgacagattgtgaaaggttattttttcttttcctgtaataatttgcactgcttatagttgccactgctttgctctacaatgggcattgatttcctcacttccctgattcacttactcctgcagagaggtagtatgtagcaagattgtcttaaagatttggaataatagaggggagaggtatattatagcacaggaaaagcagtaacttgagaccagaaaaatcactgcccaaaatgtccttcagccagtccccagcctccccatctgtgtccactttaggtcttgatttaactctagtttctcagccctttcttacccccactttttcttgtccaagctcctacttactctttttcaaagtgaaattgtgagggtttttcatcttggattgtatgcatgtaacatttcaggtaactattttatgtcactccacttagttataaaagggacatacactttatggtaataaatccagactgaatgccaagagtcacgcactctcctgctgactgagcctaacctctacagtgactcactcataaaactgggagtgtaaattagtgactgtttcaaagggtactgtgagagttaatgagtacctctgttgcatttcatcctgcttggaaacagtcacattaaacagtatatggctgctatgctgtttctgcaatagccacccttctttttcagttctgtccttaaagcacagcatcataagtagcaatggcag

SEQ ID NO: 7989 - DNA, 1155 bp, Homo sapiens
gacctgcagggggtaaatgtgggtaaagtatttctaagggtttagcatgctggagacactaacaccatgctatgctgcatgcactaacaccagaagtttggcataaacaagatggaaaagttgtgagagaaacttgtcatggagcagtgactgcataagctcttctgaactcgtggttgcattcaacagggtgaggtgctatagtcactgaagatggtgcgatgagcatggcttgtatatttcagtggctagaagactgcatgtttggaaaaaggattgccagtagacagtgtgttctgcagacagaaggggcctgcaagagccgtcatctacatatttgggttcattggttttgcctgatcctagcttggttttgcctgagcttggctgtgttcttccatgaatttctttttggactgcttagctcactcacttatgactttttaatctgcattctaggttattagtgttaaagataatgatagcctggctgcccgactggctgtggaaatgaaaactgatctcttgattgttctttcagatgtagaaggtacaaagtaatgcttttttcctttatctgccctttgttttaaatgctacatatgtgagcacatgagtttccctctttctttgagtccctctgatgtttttttgctatagatcattagccatatgttctgacaaagggcttttatgactcaaaacagggtgggtgagtctaagagatgtcatttgaatcctgaaatgttacttccaggtgctttcagttgttttccttaaataacagctttatggagatgtaattcacataccatacaattcacttatttgaagtttacaattctgtcctggcgtggtggctcacacctataatcccaacactttgggaggccaaagcgggaggatcacttgagcccaggaattcaagatcaacctgggtaatatagtgagtccctgtttctacaaaaaatagaaaagtcagctggacatggtggtatgcgcctgcggttccagctactcggggctgaagcagaaggttcacttggagctgggagttccaggctgcagtgagctgttatcgtgccactgcactccagcctgggtgacagagcgagaccctatctcaaaaataaataaataaataaaagtttacaa

SEQ ID NO: 7990 - DNA, 1038 bp, Homo sapiens
taaaaaaaaaacttcattggccatttttggaggccactagagaagctactcatattgaaaatggatgagtaaaggggaagagacacacatttgtcctgcttttcatagacaaactgtacctcagggtaaccaaatagttggtaaaggagagtttcccttttggaattattccagattataaatgacgaaggaatcattgagttagagtgtcagcattttgcatctcctaatggaataatggatcttggcaatgatcatcaacagatgctaacatcacaaaaagaaagataaccaggcattatgtatccccttgatgaacatgtacaccacaacttataaagacttgttggggaaaaaaaaaaaagccttcataccaaacagcagtttatagggtatacaaagagcagtattaataccataaggacacaattgggaaaatgtaggctgggaaatcctaaagaataaacaactcagtttaacaaaaaattacaagggggaaaactgatggagaagggaacccatgaatgaaagagacttgagagacacttcaattaatttgtaatgcagggtttaatttgcatctcaatttgagcaaggtaaaaaaaaattggaaaaatatgaacactggctatttgatatgaaggaaatcattgaaatattccagataatggatttgtggagagagaaagacatataattatatattatatataatatatatgattatcttttagcagttattactgagctatttacagatgaaataacatgtctgttgcctggaatttgtattaaaacaatggtgagggtatagaggggttattggagagtgggaagttggccatgagagatagttggtgaaactgggtggtatgtacatggggatttataatactattctcagcactttggttaagtattaaattttctttttctttttctttttatttattttagagagagggtcttgctctgtcacctagactggaatgcagtggtgtaatcatagttcactgcagccctgaactccagggctca

SEQ ID NO: 7991 - DNA, 1033 bp, Homo sapiens
ctctaccctctctaccttagaaacataacagtctttaccctttgcgagccagaactgggactccccacacattaaggtgactgttcagggcagtaaatatccaaataagtgggcccaaatgacagtgagcgatgggtccagaggtgggaaactcagatgagagtatggttgttcctggggcttcctaggagagctggaactcagcctgggccttgacaactgatgggatttgcacaaacagaggggaaaagttccatgctactaagtacacagtgtgaggtgcccctgcagttgtgcaatccagtggttctggggaagggacaggctctaggagtgtattccaggtagaggacaggcaggaatgagtatggcatgctgtgggccagggaggagacaagctggaaagcagaggtggtggtctcattaggaagaatgaaaaataaagtggatcattccattaggcagagctctgaagccaactaggtgagttggagttcagtctcaaaagcaggctgaagattttgaacggaggagaaacttgatgaaaacggtaggaaaaacctggtaaaggtttgcgtaggttaccagctttctttctagggctgcgtgtggacctaatggaagagctgtctccatcagggcctgactaatagacatcttatcatgtcagatggactcaggagccaacttaaactggcttccactggccataaatgggatgatgtaaacatcaagaaagggaatcacagctgggcacagtggcttacacctgtaatcccaacaccttgggaggccaaggtgggcagatcacctgaggtcaggagttcaagactagcctggccaacatggtgaaacctcatctctactaaagatacaaaaattagccaggaatggtggcacctgcctgtaatcctagctacttggtaggctgaagcagtagaattgcttgaacctgggaggtggaggttgcagtgagacaagatcgcaccactgcacttcagcctgggcgagagtgagactcagtctcaaaaaa

SEQ ID NO: 7992 - DNA, 1024 bp, Homo sapiens
atccatctatgtgtttatacatgtatatgaaattaacatgtatttttctacattattaaaaattctaaaaatgttaatctttttccctttatccaacatttactctgcttctgatttttctgataataaataacagtgatgaatagctttctgataaatctcttttttagagaacttttttaaggctttcgataaatttgccaacctgtcttcaagagagattaatttgtttgtactcttcaccaacagcatttgagtgtgcctatgacctgcatactgggtgtaaactccatacaatactaaaataagaatacgctagatagagcttttgatacactgtgctagttttacacagttaataatgataatgctattttttggtatctaaactggttaatactgagcatgtatatttttattgaaaaactatattgagtatttctttttttcttgcatttgactttgatggctacagattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtgattgccaagatagaaattatgctgtactaaaattgggtttttaagtcgctagttcagattaggtttaagttgctcatcaacttaaaaaaataattgtgatttcagtgcagtagatttaacccaatgtgaaaactgtttcccactgtagacgccagtgagagacgacatcttagggcaagaaaatgggatgttaaggagtaggggtgatttcatgcagttcatgtctcagacttcttagtgataaagagctgtttctgtcagagattcttagttctgactacgcagtagaatcatcttgggcctggagatgcttgggcttcacacctagcca

SEQ ID NO: 7993 - DNA, 1046 bp, Homo sapiens
ccgagatttgtagccatattctcttcctccacaggattaagatgttagccagttgtaggcattgccactgccttccaggggtacaagagttattttgtaatcctgtgggcatcaggaagaaagacatggcagcagcctctggcctttcctcttgcttttcatggctggctggcaaggatcaagctgacatttcaaataggtgcatttcctggttctgttgggagatgttagcagaaaggtggacatgattgctttaggatgttggatctgttacaggaattatatgaagatttagtattaacacataagcattgcacctgaaagattttttttaaatttggaagataccaaaaagagcaggtgttttttgtgtctcaaaatattcctaactctgcattattatttgcttacataaaaactaagatggttgaggcctagaaaggagccacttactttttctctcttttctataatatagaggaggtgggagtttccctaatacagaggagtttggagcaggagagtcagatttttactccgagggtaaggggaagtagagggaaataaaatgaattgtccagtatttttcattactcactttttaaaaaatgtattctgcagatactttggttagtgaccacatcgcagcatgttgagtcaagtttaccgctgtgggttccagcccttcaaccaacatcttctgccctgggtcaagtgtacaaccgtcttcagatctcgtatgtaccatagaaaacttatgagtatgtgggacgtttgatagtcaaagtatgtttcaacaaggttttcaaagagaaaaaagatgtttgtttgtttgtttggagacagggtctcattttgtcacacaggctggagtgcagtggcacaaacatagctccatgcagtccagacctcttggactcaagcaatcctcctgcctcagcccaccaagtacttgggactacaggcacacaccaccgcgctgactctaacttttttattttttgtcgagatgcgattttgccatgttgcccaggctggtcttgaac

SEQ ID NO: 7994 - DNA, 1048 bp, Homo sapiens
agaagccagacacacacacacaataataataattaatttttaatgataaaagtcagaaagtggttacttctgggaaagggacagagaatagactggaaagggacatgaaggagctctgaaatgatggacatactccagaccttgctttgcgtattggctataaagcatatataattggcaaaactcattgaactaaatatttaaaatgtatatattttattgtttataaattatacctcaacaaaaatattaaaaccaaacaaaaaaacatttaaaaaaacatgagaggccaggcacagtggctcacgcctgtaatcccagcactttgggagaccaaggcgggcggatcacctgagattgggagtttgagaccagcctgaccaacatggtgaaaccgtgtctctactaaaaaaaaatacaaaaaattagctgggcaaggtggcacacgcctgagtctgtaatatatgtgtctgataaagttcttatatatgtaaaataaggaactcttacagctcattaatgagttagacacttgtaccaaagatgaatttgttctagttgatagtctgaatgcagctacaaaaacacacctaaaagttagtatccacaattttttctttaatagtttttatttgtactgattttacgtagggtattaacatataatggtttaaaaatcgtgatcatacagatgtaatgtatagggtgtacttcttattaccaaagcctaacgtaacctaatccaagtcttcatgttgttacaaagtaaatcttattttgggacaaaggattttattgtactgtaaattgaattgaagcaaataaccccccaaactttacaaagtgttaaaacaaaattgctggtggtaatttcttaagtaaacatcatgaaatatagcttaaagtagaaataaattaagtcaaccatacataacagaactggacccacagtaaatgaagtgtgctgactgggctatgtatcttttgtctgtcttgataaaagaaatgaggtgaccagattttgagagagttatttttccccagtgct

SEQ ID NO: 7995 - DNA, 1091 bp, Homo sapiens
gtgaacaaagtttcttttatattttattcaggctggggaccccattcttacttacttccccaagtggtctgtaataagcttgctgagacaacctgcaggagttggagctgggggactctgtgctgaaagcaatcctgcaggtgaatccagagcaaaagtaccaaccttttcattcaatttaaaacaggctttctcatttaccactctcttaattatttgtgtttaaggtttcctagagagtaaaagtacaacttgcactcgttttttcaagaacctggctagtagctgtaccttggattcagccctcaatgctgcctcttactataacttcacagtcttaaaggtaggtgtcctttctctccctacactgtcactactatgaagttgaagtgaacatgcttctcactgttgtgggttgtggaaagagcattgaataaaagtcagaatccccaggagccacgtaaaagacagagggcctggaaaccacatctgaagacaaatgaaataattggggatatatatgcaggataagagatcatcacccttctcactaatgggattggcttgcgagggtggaagggggaaaacacccatctcaccaaacttcttgcttttgctattcagtagagccctgtcagagtaaataggcatcacagtctgtcaccctcctgcctggctccacttcctggcattttagtgtaaagaagagtcaggtggaatagaggaagtaaatcattctaatatattgactcccctgcccgccaaaccaaagcctattggtagtaatatgaaaccacaagctcctggtgatttttggtaaggtatatgcacattcatgtccctgctgttctcctaggttccaagaagcatgactgatccacagaatatggaggtatgatgctgttgtaccaggaaaaaagaaaaagaatatttggctcctctgcatctgaggcaattttagtctaagttgtactgttgaaagataaatgtaagcgtgatgtagcaaacaattaagtagggatctaaaacggtgcctttgcaagtacgtcctatacagttaatagcctcgtatgaaaccaggatccataagg

SEQ ID NO: 7996 - DNA, 1050 bp, Homo sapiens
aggatggaccatatctttgtttccccatggtgcttagtatctattggtacagccaggcatggtggctcatacctgtaatccagcactttgggaggtcagggcaggaggattgcatgagcccaggagttcgagaacaatcctggcaacatagcaagacccagtctttacaaaaaataggaaaattagctgggtgtggtggtgcatgcctgtagtgccagctacttgggaggctgaggtaggattgcttgagcccaggagttcgaggcatgcagtgatcatgctactatactgcagcctgggcaacagagtgagatcctatctcaaaataaaataaaattcaaaaaaatatgtatctacgataatgatcatcagtaaattacgtttttagtcaaagtctgtacagcatgatggagtggggaaaaaacaccaggaataggagatctgcaatctactcttggctctgcaagctggccctctggctttttgctacccttttacctctgaggatccaaatttcctcatgggattaggtcagatggtctgtaggcttcctttgacatctgaaattgtaatagaaatctaaatacctttaagctcttttaggtgtaatatatcatctgtgatggtagaaattttaggcaaaaattctacttagcctatgtttaccatcactaccgccaatatctttgcactgaagtgagagacaaaatgtaaactttctcttattcatttaagccatgaaaaaatagccagatagatattttgccatctcagttcaccttctttcttagcttaactttaacttttatttcatgtgtaaagatacaaataactgcattttacatgaggtaaatatctcctccatgtggttttcagggtatgagttccgaaggaaatgtttaaatagctcttggaagcgttagggtttgaagatttcagatcagaggtggaaagtggcccacagaacagcagcatcaacatcacctgtttcagagcaatgcttttcaaattctaatatgcatacacattacctggagatcttgttaacat

SEQ ID NO: 7997 - DNA, 1036 bp, Homo sapiens
atctatctttttaaaatgtctatgaagcaaaataatgttcctgcacaaaatggatttaaatgtctcttgcatcctggaagtcacctcatcctgatttcatctgactgttaataagaattgcaaaactatatttgtctcagaaaacaaccagtttttggttttgggggacttgaatttcaaagcagttatcagaagccttgtggttatttagatggtaatagggtaaagggaacaagatgaatacttcattttcagataaggttgtggcctgacgcggtggctcactcctgtaatcttagcacttgggaggctgaggtgggcagatcacttgaggtcaggagtttgagaccagcctaaccaacatggtgaaaccctgtctctactaaaaaaacaaaaaattatccaggcatggtagtgggcacctgtaatctcagctagttgggaggctgaggcaggagaatcatgtgagcctgggaggctgagattgcaccactgcactccaacctgggtaacagaacgagagtctgtctcaaaaaaagaaagttgtctcttcttttccaaacattttactgccttttaaatccagccttatgatcatgctccagggttattgcaatggcacctacctggtgctccctgcttttgatccccactcctgcccccgacaccatcctgcacactccttcgggatcagtggatctgaactttctttaaacacctgagggaggaatatggccacttccaatagtagttatggttcattacatcaatgaactttttcctgaacgagggtggggtgtacattcatgtttagtatgaaaaaggcaaaaatttccctttggttctgattatttacctaccttcctcacatatacacacatagcatctacacacagtatacacagttgtggagaatcatttcactagataaatctttccataacattgcattatgttgcttccttactgagaaacctccattacttcccactatccataaaataacatccagcttcttagccagcctgtcagatct

SEQ ID NO: 7998 - DNA, 1012 bp, Homo sapiens
acaaagcctccaagaaatgtgggactatgtgaaaagaccaaatctatgtctgattggtgtacctgaaagtgacagggagaatggaaccaagttggaaaacactcttcaggatattatccaggagaacttccccaacctagcaaggcaggccaacattcaaattcaggaaatacagagaacaccacaaagatattcctcgagaagagcaaccccaagatacataattgtcagattcaccaaggttgaaatgaaggaaaaaatgttaagggcagccagagagaaagttcgggttacccacaaagggaagcccatcagtcttacagcggatctctgggcagaaactctacaagccagaagagaatgggggccaatattcaacattcttaaagaaaagaattttcgacctagaatttcctatccagccaaactaagcttcataagtgaaggagaaataaaatcctttacagacaagcaaacactgagagattttgtcaccacaaggcttgccttacaagagctcctgaaggaagcactaaacatggaaaggaacaaccagtaccagccactgcaaaaacatgccaaattgtaaagaccatcgatacgagaaagaaactgcatcagctagcgggcaaaataaccagctaacatcataatgacaggatcaaattcacacataacaatattaaccttaaaaataaatgggctaaatgtcccaattaaaagacatagactggcaaattggataaagagtcaagacccatcagtgtgctatattcaggagacccatctcatgtgaaacgaatgcacataggctcaaaataaatggatggaggaagatctaacaagcaaatggaaagcaaaaaaaaggaggggttgcaatcctagtctcttgtaaaacagactttaaaccaacaaagatcaaaagagacaaagaaggccattacataatgataaagggatcaattcaacaagaagagctaactatcctaagtatatatgcacccaatacagg

SEQ ID NO: 7999 - DNA, 1049 bp, Homo sapiens
ccatccatctcttgcagggaccttgactgatacaacattaaaatgaagtgtaattttaaaaaattttatttacatatttcttattaagaattggatgaattgaaacttctttattttctttctctttcttgtcacacagaaagcctgattaagtagcattattcttttgtctacagaagtaaccacttctggccaggcatggtggctcactcctgtaatcccagcactttgggagcccgaggcaataggatcacctgagattgggagttggagaccagcctggccaacatggtgaaaccctgtctttactaaaaatacaaaaattagccgggtgtggtggtgggcacctgcaatcccagctactcgggaggctgaggcaggagaattgcttgaacccaggaggcggaggttgcagtgagccgagatagcaccactgcactccagcctgggcaatggagtgagactctctctcaaaaaaaaaaaaaaaaaaaaaaaaaagtaatgacttctgctgatcttttttctcccctataggttcatagaaaaaaaactcccaccttataaaggaatctttaaaaggttcctcataaaggaacagggttagcagaaccaagttttgagtcctgggtgaaaatccaggggagaatggtaatcagtgataaccaatggccaatccaatattaaaattagttaacagtgaccaatcttatttcacctaccccacccagagtggcccaaagcagattgctggatctgcctctaaaccaaccttcctgccaaaataattggggttaggttgtgtctgctgattgtctccataatttgagattttaacaagttgagtttggctcccaaataccttaaaggattttttttttggcatctctggggagggggagattggacgtaggcaaccaaacaggaatggaataagaaaagatttgtgttctctgaaggagacttgtgaagtctaattccaacttgctgagggaaagtgtttagaaaagaaaaagcaataggcttcaaccagaagacatgagttggagtat

SEQ ID NO: 8000 - DNA, 1027 bp, Homo sapiens
tcattctacctggctgtagtgtagtatagtgtagtgtagtgtaggaaacatcagaggagtggagtgggatatgagcctggagagagctggcggccatggatcattgaaagccttgaatgtctgatggggaggttgactttattttgtaggcaatggaaagccaccagtggttttagttgagcagcaatgaaattaagcctgtgctttgcaaagattaatctagcagcaacagattggaagcaacaccaccattcctggtatcagtccaggtaaaatatattacagctctttactggagcaataacagtaatattagaaggagaaataaaaaagaaaaatattgcacaggcagaatggggaggtcccagtgatggagctgatcttggttcattgaggcaggggtggcattaatcatgtaaaacacaggaggaggaactgggttaggagtaatggtagagttcagtttaggtaattgcaaatacacactattccctgactagctcccaagactttttcttccctctcttcttagaacttcattagaagaggtgatgttatttcttagatgagagtatcttacttaccattgactaatacatgttctctgatgaactttgctattcaacatacatgcaaaggggttataaaaacaagtcaactctagtgctgatgagggtgatcatcatcactgatcatggtgtcagttgattatagtgtcaatttataacttaatttatgtaaaatagagcaatgcaaaagacatagcaatcttcacttcaaatgaagagtcttgaatgccacttttctaaagagaaggctcatggaggcacctcctcactattgaaaaatccattatacctgtgataaaactgattgtgttcagttgtattagatttgtatgcaaataaaaagttgggtaattagctatacattgtcctaaacgtataaaataagaaaaatacatagatgtatggtttcctaggacatctaccagtttagaatgcgaggctaatgtgggagctgccac

SEQ ID NO: 8001 - DNA, 1171 bp, Homo sapiens
ggctgtgtccccacccaaatctcaacttgaattgtaccttccagaattcccacaggacccagggggaggtaattgaatcaagggggctggtctttcccatgctattcttgtgatagtgaataagtctcacgagatctgatggttttatcaggggtttctgcttttgctgcttcttcatttttctcttgctgctgccgtgtaagaaatgcctttcacctcctgccatgattctgaggcctccccagccaggtggaactataagtccaattaaacctctttttgttcccagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttg

SEQ ID NO: 8002 - DNA, 1048 bp, Homo sapiens
ttatagatactaatatataatttttccctgagaagattgcttttataacatgcctggatgtcagttttctactttatgaaactaagcaacactggaacaattcaaaaatcttagtgtcttttagcctaaactcagtggcatattcctaaagaatactttccatttaattttatcttctctaatgaagataatggtattcatgcaacatcttttatatgctgtatggtactcaagcaacatcttttatatgctgcttagcaactctgttaagcacctctatgtgccaggcatacagctcaacactagacctacagaggtcagaaggagcccttgccttcaaggagataggtaagtaaaccagcaaatagacactttatccattccacaagtgtttatggaatacctactgtgtcctggcactctgcttagctctgaggattcagcaatgaataagacaggtgtgaaaataagtaattcaaaatctaagctgttggaactccaaactattttgatccttaaagaaatgtgattatggggcctgagtcacgttacaagcagctgtaacctgggaagctgtaatctttgtttctatgattatagattaaccttcctccttgcttacattgttgtacaaaatgttacaaatgactaaagggctccaggaaagaccccttccctgttactgttgatttttattatagattaacttcccttttagtttctcacccaaaggtttcatggctatcacaccgtgttaagatggagtgttaaatacctcttttaaatcagaaaggaaatgaaaaccaactgtaaagaaaacaagccatacagaaaagaaactcataaactagcgttctagaaaatgttataaacctactaaacttctttgttttctgcctatatatgcaataatttaactttgaactttggaacactgactctatttctctggagtctgtgtctcccaaatggctattcccagctttttacttgaataatctcgactggattttgatccttttgattatttcaggttaacccagaccag

SEQ ID NO: 8003 - DNA, 1056 bp, Homo sapiens
taagtcccatctatttatctttgttacatttgcttttgggttcttggttatgaagtcttcgcctaagccgatgtctaaaagggtttttccaatgttatcttctagaatttttatggttttaggtcttagatttaagtcttttatccatcttgaattgatttttgtataaggtaagagatgaggatccagtttcattcttctacatgtggcttgccaattatcccagcacaatttgttgaatagggtatcctttccccactttatgtttttgtttgctttgttgaagatcagttggctgtaagtgtttgactttatttctgggttctctcttctattccattggtctatgtgcctctttttataccagtgccatgctgttttggttattatggccttatagtatgaagtcgggtaatgtgatatctccagatttgttctttttgcttagtcttgctttgactatgtgggctcttttttggttccatatgcatcttaggattgttttttctagttctgtgaagaatgacagtggtattttgatgggaatgcattgaatttacagattgcttttggcggtatggtcattttcacaatattgaatctacccatccatgtacatgggatgtgtttccatttgtttgttggttaggtatttaacataccatataattcacccacttcaagcatacaatttaatgatttttattaaatttacctatttatgcatctattactgtacatcagttttaaaacacttctatctccctaataagaaccttcatgttcatgaattgttcattcctattcccccaccccaggcaacaattaatgtagtttctgtctctagagatttgtctcatgtggacatttcatataaatggaatcatacaatattggtctcttgtgtttggcttctttcgtttagcataatgtttttgaggtttgtccatgatatacagcatatatcagtagttcatttgtgtttttgctgaataatagtacattatatggatataccacattttgtctacctattcatcagtaggtggtgtgaaa

SEQ ID NO: 8004 - DNA, 1050 bp, Homo sapiens
ctatcctggattcctttcaatgtgaatctaaccatttacagcttttaaatgaactgtgtgcatactcctgcgtaattatcttcagtacactgataacatacttttactttgcaaattaggagtggcctcaaggggcagttaggattggtgatatataaaagttctctagtatcaagtcttcctctagatggaactcttctatctaggtaagagttctagtttcttatcttgctcagtaagatgccagccttattgtctaattggctttaagaaaaaatagtgactgcttaccaagtgctagatactgtgggtttgctcttcatatctgtgggcctctaatttgtatggatccattcttaagcaatataaaacaccagcacatcagattcttgtgagagagtagaatctagaattgtccttcctaactttttctcagaagtttggctgaaagaagtattattgcagaaggtcatttaaagactgtgcagtccattcatcactccctatggatcaagctggaccactcagacttatgtacttggactatattacattaattacttaaagcattagtttcagtgagtcatgccagggtgattttgtccaccaggagacatttgacaatgtctggagacatgtttgattgtcataacttggagggtctggggagggggtgctcttggcattcagtatgcagaggccaggggtgctgctaaatgtcccacgatgcacaggacagccccacaacaatgtttcaccccaaatattagtgcccagttgagaaaccctgatttagatggtcaaggagcctaaggaaaggtacaagacacagaaagaggaacgaacttaaggtatttgttggactgtaaggagagctgccggactggagagtgtttccaggtgggatctgtggtgaaaggtaagactcaatatatggataagtctgtgtgtatacggccttaaagaatcacagtagatttgaagtttatcctgtaatgacagtagcatttacagaaagtttctgttggaaatagaaaaaaaatggaaaac

SEQ ID NO: 8005 - DNA, 1036 bp, Homo sapiens
agtattctcttctcatcttcctgtttctttcatctcttcctctgccttattcttctatacttaatccctgatctcatgaagacgctgtcccttgatgactattttgtcatcatcagcctctacctacattgactttcttccttgtctagcccacactccttgttttattatttacccacatcagtatccacaatttctttgccttttgtgtttcttccacttttgtccagcatacctattctagtttagtctagccatttgctttctctcctcatatagaaaggtaattgtattagtgaaaatcatgtaaccagattattgccatgatgatatggcatggtccataatgtagctcagccattcttttcctttctcacccacagctactattctaacttttatcgttccttaaacctactctacttttgaccttgtactttcagcagctggcttggctttttcagaggaaacagagactctcagacatgaatactgtgacactgaccaccaggccaacttaacatcagcagatatcctgtctcagatgaagaggtatgtttgatttatttcttttttttttttctatctacagatgatccaatatatgtcctagatcccattcattctgtctcctctggggccttatttcatcatttaaccctccctttttatcttcagtataccctttccccacctccctcccctggctttatctgccctatccaacaaaacaaaaacaaaaagaaaaaccatcaactgggattattctcagatttcttctctctctccttttttacagccacatttagagaaaaaggtaatctttttttcccttcccttacttgttaactcttctacccacagagttctggcttccgccacctaatcatgccaccaaggactttgtgattgccaaacccaaaatatcttcttaggcttcttttctgcacttggctctgtagaccatttcccagtcttgaactttccttgtttcattgttttcgcaaacatcagtttctaccattcttctcccacc

SEQ ID NO: 8006 - DNA, 1029 bp, Homo sapiens
ttcaatgctaggcatttgggtaggtgttagcaataaattataaaacaagccaataaaacaaaacaaaaaccctgccctgcttgcagtcaagcagagaaaatactaggtaaacggaaaatatagatacagaatgagcctcaacaaaactgtaattcagtctttaaatcagttaagtccctggttggatgaagatgatcatcctcaatacgcttaacaaagcaaaggatggaacatttctggtggaagataacatcatctcgggcttctataatttttcatatataataatgtagaatacaatttttaaaatcacctgtcataataagaggcaagactaaatgagcaaaaccaagagaaaaaatagataataaaaagattcatagtgatccaaatattgtagttaccagatatgaactttaaagtagctattattactgtattaaaaatagcagcaaaaacccatgaaaagactaaatatatctcaagaaaattagaatatttacagaagaattaaatgtcgaatgaacactttcaagcaaaaaatgtattgaaaatatgtaaaattaagaagtcagcagatgggctggtctgaaaatatggtggcagtacagttttagatcttcccaaattcctatattaaaagaggcagagcaactagacagcaaaaccaaaaatccacggacaagatttataatagaagtagttctcaagaaatgcctcatgaaacccaaaacacaagtcagtgaagacaaatcatcaatattcagaaggtctgaatagcattggcgattgtgtgggagatagcagagagaagcaatggaacatctgatagacctgacaagagtccaaaagagccaacagaaatgcaccagaaagtacagcaggccaacttaaaaacagcagctaaaattggaacaggttttgtctactccaattgtggatggtcaggttaaggaccgaaggagctgcaggaatctagttcccaggaattttcagaatgagccttcacactgaatagaaactactggg

SEQ ID NO: 8007 - DNA, 1060 bp, Homo sapiens
agctgggcatggtggtgcacacctgtagtctcacctacttgggaggctgaggtgggaggattgcttgagcccaggagtttgagtccagcctgggcaacataacaagatgctgtatctaaaaaaaaccaagttgccaaataatacatatggtaagatccaatttatgttaaaaacaatcatggcatacatacatatagaaatacagggagaggagaactttaaggatgtactcaaagaactaaaggatgtccaaaccatgaggtgatgaacgaagtagggctttcacatcttgacacttctacaattaatcttttccagggagaacgtattccggtattacttgtacaattttttaaagctagagggaaaaagagcagaaatctgcatagctgagcatcctttctactctctcatactatcagcaacatccctctttgttctttaagtggaagtcatactcatataaaggagcatatttcagtttaagaattccttggatgccaatgactcttccactactctgaattggtttgaaaacactgggaacaggcaaagccatacatttcacacccagggactaaattatccatgtttaagaaattaatcttttagtgggaggccaatgaacatgctctgcaccacctggccttttcttctcttccccactgctcttctctacctcagaagagaagattatgcacacttccaagcacatttctcttttcacaatttactgggagttagagaaaatgtttacattcacataagagaataaattgaaaaaaagcaaaaatccactgagaaattacatttggttcctaatacaataataatactgaaacatattgcaaataataaccccaaaagtttttattttatgcagagagccatgcatatacatgaaaaataaacccagagtctatatatactttaatagatggtactctaataaactaaaattgatattgctaaatcagattttaaagattctataatattgtgggaaaaaattctataaagcagaaatctgtagatcaaatcactttttaaatgatctgca

SEQ ID NO: 8008 - DNA, 1052 bp, Homo sapiens
ctttgtttcttatgtaccgaagaaaagcatttatgaactcttactatgactctggccatatgctactggtttttatatataatgttctccctgttcttttttaaacagtctctaatttcagttttgattttccatttaatccagttatgtataacaattttcaaaactataatatttttaaaacataattttttagagaagttttagatttgcagcaaaattgaacaaaaggcacagagagttcccatgtaccccatccccataaacatgcacagcctccccagctgttaacatccctcgctggagtggtacctttttttacaatccatgaacctacattgacacatcattgtcactcaaagtccatagtttacattagggttcacccttggtcttgtaaattctgtaggttttgacaactgtgtaatgacatgtatccaccattataatgttatgcaaaatagtttcactactctaaaaatcccgtgtgctccaactattcattcttatctccccctagaacctctggcaaccactgatctttctactgtctccacagttttgccctttctagaatgccataagttatatgaagcttttcatttccgtttatttttaaaaatatgtgttaagatgtggaggggagaggatatctttttgttatcattgttcattattttaaatgatgaaataaactttttcctttatatttaccatttccctcaaacatagcacattatggaagccagcattatcatcattttcatagaatttactgtacttatttctagtaatcccacaaataattaatctgaaaattaaccccaacccttctgggaactcccagaatgatgataatgcataaatgattctttgctaatccagaatgactgggagatatacaggccccagaaataaagtccctgggagtcttgacctttgcctacaagtgagggactctgggaatgcctctctcatcatctgtgtggctataattccaagcactgaagggacacattctcttacatataaatacacatactgccttagta

SEQ ID NO: 8009 - DNA, 1050 bp, Homo sapiens
gagagaagagtgggaatggggaagaagtaatatttgaagaaatagtggctgagaagtttctgtaattgatgaaagatgtgaggctttaaacatgaaatttattctgctaagcaggaagaagaataatgataaatccacacatatacagtatagtaaaatttcagtactttaaggataaagcaaaatttttttcatggctcaaatggcagtttcttccttttttattaaggttaaagatacataatataaaatttaccaccattttaaagtgtatgattcagtagtattacgtatactcacggtactgtataaccatcatcattacctatttccagaatttttttcttcatcccaaactgaaactctgtacacattaaaaaataactcctcatttctcccttccccatccctggtaacctttattccactttctgtctctgaattaaagtgaaatatttcaatattatcagagagaaaagatagcctataaaagcccaacatttagaccaatagcagacttataaatagcaatgataaatcccacaagataatgcagtactgtaacagcttcaaagtgctaaagggaaataaataacatcctcaaattttctactcacctaaactattaagaatgagggcaaaataaagacacttttagatctagaaaggctaaagaattttgctatccatagaaactaactgaaagaatcattaaaggagcatgctttcagcatgaaaagtaaatcgagaatgaaggatgggaaataagaaataaggtaaacataaaagtcaatgaactatgttaaaaatttcattaactagtgtgtgtaagaaaaactgtttcatgtttaaaaatgaaaactctagacaacgatcatttaggttagagaggtgtggtgttttttttgtttgtttgtttttggttttctgatttgtttgtttattgagacagagtctcactctgtcaccaggctggagtgcaatggcatgatcttggctcactgcaatcaccgcttcccaggttcaagcgattctcctgcctcagcctcc

SEQ ID NO: 8010 - DNA, 1034 bp, Homo sapiens
tctcctcttaactaccaaactctctgaaccactcccccggcatttccacttgcaacccaggaacagtaaagtactccctactgtatgttcccatgtacctatctcatacctctattaaagcactacagcattatcacattgtactgaaatgttagttttattccacagacagtgaactcattgaggtagaaaattcatttctgaattttcacatttacagtgtctggcatggcgtcgagatgtcaagtgccttgcctatcatcacttagtgaagaagtaacagtggagtctgggctggggcttttctactttgctagtcatgtaggcattttcctgctacataataaaccaacagcagagccctctgagggtctcacagagactagtgcaaatcataggtcttaccattgtcaataaacagtgttgacaagctgaaactcctggtacccatgattacaaagaaacaccattaatcagaatgtttcatgaatctgatcttatagaactcttatatgcaaatacaaatgttgttttaagacctaagactagttttcctattctttgttagttaacactctaaagaactctccagagacagttcaaatcttcaaacacttcaaaagcccagaacattctaatacaggatcatcttaactgacctaccagcctgccaatcacagagtctgattcaaagacaacagaaagtttttctatgagccagaggtcaaaacttagaatgagcaaagaagcattttctcttacctcagattgttgcagaagagcagaaaaagggaagacaatgcatccaagccaattctttcttatatatgagtgaccactacagctcttgagacagtgatcctatgaaaataaataattttttattacttacttaatatcatgtgatgaatagttttataaactcacaggtaaatataaaaagtcattctctttcttctaaaaaagaaatcaaaagataaatagaaaagatctgtttttcttgctttttaatttctttgaaagataactattta

SEQ ID NO: 8011 - DNA, 1029 bp, Homo sapiens
ggggtctccctgtgttatccaggctgatcttgaactcctgagctcaagcaatcctccctcctcagcctcccaaagtgctgggatcataggcatgagccaccatgctcagcaattgctgcattttaaacctgtgtctgactgtcccccaaacccatattattaaaactacgctgtgcagcctgctctcctcgacttcacagcccttgctcttggtcactgtgctcatcatctttatagtaaagaggaggctttaccttaaccccatggctgaggtgaaactgtgcagggctacctcctgcagtgttggtccacaggtactaacgctaatagttgccaaaatattgttgactgtttactgccatctagtggcacttacaactacggcaggagatcatatagagggaatgaacttctattaatagttaacaagcttggcaatgaaataataaacaatgccgagaggatacagggaaataaatcatcatgacaaaaaccataaggcaagactgtaaatactgacacttagcaagatactcatggtagggctagaaacagttcagaaatgatagctttctggtggtacaaatgtagaagaagcatataaattaagctgtaaacatttcagatagggaaacattaattcctggctcacttcttataagattaaaacctcagcaatggagcatgaggagaagtgttttttttacagatcttaaaatacacttattagaaacatatgatgggctgggcacagtggctcatgcctgtaatcccagcactttgggagaccaaggcgggtggatcacctgaggtcaggagtcaagaccagcctggccaacatgatgaaaccccatctctactaaaaatacaaaaaattagccgggcgtggtgggtgcctgtaatcccagctactcgggaggttgaggcagaaaaatcactagaacgcgggaggcagaggttgtagtgaggcgagatcacgctattgccctccagcctgggcagcaagagcgaaactccatctcaaaaaac

SEQ ID NO: 8012 - DNA, 1034 bp, Homo sapiens
cagcagctactaaagaaggtgcataatttagaaaggcataatctgtggagacaccaaaaatgaacttaaggaacagaatacacgagtcacaagtgcacaagtcacttactggtattcacaacaacccaccttgcaaagatacttccaggaagtaatctgcatatttggccatgtagagtttagtcttttccaagcaaatcattggccagccgtcatgaagatctgtttcgtgtactgcttcagagagataatactcaatgaaatgggcggctgttggaaggcagaggttccactgaaaggtttctaataataatagttccatatgtagcaaattttgttttgttaatactagattcatattagtcatacaacccaggctgttgagctgctccagcttaggcacactgtcttctttttcttcaaatttaccttataagaaaaggggatgggaggggagagaaaatgtcaggcaagtgatcattattggtctagtcagtaaaatgggatttgctgtcttattgccaggatttagatccaaagacgtacttaccttacacagatacaattgtgccagaaccctgtgttttctttcccagtgccaccatccccaacctttccccaatcccctaaaaaaaaatgcttgaaatacataaacattttgatctgtgttctagtatagaatggaaatagtcatgtgccagtgaaaaaaataactcaatctcatcagctgaatattttcaggaaattttttttgcaggtgggtggtagctggtaaaataaattatttgattttagagtagaagatagttttttttttttttgagatggagtcttgctctgtcgcccaggctggagtgcagtggcgtgatctcggctcactgcaagctccacctcccgggttcacgccattctcctgcctcagcctcccgagtagctgggactacaggcgcccgccaccacgcctggctaattttttgtatttttagtagagacggggtttcaccatgttagccaggatggtcttgatctcttga

SEQ ID NO: 8013 - DNA, 1941 bp, Homo sapiens
tttttttattttttgtagagatggggttttgccatgttggccaggctggtcttgaactcctgagctcaagtgatccacccaccttggcctccagaagtgctggcattactggtgtgagccaccgtgctggccaattttttgttacctacatcccaagagcctatgatgtgctatcatacatcagatccctatcacacacaggggcgtaagatgagtaagacaaaatccctgctctcaagaaacatatgttcattctatgaaatacctaaccacggattttcagaactgtcgaggtcatcacagacaaagtctgagtaactgtcacaacccagagttgcctaagacctgagtgctaaaggtaatgtgatatcctgcataggaatctgggagagaaaaaggatattagggaaaaactaaggaaatttgaataaagcatggatttctgttagtaatagtacatcagtactggtgcattgtgacaaatgtaccatctcaatatattaataagaagagagactggctgtgggctatatggggactctgtgtactatcttagtaataattctgtacatctaagctgttctaaaattaaaaatcttaagaaaaaaaaaggacagcctgggtaacatggcaaacccccacctctacaaaaaattgtaaaaatgagccaggcatgtggtggtgtatgcctacgatcctagctactcaggaggctgaagtgggagaattttttgagcccaggaggtcgaggctgcagtgggccataatggcaacactgcgctccagcctggcagacagagggaagatatgtttgacatagtttagatatttgtccccacccaaatccatgttgaaatgtaatccccaatgttggaggtggggcctagtgggaggtgtttgtcatgggggcggatccctcatggcttggtgctgtccttgtgatagtgagttcacttcatgtgagatctggttaaagtgtgtggcaccttcgcctacccccacttgttcccaccaagtgagattcctgctcctgcttacccttctgccatgtttcttgaggcctcccagaagccaagcagatgccagctccatgctccctgtacagcctacagaagcatgagccagttaaacctctcttctttataaattacccagtcctgagtatttctttatagcaatgcgagaacggcctaacacaaggttctagtagggagaaactagcaagtaaatggatacaagacagtcactcttacatttttaattacaggtccctttgagtagacaaaactttaagaataggggaaatcatttacatataaattgcataccatgtcaaggcttcatggacttaagaactaataaattcagggtggtgatgcttacctgggaggcagagggtgttatgggaggaaacagagtggtagtcaggcaaggataggatagcaggtgtccttcccatatgatccctgagcctggtccttatgctgtcaactgactgtacttgctactttaaaatctaagggattgaaaaatgaatgttgagtgattcctaaactaacacgatattaaaccgagttccagactacaccagcctaattttatttagtggcagactctagctctgttgcccaggctggagtgcagtggtgtgatctcagcttattgcagtctccacctcctgagttcaagtgattcctgtgcctcagtctcccaagtagctgggactacaggtacgtgccaccacacccagctagtttttgtacttttagtagagacagggtttcaccatgttgcccaggctggcttcaaactcctggcctcaagtgatccactggcctcagccacccaaaatgctgggattacaggcatgagccaccgtgcgggcctctactagcctaattgctgcaagtgtgctagtcgtatttatcaaactagatgtaa

SEQ ID NO: 8014 - DNA, 1030 bp, Homo sapiens
atatattttctcaattgtaaaagtaatccataattactgtaagaaaagttagaaaacacaaatttgcaaaggcaaaaataaaaatcatccattttcactacccagcgataactatgatgaccccttgacagacatcctttcagattatcaaattaaattagttgtctttgaatcagttaaacatacccattaagctaccaggaagtgacctgtgaataagggaggctttcagcctctctgtaatcaaagactactttcacttagtaccttactagaaggcatatctgtaaaatgtgagtcttactaaatgtaccagttgctaatatggtagcacataccctaacaatccttttaatatatatttctcagtgctatttcttggagagcatggtttctaggattctagatttaacttttatttttccatgccttgatatgagacccacagaggccatagtccttaaaagacatgaacagtgtttccctcaggtatgtgaaggaagagaagtgtgaaattggaggatatggtcaccttatctcaggctttgacaggccccctccctggtgtctaaaacccatgaggtacctctgccaaaaggaaagacaaagaacctttgctgagctatttattgccttctgtgtgttgggagagggggtagtgttggtggctgagtgtgaaaactcctgggacagtcatctttttatttccactagtgcccaccacagtgcctgaaatgcagtagtttagtggtgtattgaatgaaggtattaacaattgtgttaataatcaaggtcaaagagaactcaggtcatgtgaggtcatatgttgataccagctcacttctgatgactcttaactgtgtaaaagacccagaccttagccatggctgttacccttccaggacatgtccctagcccggtaacccagtggagtggaggtcggtacaggaataatctgcagaccattacaagaacatggctgcattctgtaggcccatgccatccagtcctgcacttctgtactggggtg

SEQ ID NO: 8015 - DNA, 1050 bp, Homo sapiens
tgtttgtccttttctccttgcacagtggaaaaggtggtcctcttctggtccaagcctctggatctcttcccattcattcctactctttaggatttttctcgtttacttagctatggctccttcccactggcatttaggcattctcacatcttttctgtcttagaagaaaaaaataaaaccatcctacaccaatttgccgctctctcttctgtttcatacctctctgtccacagacaagtgttcatgaaaaagttgtctttactcactgtttatttccgtgaacttcctgtttattcttcaaccaactgcaacattttatctcaactgaaattaccagttttaaaggtcactaactaccacttcatttctaaatccactgggtatttctcagaccctatctgacttgacctctgttcagtccagtgtgacagtttatccactttcttcttgaaatcttcttttacttgggcttcactgacaccagtgtttcctagtattaaataatttacttctgtggtcattcttttgaatgtctttagagctttgccttcattcattctctcatccttttatttgtgtatttataaagcatttattacatgccaggcagcatactaagtattggagactgagaatctgaagcaatacctggactctttcttcagaaaaatatactcccaaacaaacactgaaaatttggcatacattttcaagcctctcacacagtgttaaatacatgcatatcactctagaatcttgcttcagggcctccgaattatcttagcagaaagttgttttttttttttttgagatggagtctcgctctgtcacccaggctggagtgcaatggcacagtcttggctcactgcaacctccgcctcctgggctcaaacgattctgctgtctcagcctcccaaggagctgggattacaggcatgtgtcatcacgcccaggtgatttttgtatttttagtagagacagggtttcaccatgttgcccaggttggtcttgaactcctgacctcaggtgatccacccgcctcagcctccc

SEQ ID NO: 8016 - DNA, 2275 bp, Homo sapiens
taggcagagttcacatattgggtcgtgttattgttttaaggtttaaatttagataacatgttagtacttgttgagattttaacaaaagcattaaaaaaatgagaaaatagattaatctttagaatattttaagtttgctactgcgcagtggtaacatgaagacacctcataataagtctttgattaccagaagcttctgaaagtaaaattatgggtatattaatgtgagttttcctctctgcagggtgtcctatagactttgtcatggagtgaaacagaaacaaatgtgagttaatcattaacatttcctagtggttaaaattactttttaagcgcttaactgtgtattttttagattgaagatttcaaatgaaattttgatttgactgaaatatttaatatgtgatgagttgatattaaaatacagaagattactatttttatagaaacaataatgtagaaactaatatttgaagcaggtttactccacatactgtgttataatttaaattttcacttaaactctcaaaatcagaagagctgacctagtaaggcttaaacctctaaaacttgtggttttaacaaggcttaatatacgtagttataatagtttttaaaaaaattgttatcaagttcctcaggtgattctgatatagtattttaaagaaagcaaagagaaatgatctgtttatacattttaaatattttgttccttatttatgtattgagactgtgcttataaatgcattcacacgcattgaagtacataatttgatcgtcatgccagcctggaatcttgctttttgtatggtttcttgcaggtaggtctattgggttcttggcatagtacctggacaaaacattgttaaggtggaaattttcattgtatttatcacttcaaacacttgaccagtttatttagttttcaagcgctttagacaactatatgtgggcttgacttagtgtataataaatgtaaagtttgatctcaagtagttgacatttatggagtatttaccatatgccaatctttgtgataattgctagacatattttatttaatgcttacagcagtactgtgagttaggtttgttaaatccctgttttaatagatggagaaactgaggcaaggacggattaagttacaaatccgtctttgtaacttagagccatcttcttacctacttgttttgtatgacacccttttcctccatataactgaacactggtagaagagtgaatgactgtagaaaacagacctggactctattctacctgtccagctttgtaaactagggcaagttgtgtgaccactctgaatttcattttcctcacctataataaatgaaaactttgaactattatgttttattgaatcttgaatcatcagaaatccttaaggctgggtgtggtgcttcacgcctgtaatcccaccactttgggaggcccagatgggaggattgcttgaggccaggagtttgagaccagcctggtcagtcagcatagcgatatcccatctctaccacaaaaaaaaaaaaaaaaattccttaaaatggtgcctttaccatcaaacctgggattttcttccaagcccctagtgctcattctgagttttgaagttttgatgcacggcagtgccaactccatctccattgccgtctagtctgattacattgtaagatgtgactgatttcagagatgtcaaaatgtaaaataatgtgcatcttggaactaatgagctctttttcaaccctgactctgtaacatctgtgactttttaacattttattgcaggattaagtatttttgaatgtaaatgattcaagataacacatagacttcgtttgatgacatctgcaaaataaatttttaaaaaatttgggcttcatgataatggaaaagtagaaactatgtttgtctttatcacctgtgaatcccccatattgagaacatgcctggcacatagtgagtgttcagtaatcatttactcaatgaagtaaacaagtcttcatttcttttttctttgtttgagacaatctcactctgttgctcatgctggagtgcagtgacgctatcttggctcactgcaacctctgcctccaaggctcaagtgatcctcccgcctcagcctcccaagtagctaggactacaggcacacaccaccgcaccagttaatttttgaatttttttgtagagacagggtcttaccatatttcccaggctggtcttgaacttctgggctcaagccatctgcctgcctcagcttccaaagttc

SEQ ID NO: 8017 - DNA, 1049 bp, Homo sapiens
gaggctgaggcagaagaatcgtttgaatccaggaggcggaggttgcagtgagccaagactgtgccattgcactccagcctgggcaacagagcaagactccatctcaaacaaaaaaaaaagtgtggtgtataataaaagcttttatttttagccaaacaggtgaaaatgacatctaattgttgctctgaattgtatctcagcttttcctacattgaagagacatttgtatttctgttctaaagaatacctgttcatatcctttgcccatttttctacttgatcattactctttccaacagatttaaactgtgtaaattaagtcctatgaaagtaagtcatttgtcatgtgtgttacaaacatttttgcacagtatttcattacccttttgattttgtatatgacgtttatgatccatgcagattttttgttttatttttattctattgaatttttcctttattattgaagactctgggcttcctctgaccctgtgtttttcattctgtgccaggactgtgggccctctcttggattagcggcgggcataccattgctggtggccacagccctgctggtggctttactatttactttgattcaccgaagaagaagcagcattgaggccatggaggtgattactagcttctttgggtccagatgtataggcagccaccagtatttcagtgaactggcttttggactaagggtgtcagaattcagggcccatgtctatttcctgaggacaagatgctggaagtttctgggccataatttccactgcagacatgacattaggcaccagacagagctgatttgtcataaaaccttcaggtcagttgaggaattcctgacaaagatggtatttggggtaacaaaaagtagcagtggagaaggatgtctgttgccatggcaaacacatgtctgtacagtgggtgtgctttctaaagttgagaaacaaaagcgcacaagcttcacaaagaaaggatggagataacgttaagaaagataggagatgaagaggggctgaggtgtccatgatagacaccat

SEQ ID NO: 8018 - DNA, 1047 bp, Homo sapiens
ctgttgactattttgtcattgatgtatgtgaaaccatgtggaaatccaaaaggaaagttgtccatttttctgcttgcagtttaaattgaaaaaagattctactgggcatgatgcaaaacatttctacacatacacatttgtgtgttatagttgacagggccattttacttgcataaaaagatctttgaaaagcctcacagtaataatactttttatatctctaaatcaaaatggctcagttctgagaatttttacattttaggtacaaaatagaagtgggtttcaaatagctcttgattagtgtcattatttgggcatatgtttttaattggcaaaaaaaaaacagacttcagaaattggtcatttttattccatcaagttaacggtgagtggcttatttaataaaaacatgtctgtaatttaacacaagtagcacgtacagctgttcatttgtgtctttttgactgtgtgaagcatcttagacggttttactgaaagatagggtcaccgagaggggaaatctgtggacttaaatcttttttcattacctatcgccggccactaggttaggttagttgccgccagcaagcgcccttcatggctcgactagggaatgtggagagagctgagagaatcgaaatcctcgatttttttttctttgctgagagggacctgagagacattcactcatccctgcaaagaagcagctgcccgaatgcacatagccagttggtagtgacatgaatccgtacacagggctcctggtccagcgctccgagttctaaccactctggccacgtgtgcatcggggagttgtaaagtgagttatggaaataaaacaaggcgagaagcccagtcccgatcttcaggagcagcattctcgggagccagaggccgaggtggcgccccgggcaggcgccttaggctgggtgggtgcggagctggccccggcctttggctccagcatcttcacctcgctcgcctgcctccgaagttgcgaaggtgccgggaagaggaggggcctcgcctcgggcgcccgagtgattg

SEQ ID NO: 8019 - DNA, 1021 bp, Homo sapiens
gaaatgattttcaaagtttgcacgattactttgcttgacagcgatttcaaaggaaaaaaatgtgggagatggttgcaggggaaaattgatataagtggggctggccaatgttatggttattcttagtgtctcagtctaagccactaggattgcaagacttaatattgaaggtcagtgaagaaaagggagagtctagaaagtgagacatggaaggtgattctaagttggggttggtcagagaggtctgctgcagttatagaccagaaagggcagtcctggataggtaagtgtcacagatagggtagctgcaatgctggcatgaggatgtgggatatgcgattatcagtgtgtcccaggcagagacatggagggtgtgaagcagccttgttaggatgactgcagggtgttttaatgccagaagactggaatgtgggagttgtaaggagccaagactggaaaggtgaaaggaaggcttgatgatggacggaggacctgttatgccaccctgaagaacttgaataaaggttttggagagccaggaagggttttaagcagctgctaaaaattgtagtatctttaattacattctccagaaaactgagtatcttctcagtggtgagcaatgtaaatgaaggaatgagctggcctggaacaaattatcatgtatagtcgcttggaaaggcaaaatgagaaagtggcccaggtggataaaactcagtagacttgaaggggcaagagaacccagttactctgggtgggagatggacatctaagaggagaaaaacacttgttcaggttcacagaggacccagagatatggcagaggaaaccctgaagtaattattaatgtaataatggagctaagttgagcagttttatgtcataaagcctgttactctacctccagttttttcatggtttttaaattaaagaaaaatacattataaaaatcatctaaacccagattagagtttagcttttatagttctatcttatggtgtcccttttcaattattctttt

SEQ ID NO: 8020 - DNA, 1925 bp, Homo sapiens
aatagtatatcttcaaatcaaagaaggcatgttttttgatttaacaaccttttgccattatcaaattattcttgctttataagagatgtattttaattctgtagttactgattatacaagaaataattgctacttgattagacttggcgtatgatggtcagactcagtgtattatggtatcaggtgatttgcaaagcaaatgatacagttttagtaagttcagagagaatactaacataaggatattttctttaaaaaagaataactttccagagcatagagtatttagtgtttttaaatgatggatactgctctgtatgtatttgtttcaaaacatcttattttatctttgcaggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcag

SEQ ID NO: 8021 - DNA, 1022 bp, Homo sapiens
agaatgtcatcataatacaaaaattatatatatccatcaatttatgttgctaaaatgcttgtcagtaattaaaacaaaaatatttgttgattttttttaatgtaggaaaaaatgactacattaaggtgggatattatgagcatagcatttttgttttgaggaattaagtttaaaagtgcacctctattattcctaagatatttacttttctagagggcatattcagtattctctttttataaagtcatgcccttgtaagtttattcttgaggtactcataagattaggaaaaatgattctctaggttgaaactgttttgattttaagcatatttctgctcaaaggggaacaatgttttgtacgtctggaaaattggatttggttattggactagtattataccattaaaatttttgatgctaattaaaattttatacatcttttcgtgtcgtaaggattcaggtatattttcacaaaattgaatgatttttctcttatcctgtaaagaattgtattgtaactattctaaaatgcattatcaatattttaaaatgtaatattgttatttcctattataaaagaaatgtcattgcaaaaataagtggaaatagtgttgctttgtcactttggttttttgtattttaatatttaataaagggaaactttgaaatacatacaaaaatagggacaatactatatatagtgagtccccatgtactaacacccagtgtcagtaattatcaactcatggcctatcttgttttatttatattctcactttgtatcccccccttttattctgacatgaatcttagaccttatgtcatttcaagtgtaaatatttcagtatatgtctctccctgaaagataaatgtaatttcttaatatgatggaataattcagttaatgttcagatttaccacacttgcaatgacttctttttaaatatagtttgtttgctttgagatcaattaagattcatgaattgcttggctgaaatgtctcttaaggctcttttagtc

SEQ ID NO: 8022 - DNA, 1053 bp, Homo sapiens
taacatggccattaagggtctttataacgtaagaactggccctgttcacttctccaacttcatttcttagttctttccccttcatttaaagtattagccatagtgactaagaaaaagagggtgaaaggctctgttgtaatttagtgatgacttgataatggattagagtgaaagatctttttcttaattaaaaatcttaaagccttttcccttgctgtcctctgaagacagtgtgaatcttcttcaggcctgcttttcctaattttatacattattgctctaacttatttttctacttattattttattttctatttaataaaatacaaactacattgcttgaattgtgttgtatctacaaaacaatatggatacaaatacggattttttagctattttcatttgttcttttctacattatacttcttgaagcttctgttttattcagtttgtgtagaggtgaatgccctactgaagaatctgtttttcaaagattatccaagaaaatattttttgagagaattctagtggatttaattgatgaagacatggtaagagaagctgttggaagatacttgaaagaaagtcattaagtgagaaaaaaatgagaactaaaatgtgagactcacgaagagcagagtgagctttaagaataaagactggaaacctgtgtctttattgcatttacttaggtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggtaagtacctatttgtggatagaaatttggggaaccataatattttaaaataagatttcctttgaaatctatcaagtggagtaaagagctgtatagaaatgttgttacttaaaatagcatagggatttttttccagttataaaaatgatacatattttagagaaaaaatatcaaatttttaatgtattaatggagtactgtgttagaaatattt

SEQ ID NO: 8023 - DNA, 1035 bp, Homo sapiens
ctcaggtgatccacccatcttggcctcccaaagtgctgcgattacaggtacgagccaccacacccggcctgatgttgcatttatgaatagtttgttctttgtattgcccaatagtattcaattgcatggttataccataatttatccatttgcccagtaatttactagttttttgctattgtaaatcaagttactgtatttatgtgcaagtctttctatggacttatgttttcatttctcttggataaataactaggagtggaatggctgggtcatatggtagtttaagttttcaagaaactgctaaacttttccaaaatagttttgacattttacatttctatcagcattctgtgaaaattccaattgttccacatcactgccagcacttgatatagtaagtctttttaattttagctattctagtgagtatatagtgctgtctttcggttttaattagcacttcctaatgactaatcatgttgaagatctttttatttgcttttttgccatctgtatattttctttaatgaatgttcagatcttttgcctattttaatagattgtcttcttattgagtgataagagttcttatatattgtaaatacaagtcttttgtcttatatgtattttgtaagtatatactcctattttgtgggttgtcttttcataatctaaagagtattttttgaagggcaaaattactaattttaaagtctaatttactggtatattttttcttttatgctttgtgctttttctgttccatttaagaagtcttttgccaaaccagacatcactaagctttccttatatgttgtcttctagaaattttatagttttagctcttaaatttaggtctaggatccatttttggccaattttatatatagtatgagttaagggccagaggggttttgttttgttttatatatgactgttcagttgttccagcaccatttgttgaaaagattatcctttctctgttgagttgccttagcacctttgttgataaccagtttaccatgtatgtgt

SEQ ID NO: 8024 - DNA, 1138 bp, Homo sapiens
catggccaatgtggtgaaaccccgtctctactaaaaatacaaaaattagccaggtgtggtggtgggcacttgtaattccagctactcgggaggctgaggcaggagaatcgcttgaacccgggaggcagaggttgcagtgagctgagatcgtgccactgcactccagcctgggcaacaagagtgagactccatctcaaaaaaaaaaaaaaaaaaaaaaaaagaaaggtaatataaaaccaatgttagaaaagcttcatcatctaaggtgagctgttcacaaacgctaaagcaagcaaaaggattttataaagatatcaagatcaaagactcattgtgtgggatcagtgatgtaacaaagtaaaaaaaaaaaaagaatggctctatcccattcttcctctttatttttcatcaaataaaatataacccataaacaaaaaaaagtaagaggaaagattccctggtaagagggaagtgaagcctaagatacgcaaggcagttgattgtacaggagtacccagctgccttagcttgaaagtcttgttgctcataaaaatgatcttttagagataccgagagatcacattaagtaatgtttgaataactgtgtgagagcagaggtgctgtaaaactggatgggcaaatttacttttccaggagggaaaggaagaaagtgggttctaccttataagagtatcgaagtattagccatagtatgtacatgctatcctttagtagaaggtgacagatattcttgattctgacctattcaaaagatgattaataacttagagacatggtggtctgctgattcaattgaaaagggatgtgagactagggaagaaactagtaatataaaataatgaactagtaatatgaaataatgaaggcagcatctaaaaagatctcacctgactgaaatgatgtgccaaatctaagaagatgaattataataaggatcaataataatacatttgtgtagcactttgtagtttacaaagcattttcacacgcattatcttgtctggttttcagaagaacgcaaagagataggcagagctagtggtgtggttattcctattttacagaacagaaaaccaagactctcccgtagttagttttctttgttgctgtgctggtg

SEQ ID NO: 8025 - DNA, 1051 bp, Homo sapiens
agatatttggaatttaaaatgtgcagaacagccattgtaaaattctttgttatctcatttcacataatttctaccaaacctattgtgtgttctgtcttgcttttgtggaattctcgcgttttatttcctaaaattatgaataattagtagataatctcctttgtgcaccatgtaatttgccctgaggaacatgtaggagagtgcatttaagttattgatactatttgctttgaggtgcctggctctagatgtgctccatgtgatgcatccacacagaaaaaaagctttatagatgaatataaaggcatgtgtaatggtctgtgggtaaagtttctggacaatggaaagagaataggaaggaaagttatgtatttctgttgactgttagttttatcaaaggacccttcgcaaagatttctgctattctttgtcactgtcacagtctcttgctaagagcactttgtcttaaatatcctgttgctcctttactactattacctgaaattgatggaactaataacacgataatacaaggatactgctccttggtgtttttttctgcagtggcattcagaaatgccttgtattccctgcagtagtctgaggtcagaaaagtacaaaaattggtagatttgcattttagtttatgaatgaagtgttgttgaaataccttaaaattatatttccaaggatggagttgtgattttccacagcccatcttaagcagtgtcagcattaggggatcctgccttcttttagtagactgggcacacttataggttataggaaatcggagcgtaggattatatcttggtttaccattgcttttttattaatcttcctagacttaatgtgacctgtaccttcagtatagataattatttggattgactgagggagtgtcactatgggttcctgactattttaggtagatgttcagtctctaaattcgactcgcaggtgtgggaaattagtcctatcatataggactacatcctaaggaaataaggacacatgaggcaacttctactttgaatttgacctggaaatt

SEQ ID NO: 8026 - DNA, 1031 bp, Homo sapiens
tactggttttgatactcttctctttcatttctccacctagcccctgattgtatatgagctacagctatgatgtgaatagcaagaatagtgtctgaaagtggcattaagagagtcagtgcactgttctcccaatttgaccatttctttttgttactaaaccttttctttttccgttatttgagattctctgagcacaaccagaagtcaacttcctgaacctcagcattttaacattgttattaaggcagtgatcattctaagtttggaatatactttctcaatattttgtatttctttagctataaatttggagggaggaaacttacaactgtaatttttacatactatgttttagtttgattctgaatgatttgcttttctctctctatatatatatttgtatataggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagtaagtgcctacacttaactgtattatgtctttattgttcttaaatagttttaatcactggaatcttttaagtcaatcataattaaatcgttacttatttcctttatcttacagtttatgataaatatcataaatgcagacagacaaattaaataatgaacagtaatctgtatttttctgttacatgccaaaacttagtagcattactgaacattgtggttagttataaaggttatatgttccattaaagatatgaacagaggttactttcaatccagagctgtttgacaaagtaaatagccttttttttcctaaagttgaagatccaattagagcttcatcagaagttcaagaatttcagttactaagttacttcatatttaccttcagatctggaaaacatcagagtagaagaaaacattgtaaataatagtaaaaagagtgatgaaatagtcac

SEQ ID NO: 8027 - DNA, 1044 bp, Homo sapiens
ttataggcttccctacatgggcacttgcccttatacaacttacggtgtgagaaagaacagaatgtatgcatcagaaggaggtaatgagagaacggattgagatcaggaatttctgcttgtggaaatccttccatgtagaaagaaacatcaagaatgggaagaaatggcctcccagttccccagcccccaccgacagatacttgctgaattttagttcataaagccggtagcattagtgttggttttgtacaggtagttttgattctttatagcaaaaatcacactttgttttggtggtttcctcctcaaggatggagataaaaagacaaggcataagggtatcccttcttctgaatttcttcctgaattgttgcttctttcttttgatctaatcttttggactagaattttaaagtttattaatcacctatttttgagatggcccgtaagtttttgttgtctcagatttacatattactgttaggttccattcttagactctaccggaacctatcactacttctgatcttactcaggggtcagagattttaacaattaagctatttggaatttagtctttttttttttttttgagacagagccttgctctgtcccctgggctggagtgcagtggcatgatcttggctcactgcaacctccgcctccttggttcaagcgattctcctgcctcagcctcccgagtagctgggattacaggcacacaccatcatgcccggctaatttttgtattttttttagtaggggtggggtttcaccatgttggtcaggctggtcttgagctcctgacctcaagtgatccacctgcccttagcctcccaaagtgctgagattacaggcgtgagccaccgcgccctgcctggattgtctttactgaaggatttagcatactactcttggagctaaaatttttcccctacctcaatccccacctcaaccccacctgctgtgtgttctcctcgagtataatgctcaggcaatcttcaatagggtatggacacagataatttcaagatttagataaca

SEQ ID NO: 8028 - DNA, 1042 bp, Homo sapiens
atggattgctctgtcagttggaataatatactcctgcacagtgagagcttgtcagagccttttagcaactgtcaagctatttctgttgtcttaggcttaaaaatagtaaaaatgagagagaaattcagtgtaggtagcctctgccagttattgcctcatagctggaatgagtccattgctagtagtcaattttgaaagtttttcaagccttgtgcatatgtacctgatgcaaataatccttatataactaaacttaatgaaaaaattttatagttgtaataaaagtaatgcagtctaaaaataaagatttacagatttttttttattattcattcaaatatttattgagcagctaaggagatacgaaggtgattcagaacatggtcagaggagaggcgaatgtgcaagtaatagaaagcaaagggcaaggttcactgaatcacagcaatcagaagaaactgctttagggaaccaagagtgagattgtttccagcctaaagaggcatccatggcagatcagaaaaggagattgagattaaaatagaagacttcagtctggattgttgatgatactcagtatggactatatttgtctctccttttcttttctccccatctttgggcttaatttaccagtagtgccctgaactgttcaatgcactttttgtatacttgcttgcatttttgctttaatgttttctacagaactaggtccttttggtgttttaggaattttttttcctgtttttgaaggatttttgtccttttgatcttagtgttgatagttttgagtcttttccattctgatttgacttttgtgcatttttggctggattatctcatgtagatttcttcactggtggtttttctttagtttcctcatcaaaatcgtcatcatcatcatcatcatcttcatcagcagcaagttttacttttttctgtggaaccttgctaccacctccagggacagatcactttccagatatccttaagaatttcgcctcctcctgttcatcttctgattctgcatcttcctccacag

SEQ ID NO: 8029 - DNA, 1059 bp, Homo sapiens
tttctgttcttgtgttagtttgctgagaatgatggtttccagcttcatccatgtccctgcaaagaatgttaactcatccttttctgtggctgcatagtattccatggtatatatgtgccacattttctttatccattctatcattgatggacatttgggttggttccaagtctttgctgttgtgaatagtgccacagtaaacatacatgtgtatgtatctttatagtagaatgatttataatttttggggtatatgcccagtaatgggattgctgggtcaaatggtatttctagttctagatccttgaggaattgccacactgtcttccacaatggttgaactaatttacactcccaccaacagtgtaaaagcattcctgtttctcccatcctctccagcatctgttgtttcctgattttttaatgatcgccattctaactggtataaggtagtagctcattgtagttttgattcgcatttctctagtgaccggtgatgatgagcttttttttgtatgttcgttggctgcataaatgtcttcttttgagaagcgtctgttcatattctttgcccactttttgatggggttgtttggttttttcttgtaaatttgtttaagttctttgtagattctggatattagccctttgtcagatggattgattgcaaaaattttctcccattctgtaggttgcctgttcactttgatggtagtttcttttgctatgcagaagctctttagtttaattagatcctgtttgtctattttggcttttattgccattgcttttggtgttttagacatgaagtctgcccatgcctatgtccttaatggtattgcctaggttttcttctaggatttttatggttttaggtcttacgtttaagtctttaatccatctcgagttaatttttgcttaaggtgtaaggaaggggtccagcttcagttttctgcatatggctagccagttttcccaacaccacctattaaatagggaatccttttgtcattgcttgtttttgtcaggtttgtcaaagatcacatggttgtagatgtg

SEQ ID NO: 8030 - DNA, 1065 bp, Homo sapiens
gtattatatcacggagtgatttcagaaatgttttgtttgatttactttggcaaatggaaaccttttgtctttgtctctgttgggagtataggaactcttaaaacttactgaaaacttataaagagtataagctgtttactataagtgaatttgtgagttatctaatgtagattgttaaatgccgtaattcgttgtcctattttcagctctactcaatgatagactgaaagtttatttaggtacaaagctatttttgagagagagtagttatctcaagagactattcaaaattacatttctaatttatttgtattagaattctgatgtgtgttttaataatttaaaggttttgaaattatgatttctggaacattattttgaagtaaacacatatatttttccccctttgtatgaaaatgaaggatagcatttgggtgcttgttctgaaccctcagtcctttgctcatctatgtaaattgtgatttcttattcagatttcacatgaccacgtcagcatattatcttctaaagcgtttctcctgataataattaattcattacctctgtcaaggaggaaaactttggtacccccccaacacataaacagtatttaaataagaggggcccaacattggtgacttcttgagaataaaggtcattccttttgagattagagtgcaaatagcttcttagaaggttttttttctttcaggcagattaaaggctcacatagaaaagttattcagtgttcaggactgtctttagttgctttgtacacctggcactgttttcatatttccttgatttagttttttgctctttaatgaatgaagctgactagggattagcaaaaatactaaccttttaaacttgatgctgattgatttggacaaattacttaacatctctgttctttagttttgtttttgtttttagtctgtaaaatggggaagtaataggacctattttatagaattttgagatgattatttaagtgttcatataaagaccttagaactatacctagctcatagtatgtatttattgttagctactgatgttatt

SEQ ID NO: 8031 - DNA, 1050 bp, Homo sapiens
actgcaacctcagccttgcgggctcaagcgattctcgtgccttagccaagtagctgggattacaggtgtgcgccaccacacttagctaatttttgtatttttagtagaaaggggatttcgccatgttggcccggctggtcttgaactcaaaacgactggcctcaagtgatctgcctgccttggccccacaaagtgctgggattacaggcatgagccaccacgcctggccgaatatgtattgtaaaaagcaaaacaaaaacaaaaacagttatgggaagaatagcatctaaaaataagcataaaattcaaatgtcatttatattattttttcactgttagccaaaatcttttgctttttctaaatttcttgaaaatatttctcaaaaactaggcattcctattcctcttagccagatagtagtaccgaaaaggctaatgtcaagtgagttttatttatttttttctgtcaaagaagcagaagtagctagtaaagagagaataatactaaaggaagaggagacattggtgtggggaagttgctgagtaggtgtttagtaaatacatgtagaattgaattatcaaacaataacttttagaagctgaagctggccttttaggttaattgcctgtgaagattgtttccagataatacctagtatgtcttttgtagtaaaatgggctatgcactgtttttttttgtttgttttgttttgtttttttgaggcatagttttgctcttgtcacccaggctggagtacagtggcacaatgtccactcactgcaatctctgcctcctgggttcaagcaattctcctgcctcagcctccctagtagctgtgattacaggtgcttgccaccatgcctggctaatttgtgtatttttagtagagacgaggtttcaccatgttggccaggctggtcttgaactcctgacctcaggtgatctgcctgcctcggcctcccaaagtgctgggattacaggtgtgagccaccatgccctgctggctatgcactgttctaagtattttacacttattaactcatctatta

SEQ ID NO: 8032 - DNA, 1122 bp, Homo sapiens
tcttctttcttatagctgaaaaatattccattgtgtaacttttcttaaatttaaaaagaaacttttttctgaaataatttgtgtttgtcataatgttaaagaagaaaaaaacccctgtaagttctaatttttccccttttataaataatattgcaataaatgttcatacagcttcatgcctaaatctttgtgaatctctgttaatttcctctggatcatactgctatagagtccccagagacagggttgcaagcctgctcttagcatctccccaccctcccccatgcaacctgaatctaccgccttccttactgctatttattttattttattccctttatgcttggttcagtctgtcgtttacatttgcagtttctcttgcaaggatagtcgtatggagaatgtgtaccctcctcccctcagggaaataattcataagaagatgaatggtttttatgacagttaccctgtgtaatgcatcaggtgttttacatgtatttattcctcccacaaccccaagtgcacagatggtttcagcgccattttgcagatgagaaaactaaggttcagagaggttaaatgattggggtaagcactggaactcactttggaacacagggcctttgggcctagaaagcttacacttggccttgcttctcccctaagtctttcctctccaccctcctcttccacactgagataaagaatgaagaatgctcaaggaagagaaaggatcagagaaaatgacgcttccctgagtgctccaggccataaatttccaagtcaggctgagcattggcaatttccctgcactatgtttaaaatgtggatacctgggccccaccccagacctactgaataggaatctctagaggtttgtcctgggaatatgaatttgaaaaagccttcaagttggttctgctatgcagcccagctttgagctttgctccatgcctggtgtcttgtctttcggtttttgggtcacaggagcccgcggtagctcaggccctgtggtctgttataggctattatgggctgttatgggcacagtagtcccaaggggctcagagcctggccttggcgcgtcacaggcagcagccctgagagaagagaagggagtca

SEQ ID NO: 8033 - DNA, 1103 bp, Homo sapiens
ctagtctcaggtattcctttatagaaacacaaaagcagactgatacaaattcgaccaaacaccgaacaccgatccgaacacctcccatcaggccccgcctccaacactggggattacatttcaacatgaggtttggtggggacgaacatccaaaccatatcagaattctaacattcttttttcatttctaatgcagttgtgactatgctttaaaacagaatccttatatttaactggaatgtttccacgtaaggaaaattctcatctgttgtgtggttaaacttaggcaattaaatggtccccttcatctacatctttaattctgagcctgcagttaggcaggatgtgctgacttgtgggttctgtggtgtgcatttaatgagcattaattattaatattattgtgtccattgttgtcgctgtaatccctgcccctgtctatgccaggcagtgctcttcatcagataacatctacatggggtattgggataggttccaaacaggctgagtaaaaggtacagctcgtgacccctggggactctgcacatcaccagagatgtcagccacaaagacaaactcattaaagcccacaaatttgcctgcagcccaactcctcccaattaatttacttatagccagggagacaaagaggaagccccatggggaaaccttgccaagtatgtgaaattagagggtacagggagacactggcaaggtggactattttaagcagctggcagaatgtctgagagaaacatgctaaggagatttactggccggggactcacacacaggaaaaccttggggatggggaatgggaatgagagactcatgtgagccactgttctttgcatgtattatcttaatacttacagtgatgctatgaaggtaggtgctttatcatcctgattttacctaaaacaaagactgagagaggttatgtgacacacccaatgttgcagaacatccggtaaaacaggaatttgatctcaggcatctcttcgccatcaccaagaaattacttagctgcccctttaattgtgctttttctgtaagaacagagctcattattgaaggctgtaaagcaacactgaactttcatg

SEQ ID NO: 8034 - DNA, 1056 bp, Homo sapiens
ctctggggtcccacccagctgcgtgagtctgctagaatcaggttctcagcatcatttgtgggcccctttcagctacaaatgcctgtgataatggagcgcaagtcagcattttctctgtctgtcccggcgtccttaccccagacttcaacttctggaagtgggaagggagcaggggcaagaggggccaaaggattattcagggcaggtgagcccagcagataacacccagggctgggctgacctgggcccttgggcttcccctctcttttctccccgcagacgcctggagctgaacggcatcaagtccatccctcctggagccttctcaccctacagaaagctacggaggatgtgagtgcctcccactgcttcctggggagctggtacagggctgacggagatcctgggtggtcccacagccctggggcaggccctaactcagccccccacagctgagtggccttggccagccacctgaccttcctgcccttcaggctgcttggctgtgatgcggggacctccttgcagggctatcgtgaggcctgaagggagtgctgagcctgagcctggcctgtgatgggagctgcttgtcatcctcccgtttcagcttgggtaccaataggagcaattaaggatgggagggggctaggagactgccaggatgcatgggaaagctttgtccataacttcccaagctggagtgccccctcctgcccagccctcagactgcacagggaaatagcggccatgggcttttcaaatggaggagagatctggcctctcactattctcatttcaaagcactccaccctgctcctgtgacatctaggaggtggaggggactgggcagggcttagtggctgttgagggattcagatgccccctctccttctgctcaccttgcagagacctgagcaacaatcagatcgctgagattgcacccgacgccttccagggcctccgctccctgaactcgctgtgagtagcagtgccaaggcttcctcagtggcccagggcatcccctgaggaggctggcagggcccagggtcctggtgg

SEQ ID NO: 8035 - DNA, 1052 bp, Homo sapiens
cctcttgagatggcagaagacctgcaaggaatctgaccgaggttcagggctgcccgctgggaggtgggggctcaccagccctcaggcctgatagcgccctaggaaacacacagcacctttagtggggtgtctgctagatagcccagcagcacagtcatagcaaagaaacaatccaaatccaatagcaagggtatacggctgtccagaaatgatggcaaatcagagtgacccaggggacaagacggtgagccaggggatacaggacctgggggtggtgctggagtgagtttttagcaggcctatgaaacatccagatccttccctccccaaacccttcagcacagcttctcatgaatgtgattccaagcaaatagaaggagatggatgatatgtcattatatgtaatctacttgcaaaatagtcctcgtttcacttttattttattaaaaaaatttaaattgtggtgaaatacacataacataaaatttaccatcataatgatttttcagtgtactgttcagtaatgttaagttcgcatcgttgtggacccgatctccagaacattttgacttcataaaactgaaactctattgccattaaatgacaactcccattgccccacctgccagtccctggcagccaccattctactttctgtctctataaatttgacagctccaggtacctcatagaagtggaatcatccagtgtttgtcttaaaaagaaattctttaaaaaatattagagatggggtctccctatgttgcccaggctggtttcacactcctgggctcaagccatcttcccaccttggcctcccaaaggctgggattataggtgtgagccaccgcgcctggcccagtgtgtatctttttatgactggcttatttcacttagcgtaatgtcctcaaggctcatccctgttgtagcatgtgtcaggatttcctttttttttaagctgaataatattccattgtctgtacacattttgttcatccattcaactgtggatggacgctggggtggctcccactctctggctcttgtgataa

SEQ ID NO: 8036 - DNA, 1080 bp, Homo sapiens
ccttccttatccctccccagggcacagtgtgtcagctcctgggcatttttctatggagcaggtaaaatagaatgatctcctcctatgcccaagagaagtggttttaacaggggacccactccccgacctggtctctgtcattgtccttttcggaaacgggaccatccgtggctgtttacatccccttctgcagcccctcctccacttgactgagcagccccgctggggagagacccaagtacagcatccagtcagagtgccctgagggctggggagcgcctgagctgtgggtactcactgcagccccctggggttacctctccaggcctcaggcggcccagcgggaagctgcttccaccccggcttcctcactattgctcggcctccagttcccaggacgctgagcttgccccacttccccttgtgattccaggtttttgtggatttctgcttgttgctttctacctcccaaaggaatactgttctgttgccctggctcttcaagtctgtgttctcttgaaggggcctccattctagggaggagggtagaactgcatgtcccttccctcctctttcagtgcgacgctgatggagttgcgcagtgagtggacaccgagcctaagtattttagaaccatgttaaatggccgaactgttatggacagatgaagacgcaggcacgtggtcaggcgatggggaagggagcatgcaccactggctccccagcctgcttggctgtgcctgctgggtcccgttcgtgaagcccgtgccttcgactctgcaggcacggggctttccccaggctgggcccgtaggcctctggcttttcctacgtcagatatttactttttcatttgtaacacactcaacaaatatttctgtttctgcctcattctggtctctgggggtatcatggtgagaaaaaaggctgtggtctctgcttttcagagctggtgggtcctgttggggatgtgagtcaatgtgagctgcaggagaggagacccctcatttggtgacttgcccaggttgcacagtgagtgggttagtagctgggagggaggttcatccaagggcctgcctg

SEQ ID NO: 8037 - DNA, 1027 bp, Homo sapiens
atgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcaacctctgcagggctgacaggatttaaaggagagaatgttcttatttggaagcagctgtggcttgtcaccaatgttcaaggagtgttactgttcc

SEQ ID NO: 8038 - DNA, 1065 bp, Homo sapiens
ctggtttgacatgattgttttatcactgggatatgagcataattactatttgagacatcagcaataggcagagatcaaaagcctaatccttatggataaattcttttctggaaaattagatttcagtatattcttcttacttatccttgaatgaattatctaaactctcttttctttcctcgttgcttctgtcttccaggctgggctgtctaattgagacaagatgggggtttgagttttttgtgtctaaatatttctgtatgtccatgaatcaaaaccaagcataagttatttttgaaggctacattgttttgtatcagttacaacttttgttgctgtcatttttgaaagacatgcggaaataatacctttctgtattgacagctctaccttggaaagaaagaaagacgttttttaaaaaccagtctaatatttcaccaataagctttagagcagggattgttgaccttgtcatctgtggacttcctaaatggtctaataaagttcccggtattgttgatgcaatcttttgtgtaggtacatatgtgtatttttctgggggagagaatatatggttctaattagattctcaaaaatgttagtagttcagagaagtcgagataatgaatgaccctcaattggatcaggcaatggcattttcactttactctctcctggtcacttcctctatctggaaatgccttcctggtgttatgatgctacattattctcgttcttcttcctctttaattcttttccttatctgcagtggcttactgttgtttgcctattccactacatctttatttttttcaatgctctatcttaagttctgctcttaagttctgttcgtttctgcacctgcttctcctgcctctttgcagcttggtctccttccactgctcagctctgctctctgtatgataactacttccagcctggcaatgccaggtctgaactctcttcagacattggcagtctccaagcccacagatccaggtgcctgccatgtatttcttttatacaacaatgaatatacaacctcagattttttgatagtgatgt

SEQ ID NO: 8039 - DNA, 1065 bp, Homo sapiens; identical to SEQ ID NO: 8038

SEQ ID NO: 8040 - DNA, 1065 bp, Homo sapiens; identical to SEQ ID NO: 8038

SEQ ID NO: 8041 - DNA, 1025 bp, Homo sapiens
agcctccggagtagctgggactacaggcacccgccaccacacccggctaatttttttgtatttttagtagagacggggtttcactgtgttacccaggatggtcttgatcccctgaccttgtgatctgcccacctcggcctcccaaagtgctgggattacaggcatgagccaccacgcccagccatagtcatcatttttaatagctttgtataatttgcttttctaatccctttattggtaggaaattagagttgtttccgactttggcccttaaattgggttatgtgtaggactgctttggaaactaatgttactagggaaatggtgttgtaaagttctagcttctgcgggttgtaagttacctttcaatggagggatgggtgggcagagggagctttgaccttctctggacatacattagaggaaaaatggaagggaggcctgtttccagggggataattgtgccaaagtggaatgtccaggtcaggacatgagccgtgtggaagctggaaccacgtgaggtctgcctagttcatgtgctggccaccacctggaggcccccttctcatccctgctggcgctgggggtgagccatcatttggcaacaggagggggcctcctattctcagccagatgtgacccttccgttccttggccctgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttct

SEQ ID NO: 8042 - DNA, 1050 bp, Homo sapiens
gaagatgatttagaggcagaaagagccagaggctgaaaccctcccaacttcccaatcccaatgtctcacattgcccgggagtccctccggtgtggcatctcggagctctctttagtctttcctggcccctctccacatatccagccattagctaagaaacacttaggtcttcgccaggcgtggtggctcacgcctgtaatcctagcactttgggaggccaaggcgcgcagatcaggaggtcaggagatcaagaccattctggctaacacggttaaaacccatctctactgaaaacacaaaaaattagctgggcgtggtcgcgggcgcctgtagtcccagctactcgggaggctgaggcaggagaatggcgtggacccaggaggcagagcttgcagtgagccaagattgtgccactgctctccagcctgggtgacagagcgaaactctgtctcaaaaaaaaaaaaaaaaaaacacctaggtcttcaagaacacacctgtcatccctttgtttggttcccagtgctgcgagctctgggcccttgtctcactgcacctcctaactggagcctcactgctccacatgcacccaactcaccagccacacgactgcagccgctcggtcagcctctccttagctccgtttccttgcttcagagtggatatcatacaatcctaatacccacttttccgggttggaatgaagatgaatcggtgtaatggggacagcgtatgtacttggtgtacatgtgcctgttatatttccgtgtctagtgtcttctctgctcctctctcgcccctgtatactttcccatctcctgtcccccttggtgcccaggcattcctgaggctgtcaggacccctcccctctctctctgcctttccaaacccccctgctcttcaggattcagctcaaagctccttttgtagcccttcctgggcacctcagcctttaggcctgattcccccagaactcctgccaagcccagaggaaacccagtcttcagcccttggtcatgtgctttctttggagatagagtctcgctctgtcac

SEQ ID NO: 8043 - DNA, 1031 bp, Homo sapiens
agggagcctgggcaacaccaggaaaggagccactgttgaggcttgttgggtggaggtagcattgaggggtcctgactggtagccctttgcccacagccccgtttgaagtgcctcctacacatcgtgaggaagctctcagctgaacacaaggagttcatcactgccctcatcccagaggtgagtgtgcgggtgtgttttagaggggggtccctggaatgtggctcttaagggcctcaggatccagggagggcagtgatgggagtgggaggactcgattcgcttcccgggcagatggctcagggagcagatgctgatggagttgtcttggccaggtgatcctgtgcaccaaggaggtgtcggtgggcgcacggaagaacgcttttgcactgctcgtggagatgggccatgctttcctaaggtttggctcgaaccaggaaggtgaggcccagggggctgggggtggacactctgctcatagactgggtggggggaagcacccctcaaaaaaggtggggagagctctgtgccctggccctgggcaggctgctcctctctggccctcagcccccctacctggtgggtccttcctgcttgacccacgttggtctctgtccccagaggccctgcagtgctacctcgtcctgatctaccctggcctggtgggcgcggtgaccatggtcagctgcagcatcctggccctgacccacctccttttcgagtttaaaggtaaatgcttatttcctagaaggcctgagaagccctcagattaggaagatgcccaaaaggtcaggataaagtggctcctggaactgggaaaaggtgcctggaggaagtaagaaaagccacacccagcccagtttgcctccctgtctcccttcctgcgggtcgctgcctcccgcccttgcggctatgccaaggcaccttcctcaggtctgtccccacgtgtgactgtgcagtccagtggccctgcatcccattgtcagagtggttaggaggtggttagggctgatgcctggattttagtcctagtc

SEQ ID NO: 8044 - DNA, 1095 bp, Homo sapiens
aattcgatggtcccatctgggggtgatgggagacagtgacagatcatcaggcattagattctcataaggagtgggcagcctagctccctcatatgtgcagttcacaatagggttcatacttctatgagaatctaatgcccacttcgatctgacaggaggcggagctcaggcagtaatgtatgcgattgggaagcagctgtaaatacagatgaagcttgcctgccactcacttccttctatgcagcccggttcctcacaggccaccagaagttgggggcccttgctatagtgcttctgttcaagccctgaggcaacgaaattccttatcctttcttgccaaatccgatctgcctttatctaatcagaggtattgatactgcctctccatgtggtctgaggatgcttctccaccctgctcctctgggtagcagctgtgtcccatttacaacttgttctgtctgttcttgtagctctttatttactaggaatctacagaataattctttctcacaggctgggcaaggtgactcatgcctgtaatcccagcactttgggaagctgaggcgggtggatcacctgaggtcaggagttcaagaccagcctggccaacatggtgaaaccccatctctactaaaaatacaaaaaactagctgggcatggcggacgtgcctgtaattccagctgcttgagaggctgaggcacgagaattgcttgaacccaggaggcggaggttgcagtgagcaaaattgcgccactgtactccagcctgggtgacagagggagactctgtctcaaaaaaaaaaaaaaaaaaaattctttctcacaggtaattaatctttctgttaattctttttttatagcaaggaagatgtccgagcaactgaaaaagacaaggttgttggttggttctttttttttaatggctttacgtatctcaatcccttaaaagtattatctcaggccaggcatggtcacacacacccgtaatcccagtactttgggaggctgaggcgggaggatcacttgagtccaggacttcaagaccagccctggcaacatagcgagaccctgtctctacaaaaattttaaaaattc

SEQ ID NO: 8045 - DNA, 1044 bp, Homo sapiens
actttggaggaaagagtaaattgtcggcagggcgcagtggctcacacctgtaatcccagcactttgggaagccaaggcaggtggatcacctgaggtcaggagttcgagaccagcctggccaacatggtgaaaccccatctctactaaaaatacaaaaaattacccgagcatggtgacaggcttctgtaatcccagctactcgggaggctgaggcaggagaatcacttgaacccaggaggtggaggttgcagtgaaccaagatggcacccttgcactccatcctaggcaacaagagtgaaactccatttcaaaaaaaaacaaaaaaagtaaaattgtcaatgattataggcaatatagttgtataccaagaaattctgagagaatcaccaaaaaacttattagaagtttagagatttactacaaaaaaaagtagctgggcatggtggcgggtgcctgtagtcccagctactcgggaggctgaggcaggagaatggcgtgaacccgggaagtggaccttgcagtgagccgagatcgtgccactgcactccagtctaggcgacagagcaagactccgtctccaacaacaaaaaaagaagtttagagatgtatgtcttctagcagcattctgtagcctcctggtcctcctatttcctaaaatttctaaggccttctgctctgggctataaatgaatccatactccaactctcacctttataccaagacattcctatattactctcaagccacaaatgccttgacccaagggttagtcaggacatttcagttttttgttgttccctctgtagcttccagtggtgtctgtagtgagagaaacagagtcccagttactgccagatgtgggagctattgtaacctgtaaggtaagttggtcctgacctccatgcttagaatgcccattcaatactgaaatcatgaccataccagaactgcagtgtccagtatgatagccacaagctacataaatttatttctggcagggcacagtggctcacactggtaattctagcactttaagaggccga

SEQ ID NO: 8046 - DNA, 1577 bp, Homo sapiens
agatgaccctctcttttcaaatggcagcacctctgtattatgagaataccaggctcttatgcaggtgtccaatcattttgtccacaggcaaaaatgatattttccctttctaacagcttctcagggagctctgcacttaaagtgatttgcatttcattgctaaagggaaaatgtgtagcctttatgtcagcatttcctctctcctttttagggcagcagctggatgaattcctacagctagctgtggacaaagtggaggctggcctgggctctgggccctgtcgtagtcaggccttcactcttcttctctgggtaaggagttggagtggagtctggttagccagagaggcaattatgtctggttaaataaaatgtccctgtttgaccctaaaccataaacatctatgtctcagggttctcgggtttgagtgtcattccccaattgctctctctgtctccaattacaggtaacaaaggccctagtgctcagataccatcctctcagctcctgccttacagcccgggtacgtcctttctggagacagaagaacccaggacctaaacaaactttctggttgctcctattcctcccaaggacttccatcctcccctgtgtgttttttgttttcttttcttttttctttttggagacagggtcttactctgtcacccaggctggagtacagtagtgcaatcacagctcactccagcctcaacctccgtaggctcaagtgatcctcccacttcagcctcgcaagtagctgggactacaggggcaccccaccacacccaactaatgtttgtattttttgtaagaactgggtttggccatgttgcccagactcctagactcaagcagtccacctgccttggcctcccaaagtgctaggattacaggcatgagccaccacacccggccccatccttatctttggcacttaagattcttcttccctgatgtacctcaaaggctcttttttctccagctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaaggtgaggagtctgaaagaaggtccccacatatacacatctctcctttgcttggccacattccctaagataatttagggcccgcttgcttctttagagctatattgtggtctgtgcctagaagactaaacttctagattcttgtcccacttcttcctttcatgggcgtatcttgcttattctgagcgtgaagggctctttcacccgtttgtaggctgatgtctcagcctcaccacagattggaattgatttctcaagctatatatctaagtccaatttctcccctaagcctttccattttttacagatgtgaagccaaactacttgaagggtctttctcatgtacttaacaggctgcccaagcctgtactcttgccagagctgcccacggtaagtcccacaggcag

SEQ ID NO: 8047 - DNA, 1031 bp, Homo sapiens
aatagatacacagaaaaaataatttatgtcacacattaaaaaaaacacatcatacacctgtttttataaacttttattggaacatagctacactcatttatttccctgttgtctatgctacttttttgttaaaacagcagagttgagtagttgggatagagaccataccctgtaagcctatatttactgtctgaccctttaggaaaaaatttgtgaactctagttctgtagaaaggcagttttgggctgagaatgggttttactgtggacctgtatgagaatggatattaagaaatgttcccctattttcccgactgatcaggtgtctaccttcaaatgggaaggcacaggacatgtctcttggtgaaagagaaaatttgtagtggaacccaaacagaaacaactgttatagacttagggaaggaacaaagctcttgggcccttctcgtgcctatgtcaactaatggctgaatctggtttgtgcagtggtacacctgatactgttctatgagaaccggctgaaggaccatcatcttgtgatcccatctgtcctgcagggtttgaaggcacttgtgagttttccttcatttcattacataactttgttcaagggagcccttgtctagttctctccttgcgctttgggtgtgatggttcacatgctgaggagcaggtgcccaagtgtgggactaaattagtgttaccagctctacttccgttttccctctagagagtaaaagtgtactttgggggactggaaaccagagccatctggaaagagctgcagagaactcatcagcttgagaaagagtctcactattagtgcttcttcctcaaccaggatgctgtgattcttacagtagctaattaggcctgtcgtagggttgtgtcttggaggccatgctgcaattccttcggtattcacgtaccttctcctctcccccagagcctgtgtgtggccctgcccccagggctggctgtttctgtgcttaaagccatcttccaggaagtgcatgtacaggtgagggata

SEQ ID NO: 8048 - DNA, 1032 bp, Homo sapiens
gtgacagagcaagactctgtctcaaaaatgaataaatgaatgaatgtttgtctttctgctccaacagactatggacttccccaaaactccctgcccatatttctatcttaagccctaacatggtaccctatttataatattcagtaaatgttgaatgaaaacgaacatatggcttttttttttttttttttgggagatgaagtcttgctctgttgcccaggctggtgtgcagtggcgcgatcttggctcactgcaactttagcctcctgggttcaaatgactcttctgcctcagcctccgaaacagctaggattacaggcccatgccatcatggacagctaatttttctatttttttttttttttagtagaaacagggtttcatcatgttggccaggctggtctcaaactcctaacctcaagtaatccacctgcctcggcctcccaaagtgcaaggattacaggtgtgagccaccatgcctggccaccatcttccttacttttttttacggtcttgtaatagctttattatctcatttttctctaattttttctttcttttcttttcttttttttttgagacagagtctcactcagtcgcccaggtgggagtgcagtggctccgtctccactcactgcaagctctgcctcctgggatcacaccattctcctacctcagcctcccaagtagctgggactacaggcgcccgccaccacgcccagctaatatttttgtatttttttttagtagagacagggtttcactgtgttaaccaggatggtctcaatctcctgacctcgtgatccgcccgcctcggcctcccaaagtgctgggattacaggcgtgaaccaccgcgcccggcctcatttttctctaattttttctacttttatacttttttttttttttttttttagattgagtttcactctgtagcccaggctggagtgcaatggcatgatctcagctcattgcaaactctgcctcccaggttcaggtgattctcctgcctcagccttcggagtagctagg

SEQ ID NO: 8049 - DNA, 1034 bp, Homo sapiens
cattgttcccaaggccagtgtccgagtcagctgcatgtgattgtcggggctgggattggggcaggcaggcgagctgtaccttcgtccacagggcatgcacatccagctctcagaaattcttcctgtcagccaggtggaagcccgggacaagtggactcttggtggctggactggaaggggaccggcggggaccagcctggaccagctgaccagagggctgcacatctctgctctgcagccgggcaagcagaggacatgcagccatagtcctcactccctttctttggttgtttttcaaaccttcaagatagttactttctgaggttgactgaccaatcgcaaggtgccagaattgtgaaatgtccagtagcacagggcatgaacacagctgcccctccagacacagatggcaccctttttactccctcctgaggccgtactttgctttggtgtagaaatggctcaaacacctggcaagtgggggtggggagtgaggcagcaggggaaaagacacatggaagcaagaagatacgcactgagctgcgcaggacctgggacagtttgaaggcctctctcctttgggcctcacctttctcagggaagccatagagaaatcggcctaggacaagtcagagagaaaagggaaactgccacttatgaggcagaatccacgtcctgttacttccaccaagcagcagcggtagcacagaaaaaagtccaagaacctaatagcctgtcctcttggaagccaagactcatcccagagcccttgcagagacccactcccgaagacaaactgaactcttacatcaaaagagttggggggaaaaaatttaaaacgagaggaacaaatgagaagattgggaccaaggactcaggaagcaaggtgggatatgttcacccatagaccacttagctcccggcatacactccggctgcgtggatcacttttacatgctgggagtcaacttcctattaaaatataaatgctaagactagctcttcctgcctctgcttgagaaacagacaagctg

SEQ ID NO: 8050 - DNA, 1050 bp, Homo sapiens
ctatctttgcaatttcctgtgaatctataattattttaaaatacaacattttaaaataaatgtatggggggaattggggaaaaagtctaaagaggcttctggcagggtaaggggattacagtgatggaaaaaacattgagaaacaccagcaggagtagaggagcccagagtgtcttcactgaaatgcaatggttcagaaagcactggagtcaaacattcctaggttcaaaatcagacaccttccccaggtgttcacacctcatgagatgataccattttaatataaaaggaataggcactatggtctcaaattagtaaatacaaatgttaatattatacacacatatgtgcagaaaaaaaactgaaaggcaatgcaaaaagtgagaacagtgattctgtcagagtggctggattaatatagtaactctcacttattctagacacagtgccaagcacttcactcttattacttcatttaatcctcatgactaccttgtgagatgagcaatattatccccatgttacacatgggaaaactgaagatcagaacaattaagaaacctgccaaggtcacatgatacttaaatggcagcactgggattcaaacccaggcttccttgagcgtgtggtttttattttcttccatatgttttgtcgtgtgtgtgtgctccaatttttatagggaacacataatatttatgtgtagtctgaaaaagaagcaataaatatttaggggacccagagcctggttatatgatcattttcttgggctatttcaccctggataagtcagcctgaggttggagtgtttatcactcctaaggcagctatgtgctaagctggccctaaaggcacaagataccttttaaatacatagtcctgtcttgcaaagtagcagtagccgacacttatcaagcaattagtatgtgccaggcactgggctgagtggtttgcctaagtcacttcatttgattttcacaacttgaagaatcaggtaacataacccacattttacaggtcagaaaactgaggctgaggtcaagtaacttg

SEQ ID NO: 8051 - DNA, 1050 bp, Homo sapiens
agggacattaggggaaaactaaagaaatctgaatgaagtgtggatattagtaaataatcatatattgatactggttcagtaattgtgacccatgtaacatactaatgtaggatgttaatgataggggaaactgggcagggcatgtgtgggaactcactatactacccttgcaatttttctgtaaacttaagactatcctaaactaaaatgtgcacttaaaaaagaaaatcagactggacacagtggctcatgcctctaatcccagcactgtgggaggctgaggggggcagaccacttgaggccaggtgttcaagaccagcctggccaacatggcaaaacccggtctgtactaaaaatacaaaaattagctggtgtagtggagtggcgcatgcccgtaattagccacgtatagtggcacatgcctgtagtggctactcaggaggctgaggcatgagaattgcttgaacccaggaggtggaggttgcagtgagctgagatcatgccactgcactcaagcctgggtgatggagtgagactgtctcaaaaaagaaagaaaatcagctttccctacctatgtagtggccttggctctatccttggcctgagtcaactcagaaatgacctagaacaggccagccttatgtccctccaggctgctcccaagtggcagccatcacaatcacctctcccctgccccatctgtcatctcctttccaagtcaggtatctccacctccatcagaacctctgaatcctgctttcagcttctctcactgactagaccacccttcttcagtcacagctcagttcgacaactgcctgccccagttcactgaggagcccagaattgaacatgacactctgagcatggctgcacagcccagggaaaagcaggcctgtcacttccttcagttcattacacatgtctctattaatatagcccatagaggctaaaatgactttactttagggagcagccacctcacatgagtatctccaactcaactatccagtttaaaaaaaaaaacaacaactccattacaatcagtat

SEQ ID NO: 8052 - DNA, 1050 bp, Homo sapiens
cgagcaccctcgctgggccaggcagcgtgtgcccagcccctgtgaagctgccatttttcacatactgcccccagctgggtccctaggtcagagaaacagctcaagtgaaccttggagaccatctggtctgaccctctgactttatatctggtgaaacagagcagagaatggaactcacttgcctggggtcatctagctggttggtggccacatccaaactggatatttgagctcaggactctcagtccagtgctctttccatcctcccaacatcatcacccgtcattacaaatctggtctgagctagtcctctctggcttctcaagcttcagactctctctccagaaaaacacaaacccatgcacattcatacagtctcgtgaaggttttctcaggagacagaccttaaaacctgtctctgggcccacagtaaagaacttggggaaagagaatcatggttcagagtatacactgaggtgggagggaccccagaaaaggcttgtagttgaaatgtagacctagaaaagagaagttcgtagtatcaccaccccctgattctctaagatggattgggaagctgcggagtgtgaagctctgggactttagttttgtggcgatatgagcaactacccatattgaggcatttctcaaatgcacaaacattgtttcatgagtcattttagcccagataggtcatggtgtcagtggcaaatgctgcaggtggcagatgcctgttacatgaatcacagtggccagtgcagacgttgccagcatccgagatggctgcgaccctgagtagggccctgatgatggaccagatctttctgtgttcagtggcctctgtgtgagaagcttaagcatcaccctggctctctctagctggctttgtatgacatgtgtttgtgtgacagaggctgaggagtgaggtgatttgctcagctgcctgccttccggctccgtgcctatcccaccccactccacagttagagctcggccggaaacctggccccctttcccagctgtgtgggcaggtcatatgggctcaccaag

SEQ ID NO: 8053 - DNA, 1035 bp, Homo sapiens
tagatcttcctccatccctttattttgagcccatgtatgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgttattatgatgttagctgcttattttgcttgttagttgatgcagtttcttcctagcctcgatggtctttacaatttggcatgtttttgcagtggctggtaccggttgttcctttccatatttagtgcttccttcaggagctcttgtagggcaggcctcgtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatcagctgttagtgtgacgggcttccctttgtgggtaacccgacctttctttctggctgcctttaacattttttccttcatttcaactttggtgaatctgacaattatgtgtcttggagttgctgtttttgaggagtatcttcatggcattctctgtatttcctgaatttgaatgttggcctgccttgctaggttggggaacttctcctggataatatcctgcagagtgttttccaacttggttccattctccccgtcactttcaggtacaccaatcagatgtagatttggtcttttcacatagtcgcatatttcttggaggctttgttcgtttctttttattcttttttctctaaacttctcttctcacttcatttcattcatttgatcttccatcactgataccctttcttccagttgatcgaatcggctactgaagcttgtgcattcgtcatgtagttctcgtgccatggttttcagctccatcaggtcctttaagtacttctctgcattggttattcta

SEQ ID NO: 8054 - DNA, 1120 bp, Homo sapiens
gttcctctgggacaagaggagtggtgggccttcttccactccttctccatgtttgtgttaaaggtgccaggttcatgtggaagtagcacctaggctttttctggaagtctcttggggagatgcagaaggaagaagactgctgggccaatggcctagagacctcagtgcactagtgatattgacatgacatttgcaagatgctttttactttgcagagtgcttttctatgtactttctcatgtgaccaggctctgtgatgtcccagttttatttcagcattctactttttggaggtcacatagttaagagctgtaagttccacaaggatggggaccacatctgcccttatgtttgcccagcacctagcccaatgcttggctcaaattaggtactcagtaagtgaacaaacttttctccaatttccttcactgttctgttttgaccggaaggtggtgggattctcctggttcacagttacaaactcttaacttggacacagcatgagcctccactatgtataactcttttccattctccagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaagttttgggtaaggatgtattttctctttagaaactgaaagtaaaaagatgttgagaatacagtttgtttaaaatattaggcgttatgtctattgaactgccaatgaataagtgtttctgtagcgcgagttcaggaacctgatagcgcaaataatgtggccatgtacaaagcacggctttttcacttgttcagttttgcccagtagatcatcagattttagctactgcatttgaagcagtcagtggagatgccaagtagaaagaatttaatggagtgataaagacaccagggttctagatccaactctgccactacttttgatcataggcaagtcatttagccctctgggctcacatacacatgttagaaaaagaccacatagtgcgagtctgtga

SEQ ID NO: 8055 - DNA, 1022 bp, Homo sapiens
cctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaaggtaatgattc

SEQ ID NO: 8056 - DNA, 1057 bp, Homo sapiens
ctctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaattgtcagtatttccttatagcaatgcaagccgactaacacaggtgattcttagcaaaacagtttgtcaatttttcataaatgctggaccctggctgggcttatgctattgcctagaagagattcccaacttctctcttatttgaatcttagaaaaatcccaaagcccaagcctcatctaagaccaattaagtcacaatccctggaggaagtaaaaggca

SEQ ID NO: 8057 - DNA, 1049 bp, Homo sapiens
tggctgggcgtggtggctcatgcctataatcccagcactctgggaggccaaggcggggtggatcacctgagatcaggagttcgagactagtctggccaacatggtgaaaccccatctctactagtaatacaaaaatgagctgggcgtggtgatgcaagcctgtaatctcagctatgcgagaggctgacgcaggagaattgcttgaatccaggaggcggaggttgcagtgagccaagatcatgccattgcactccaacctggacgacaagagcaaaactccgtctccacaaaaaaaaaaaaaaaaaagcaagctacttttgccagtaagattaaaggagtgtccagatttgctaacagcacttgtttatttttgaacagataaaagatgaagtatttgaagaaacagaaaaaaacttccgaatgcaagaaagattgattaagtcttttatccgagacctgtctctctacctccagcacatccgggtgagcatcaacatcactgtagttagattaacatacgatgtaattctgtcccctttcctgttcatcagtcatattgtttaatgaatgctgagtaatctggactcaaattactattatgccccatcatactttttgttgagatgccagtaggttatttaacagtaatagcatttagatcaatgttgtcacattcatttcaaagcagcccaactttttccaccctctttttggtcttcatcacccttcatcccacacacaccttatttttcttttacttattacagttcattttatcaaaaccagtttgaaaatcaaatattgaatgcaaaagctaggaagctgtaaacaggaaacgtaaacgagaaagaacaagcagtgaatacgagtaagagaatgttcctatgtggtatgctttctgatcacttcagctcccaatttattaatattcagttgctataataaggcctctaaaggtattagagccataaacagctttgagatctagagaagccaaggagatcaggtgagcctaggtctttccttgcctcaagcaatgcttcctccct

SEQ ID NO: 8058 - DNA, 1064 bp, Homo sapiens
aactgggtcaaggattagggcaggaatagaatctggctctcttgacacctagaatgcttttccagcattaccacatttgaaggcagaagcacagccgtagattgagtctgcaaagatgaatttagaatatcagaaaagtgttaggtatttctctgcagagtgcacagaaaaaaaaagtgttaggaaagtcagagggaggctgccaacagaggttgcaactatattatagacagcagaggtgcaaaggtgcaagagaggatatggactcgggaaagacctttgcatttggtaggttggtggagggtaggagcaggggcacagagcatatgacagggagtttaggagggcagtggtgataaggatatgaaagcagtcccttaaaagttgggacagtaattgctgtggagcaggaaaatcttctgttttgtctttctcccaagataagaaaaacctgcattgatttgaaggcacttttgcgaagtagtacacagacagctcaaagtttttaggactctggtattcaagatttcttttcattgcaaacatgtgaacatgatatctgttccaacagtctgtattcaagcttattattaatataccagcacatagatcccatatctcctttaattgcagtccaccaggtgtttattaactaatgtctgtacttggcattgtaccaagcattgaaggtatccagagaaggcaactatactcttaaacacctgccatgcaggagcttgcagatcagttgaagagacaaaatacaaaagaagtatgtatagcatagacagtaaatgctatggacagttggaaggtagaccaggttttttgttttcttttttgttttttgtttttgttatttttgagacggagtctcgctctgtcgcccgggctggagtgcagtggtgcgatctcagttcactgcaagctctgcttcctgggtccatgccattctcctgcctcagcctcccgagtagctgggactacaggtgcccgccaccacgcctggctaattttttttttttgtatttttagtagagacggggtttcaccgtgttagccag

SEQ ID NO: 8059 - DNA, 1059 bp, Homo sapiens
gcaaaatcctatgggtcattttatagtcaagcacattggaaaaccgggttatcttttatgctcttgatttttatatgctcttgatttaaaaaaaaattaggccaggtgcggtggctcacgcctgcaatcccagcacttcgggaggccgaggtgcgcaggatcacctcaggtcaggagttcaagactagcctggccaacatggtgaaaccctgtgtctactaagaatacaaaattagccgggcggcagggtgtatgcctataaccccagctactcgagaggctgaggcagaaaaatggcttgaacctgggaggcagaggttgcagtgagctgaggttgcaccattgcactccagcctgtgtgacgagagcaaaactccatctcaacaacaacaacaacaaaaaatttaagtctactcaggcaaggtggctattgcctgtagtctcagctactcgtgaggctgaggtgggaagactgcttgagcccaacagttcaaggctacagtgaactatgatcggaccactgcactccaacctgggtgacaaagagaggccctgtctctaaaaagtaaaataaagtaaataagaaaaaaaaaactaagtctgtcttatattcccaagtaggttacagttccttaatggtaggtaccaccttctctttggtatctcaagagtctggtatgatgccttttgcatggcaagcacttgatgttcatttgctaatgatgatgattcttcaactccaactcccaaataaattcattacattctgctttccaaactgacttctgctgctcatttccttttttcttctaattccttctttcaaaatatttcttccctttttcttttcttttttttttttttttttttttttttgtggagacagggtctcaccctatcaccaaggctgagtgcagtggtgcaatcatggcttactgcagccttgaccacccgggctcaactgattgtcccacctcagcctcctaagtagctgagactacaggcatgcgccaccatacctaatttttattttgacagggtctcactatgttgcccagg

SEQ ID NO: 8060 - DNA, 1029 bp, Homo sapiens
aactcctggcctcaagcaaccctcccaccttggcctcccaaagaactggaattatagggacacaccactgcatctggctaagaactaacattttaaatcagaactttaataaattaatgtgggtcaagattttccatgaaatagcattaactttactcatgaacattcccctttgctttcttgaatggataagaaagatgtatatcctctgtgacttagagagggaaaaaaggcttgaacatctaggacattgagaggccaggcaccgtggctcacacctgtaattccagcacttcaagagggcgaggcaggcggattgcttgagctcaggagtttgagaccagcctggccaacatgatgaaacccgtctctacaaaaaatataaaaaattagccaggcatagtggtgcatgcctgtggtcccagctacatgggaggctgaggcaggaggatcacttgagtgcaggaggcagaggttgcagtgagctgagattgcgtcactgcactccagacttcactttctgacacctctcatcctttcatacaaagagaagaaattattcatttagccttcgtgttgtcttgtatgagctcttgtattgtcaaggacaagagaaatgtgcagttgcttttaaggttagatattccttctcattgctgggacttgagattttttaaatggattctcattcccaaaaggtaatgttaactggagagttcagttccaagacataaggatgctcgtggaagcatattcttttgaaggaacctccacctgacagcccctacaaaaagggaacccctttcccagctcttcccaggtaggtactctcccctgggtggctgagcgagaccctgactcaaaaaaagaaggacactgagttcttttgacaccatctaaagaatcagccattcattgggtttgccgtgttgtggcatattctctggttcatcttgaaattatatatacattttattttcaagtatagtggctgtagtttctataaaaggcaagcagtactgcagtttt

SEQ ID NO: 8061 - DNA, 1034 bp, Homo sapiens
acatgggtgcccacctgaggagggcaggggctgaaacccagcttcattctgcatgtcaaaccatgcacctgcaggactgtagaaacggctggtgccgttttctaattggcacagagctgctgtatggactagctggaggtctaacagcaaaggaagtattgatatattcccttccaaatcacaggctttacacaatacaactaggagaagaaagccaaactaaaattcaaatgtactaaatttttttcctatctctgggtgactttgggcaaatcattgaatctttcaacctcagatttattataagtaaaataaagtaacacctctcttaacctaccttaatgggtccaaaagctcatgttgacaaaacggttctctgactcactgtagggtcagaattactggctgtgactgcacataggagaatcatttctaatttttataacattttgcttcacagggaggctgagaagacaaaactccttatagctgcacagaaacaaaaggttgtggaaaaagaagctgagacagagaggaaaaaggcagttataggtacttggatttctctgaaatgattgtctctaagtacatttgtttgtcctgttctttgtcagtctcattttgggtatcatgggactcagtaagattgcatcataggtagtggggaattctggaatctccactgtacattcagatgttctaaagcctttaaaagtaggtgagaccagtacttaatgatgtgctgtggctgtccatcatgttgttagatgctactgttgtctctttcaagaacagggagaatggatagggtttataggcagcttgagtctgtggatagcattttcatttgtacagattaagaatagggaagttttttgaccaaagtttcagattgtagtatgcatccttgttgttgacatgcacttagttttacctggataggtagtgccgtttatgaaagcatggcaggattgtttacagttcatttcagattacagtggcttcccttatactccaggtcactgtgtattaga

SEQ ID NO: 8062 - DNA, 1111 bp, Homo sapiens
caaggtagcaggtgaatttagtggtagtggtgatggtgacgttgggaaatagaatggtgagaggttttacccctgcttttttttgggtcactgtgttttccagattgtgggttgtaaaatcaactttagtgagtcatgaacagcattttaaataaaatggaatagaataggaaaagaaatggtatgtaataagtttaaatattctgtgacacttgtgtttcacagtgtggcggggtaggtgtttatattggacgtcagtgcaaaatgtgtttcttactgtgtccactgtcagtaacattcgaaagccactgctctggatccagatgacctaagaagttatattgaggcttctctagtgtcctttctcaggagctctaggagaccagttgattgttgattgttgtgatgaacattactgcaactaaagcttatcacatgtctctcaattctttacactcagcaccactgctactgagagtgtgcgctcactgtgattgtatgtgttcgtgcttctcaaaaacaagactgaaagataggtggggttttcctcatggcctcattcatgcaatgtcattatctcaggcgcttgagggtgagccaccagagttaaggggtcgtttgaaatgtccagaggtaactttgtaaaatcctctgagttgttcaagtcagttgtagctggagtagctttttagttttaaagatagtgaatgtgaaggtcagctcttagattctgcccagggtgttactcagagatctagctcattcaactgttgtttagaattccttgccttatattacttagccatttttctgttcccagttttttgctattaaacaatagtgtaatgaacattcatgacacatgttcttgtatgtacaaattatctttcaaactgactgtacaaatgtacattcttaacagcaatatgtgcaaataattgtgacccatgaactcaccaacattggaagcaatcagacatactgattgttaccatatggatgggtgggcaattatatctccctttgatttgcattcctttggttgttaatgaggttgaacatcttttgatacatttattggtcatttatactgtcttctgctgattgccta

SEQ ID NO: 8063 - DNA, 1032 bp, Homo sapiens
gaaatgctatgaaaaaggaagcgaactctttctgtgttttaagtgaatattagtatgtttcattatcagcttctccccaggtctatctataactgtgttttatggattgcctttagtagttcacactttttttctttgtttttagtggtggggtcatgatctatattgaccgaatagaagtggttaatatgttggctccttatgcaggtatgttacccatctacctgtggtttttatagttatagccagaggatttatagctgagagattctttgaggaatagaagggtactttgaaagttttatgacttcattgatcactgattaataaatttctggggaatagaggcaaaaataggtcagaagttctggacagagttgactttctgcaactgtatgagttactcttctctgagcttagtgtttctaagagcaaaatggtcattggttatttctagaataggaaagtagtattttatccagtcaggatgagagataatttccttgggtgttagaaatctgtaactgatcaattccttggcccacactgatttgccatcaaagagaagtattttctagttgagatttgctataatttgcaaagcagtctgaaagccttcaacgtggggaaagcattttcttgataaaagatgaaaacctacaggtatggggtgggtaggtactgttgtaatcaaaaacttaattagaagccctgaagaaagatataccgtcttatatgcatgcttgttaataaaactggcatgtctagtatgtacagaatattgtgtttggcaagaataatttgaaaagatgaaattacagcctttgccttcaggggttttaattttacttgagaagacataatacagagctaaaaaaggatatattgggatgtaaggtcataataaatttcacataaccggtacaggcacaaatagtgaaaagatttcagagtagagagcaggcgtattactgtcaagggcatttggattatatttttcagagagtaagcattttccttgtctttttttcc

SEQ ID NO: 8064 - DNA, 1093 bp, Homo sapiens
aactgaataggacatgtgagagatcactaggtattaaactaaaatgttgaccacagctttagagaagaaaggttgctgttggattcaagggcagctttgagtcttagagtacttgtatgcataaaatctcttttatcttcaacataaatagtaatattagcagtggaatcaaagttcagagtgcaagttgtagccagagtatctatgtgagcaagctgtgttgtttacaacccctggccagctccaggcaggtaagggactctggaagagttttctacttattagcagactgaacattgaacctttcccagtgaatcttaattcaaacattcgctgtaggccaggcacagtggctcacgcctgtaatcccagcactttgggaggccaaggtgggtggatcacttgaggccaggagttcaagaccagcctggccaacatggtgaaacctcatctttactaaaaatacaaaaattagctgagcgtagtggtgcatacctgtaatcccagctacttgggaggctggggcacaagaaccgcctgaacccaggaggcagaggttgcagtgagccaagattgcaccactgcattccagcctgggtgacaaagcaagactctgtctccaaaaaaaaaaaaaaattgctgtaaaatattttctgtctcaagtctttcatttctactagaatacaaaaagaaatgactgttctgagagctaatctttgggaactgaaattgtgatggatctctgctgtacttactgtcagcagctttccagagatttgcctctggtaccagtagttttttgacaatgtgtgtcttgagtgttgatgagatatcttttcctccctagacaacactacaaactgatgaagttaaaaatgtgccttgtggaacaaggtaagctttctctttgcctacgagcctccctttagctcagacagagtttctgttcctacagctatgatcacttagacatatctcaaataggcatgatagttaacccaaggggacttctgatctgagcattgtttgagcaaaggcctatctccaaataggagcttttccatcttaagaaccattattgttcttatggtat

SEQ ID NO: 8065 - DNA, 1404 bp, Homo sapiens
ctcctgaccgacctcaggcgatctgcctacctcggcctcctgaagtgttgggattacaggcgtgagccactgcacccggccactctttcagcttttaatatttaacttcaccactcagtcgtgctgaaacagttgttatttaggcctgcattagtgagacctggcctgccacactcccagttaatattccttcttggcttggtgcagtggcccatgcctgtaatcccgggactttgggaacccaaggtgggtggattgctgagttcaagagttcgagacctgcctgagcaacatgttgaagccctgtctctacaaaaactacaaaaattagcggggtttggtggtgcacccctgtagtcctagctacttgggagattgaggtgggagaatcacttgagcccagggaggttgaggctgcaatgagccatgatcacgccgctgcactccagcatgggtgacagagcaagaccctgtctcaaaaaaaaaaatttctttttgtatttgaagcccagtactctgaaactactgtgagaacagcagtctcataggtcctgccaaaggataaatgggtggtaaaatatgactgtggtcatgactttttcccccatttttctttttatgactttattgaggcatattatcatgttagttcccatttaaggtgtacaatatagtgattttttatttcttttttattaacttgtcactgacttgatgctcaattacagtgatttttttttaaagtaaatttaccaaattttgcagctgtcaccataaatcagcttaaaaacatttccattaacagtccattaactgttaatctccattctgtccaccccaggaaaccaggaatctattttttatctccacaagtttgccttttctgaacattccatataaatggaattatgtaatatatagtcttgtgtctgactttttttacttgccttgtatttttgaagcccgtgcatgttgtagcatgtatcagtacttcattcgttttgattaccgattagttttttcactgtatatatctttttgcatttgttctttgggttttggtgattgttcactttagcccatacaaaagtttgggtcttttttcctcaacaaaagtttggactctgttatctgtaagagatatggtaatacacattgattttgttcatttgcatttcaaagtaggaaatctggtgcataagtatttagaaaacctaggattttcaaagatccttgaacaggattttaactgtttgtttctttttcagagaggctgtgatagctatatggtttatttgtttgataaaagtaaaactgtatatgaagggccatttgcttccagaagtttatctgattgtgtaaattatattggtaagtccagtccatttagtggctgagctttaa

SEQ ID NO: 8066 - DNA, 1060 bp, Homo sapiens
ttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacattatatatgagagagagttctgaaaagacctgttataaaatcagtttcaggcacttttcccttgtatgctgttgtgtgtttgaaggtcagttttaaagcattggtgtaatagtctcatggtttatctttttaaaaagcattgcctcaagagagctgtggataaatatatttaattagtaaagctaaaaagttttgttgtcttaagttatttctttggtagcaaataaatcttcacaagaacctaattttttttttctgttgattttctattttggcaggaacttgatctcaaaatagcaattaagtcttgtcgcctagagctaagtaccaaaaacagagaacgatggtgccatgaaatccagattatgaagaagtaagtgtattccttgacttacatttccctggttctacagcccaaccagatgtcatcatggggaaagaggccaggaatccactcttctcaggatctttttgggaacatatatttttttctctcattaaatatattctatttcaaataataatatcacattaagattaagaaggtttagttaaaatcagctaggacacttacacactgttggtgggaatgtaaaattgtgcaactgttacggaaaacagtacggtgattcctaaaaaattaaaaatagaattaccatatgatccagcaattccatttctgggtatatacaaaaatgaattgaaagcagggacttaaagagtaatttgtacactcatattcataacattattattcacaatagctgaaaggtaaaagcaacccagtatctaccagcagagacatgtataaacaaaatgtggtatattcatgaaacggaatatcat

SEQ ID NO: 8067 - DNA, 1026 bp, Homo sapiens
aattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggc

SEQ ID NO: 8068 - DNA, 1050 bp, Homo sapiens
gaggcagaggttgcagtgagccgagattgtgccactgcactccagcctgggcaacagagcgagactccatctttaaaaaaaaaattatataaagtttagctttaatatgtaaaatatttaatatttttatattaatatttaaataacattcatttaaaaagtttttaaagagtatctggtggtaaccccagagacttcacagggaagtgtgtggtcagtacatgtaaacagcatagatagtaagttccttgtttagaaaaggaatgggtagttgaggaagttccaaggaagatgtggggcttgctggataagaatttggaagaaagtgagtattttgtgtggaggcccagcatgagggaaagcttagtggtaggaaatagtctcaaagcctgcatggggctagcagctcagaaaatcagattgtaaatcatttgtagttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactgtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcaggtgaaacaggggatggtgatattcagggaagagtaaatatctgttttttttgttgttgtttgttgtttgtttgtttgtttgagacagagtcttgctctgttgcctaggttggagtgcagtggcatgatcttggctcactgcaacctccgccttccgggttca

SEQ ID NO: 8069 - DNA, 1052 bp, Homo sapiens
agtctcgctctgtcacccaggctggagtgtagtggcgcgatctcggctcactgcaacctctgcctcccgggttcaagcaattctcctgtctcagcctcccgagtagctgggactacaggcacatgccatcacaggcctggctaatttttgtatttttagtagaaatgaggtttcaccatattggtcagcctagtctggaacttctgacctcaggcggtccacctgcctcggcctctcaaagttttgggattacaagcgtgagccactatcccagccgaaagtggtcattttgaaatcagaagttgtatctttttgtggttgagggtgataaaaactgaaaaactgttttcaagtttggagcatgggagggaaaacccagcgatttgttctggtctccctcagctcagtgtgtttgaagccaaaagcctgcttgtgtgcctctcccaattcatttgctcctagttcatttgctacttgcatagaaattttcatgccgaatctcactcttcagcggatacctgagaacattgttgctacaatctctaaaatcagattttttcaagaaagaatttttattaataacctcaagtacttttcgcctacaccctcaggctcactttttgtataggtttttctccctggagaatcctacatgctgtattgatgtctcaattctgtgtgctgcttcttcagtgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtaggtggtctgttcatagaaacttggaagggcgctatggggactttgatattggtaaataagtatttaaataggctgggcgaggtggctcacgcctgtaatcctagcactttgggaggccgaagcggttggattgcctgagctcagga

SEQ ID NO: 8070 - DNA, 1060 bp, Homo sapiens
agtcccagctactcgggaggctgaggcaggagtatcacttgaacctgggaggtggaggttgaagtgagcccagatcataccactgcactccagcctggcaacggagcgagactccgtctcaaaaaaaaaaaaaaaaaaatagctacagtaaaattcataaataccatgattggggtatggcaaggggctataagatcacacagatgaaagtagtttactctgtatggtgaggttgtgggggcagtccagggagtgtttcagaacaagtcggatgtttgatcagagtttcaaagattaaaaggttttaggcaaagggatgagcaagtgaagactgtttcaggcacagagaatagcatgtacaaaggcactgaagcaagagtaagccgaagccttttgagaattactattatttaattggggctgcaacacaggtgtttgtggctgtgaagttagatgaagctggaacaacaggtaggagttagatcactaaggacctagcattctgtgctaaagaacttaaacttgacagggaggagctattgaacagttttaggaagagtgacataattagctgtatgttaggaagggccaggctggagggagttaggctatagtaagggatgatgaagacatgaaataactaaagctagccagtgaggttggatttgaaatacttagtacttagtagatagaactgacagaattgctgatagtttggagaggtgtgtgtgtggttgggggtactgagggagaggaaagaggttctggccaaagtgcccggggggattggatactgttaagatgtgaggccagaagcttgctagagctgccggagaacagaatccagggagatttggatacagttaccaggcagaagctctgatggctcatcttgtcccaccttcaatccccaccctaattccttttctttttttccctccctttcctccctccctttcttccctcccttgtctccccttttccccttcccctcctctcctctctctctccctctccccgtctcttttcatttaaaaataaccatagattcacaggaggt

SEQ ID NO: 8071 - DNA, 1044 bp, Homo sapiens
gagcattcaaagtatagggaacagcatttgtaaaggctctaaggaaggaaaatgtcaggaaattaaaggctagtgtggctgaagcacaatgaatgagaaaagtattaaaagatgaagttgaagtggtaggctggagcctttgggcagggctcaaagaagtttgaattttattctgtgtgtgatagaaatcattgaaagattttaagcatggaatgccaaaatcattttttattttagaagttcactcctgctgctgtgtaaagaacgaattgggtaatggcttgagtagaaaggggatagctagttgggaggttgttggagtactccaggtgagagatgatacaatcaaaaaggctgttggcagcgaaaatagagaaaagtagacagattgagatatattttggaggttaaatcaaggagactaaatgatggattagaagagaatgagggagaaggagggatcaagagggattttcaggcttctgggttgagcaattgggtggatagtggaaccatttaccaagatgaaaaaaactggaggaagaacagaagagattgtgactttgctcctttctgaaaaaaacaaataaaaaaagaccataaaagatggtagaatagagaactccattttagacagactaaaatgggagttccctcccccattaagtatctactatatccaagtgaaatatttgattggaaattgcgtataagcagctgatcacttgaggtcaggagttcgagaccagcctggccaacacggtaaaactacgtctctactaaaaatacaaaaattagccaggcatggtggcacatgcctgttatcccagccactcgggaggctgaggcaggagaatcacttgaacccaggaggcaggggttgcagtgagctgagatcgtgtcactgcactccagcctgggtgacagagcaagacttggtctaaaaaacgaaaagaaattgcatataagaacttggagcttagaggagagatttgtgatggtgatataaatttggggatcatcagcatatgggtgctatttaaa

SEQ ID NO: 8072 - DNA, 1031 bp, Homo sapiens
gttggtaaagccagcagcccctaaagcacgtcccagccttgtctcctctgtgctttcccccaccactgctgctgcacgcctcatttgctgggccactttagtggtggaaccattagaggctgagtgacttaaaggagattgagtctgtctcgaccccgagagagagtgggatggatggatgcatcgtctcatttagaaagtgttgcctctgactctaacacactcttctctctttctttacctccctccctgtcttcctcccttcccctcctttccctaacccccttccctccccctttctccttctctctcacagtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttttctgtagggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttatttgtgcctcatttccccaggaatagtcactgccttgaggaacctcatccttttccctttttttctgcttgatgtctgctgtcttccctgttttctttttctgaaatttaaaggataagagggtggggtggatggggacttaggcacaaaatgttaatttgttaatttcacttgggttgtaaaggtacttaagggttttagctgtgtggaggtgttaagggtccctccttttcccatttacagggtcaaggaagaaatgttcctaactttccaagttggaacaagatttatttcacataaaaaacctttctagtc

SEQ ID NO: 8073 - DNA, 1048 bp, Homo sapiens
gcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacaggtccgcgagaacgggcgagacctcagtgtgggaagggggtacctgaaatttggtgtatcgggaggggggatcgtagatgccgcggcggcagcctccgggtagggagtggaggtggcgttgatatatccagaaaatggggtggaggatcgcactgatcctgcgaagtcccgggctcggacctctgcagcccctgcgacttgaagccttcggagcggctggagagcgggctcgcttctgacctgttctcttctgcgttctagcctcccacatgaccaaggacatgttcccggggccctatcctaggaccccagaagaacgggccgccgccgccaagaagtataatatgcgtgtggaagactacgaaccttacccggatgatggcatggggtgagacagagagggtatgctcgcacccaagtagtgatgggagaaggccggctgggttgggtggcttgactgtgaccctttttcccgaaccttctcgtgacccctcagagtcaatggagtgggtgcttttctctgtggagggaggtgggaggggggtgggtgagcagctgcagctgagaggacttcaattttctccttggctcaggctgtttcctcaaatgaggaagccgaggttttaatggctccctcgaggacccccgaatagcaggagccttccttggctctatccagagcgtcgagtttcatttagattgagcatctgctgcgctcaggtgctgtcatccaggcatgtgaccaggctggagctggactcctgtcatgagaatcttatttgtaaacggagtactctatatttgtgtgtatgtctctttaaaaaaaatgtttttctgttagtgctgtggaaatcgtagcaactattaagcagattaaaca

SEQ ID NO: 8074 - DNA, 1123 bp, Homo sapiens
aaagaaaaagaattaaagaaaagaaatatcacccagcctgggtgacagagtgagtgagactgtctcaaaaaattaaaaaaaaaaagggccaagcgcggtggctcacgccagtaatcccagcactttggaaggctgaggcgggcagatcacctgagatccggagttcaagaccagcctggccaacatggagaaaccccatctctactaaaactgcaaaattagctgggtgtggtggtgcatgcctgtaatcccagctactcaggaagctaaggcaggagaatcacttgaacccgggaggtggaggttgcggtgagccgagatcgcgccattgtattccagcctgggcaccaagagcgaaactccatcttaaaaaaaaaataaaaataaaaaaattttaaaaagaaaaaaagaaaaagaattaaaatcacttctcggccttttggctaagatcaagtgtagtatctgttctcatcagtttagtatctgatatgtcctctatctgaggacaatatattaaatagatttttggagcagggagatggaataggagcttgctccgtccactccatgcatcgacctggtattgcagtacctccaggaacggtgcactcgctccggggatacaaaaaaaaaaaaaaaagaattaaaagaaatatcacctaaataatgcttttctgtgtatttactagtatattttcagaataccattaaatattttgaaatattacccataattcagcaactcacaaataaccacattaacagtttggtgtagtacttcctgcatacaaggatttatgaatctgtgctacaaaaatatttatccacatgctataattcctggatatctgtctctatgacttttcagtgaaagcatgaaagttttccagacatctaaatatatcagcacctgatctttgcaaccttaagtttaggtgcagcgaagagatggaaagctgttaaaactgttaacaaaggagttgttgggttattatgtatgaccttgatgtaaactctgttacagttcaaattctgttacaaatgccattccagtgacatcaagcttatcagtcccaaagatagaagaatagcaccatgatattgctgaacttttcagggcatc

SEQ ID NO: 8075 - DNA, 1044 bp, Homo sapiens
tcagggcagagggttttaatattttattttatcttttttttttatttcaccaacttctttgagaacctgatgaaaactgtggactgttttctccccaaaatgcacaaatgtgcaaaggtttatgtctttttccagatgtatggaccttctaaagcccacgcaaggctggctcaggatttggggtagagttggtgtaaaagcacagtgtcagtaggatttggtttggggctggaagaaagctccatcaagatggagttaagaccaggcacagtggcttatgcctttaatcccagcacattgggagaacagggtggacagatcatctgagctcaggagctcgagaccagcctggccaacgtggtgaaaccctgtctctataaaacatacaaaaatttccagcctggcaaacatggcgaaaccccgtctctactaaaaatacaaaaaagttaggcgggtgccgtggctcatgcctataatcccagtttcttgggaggctgaggtgggagatttgcttgaacctgggaggcggaggttgcagcgagccaagattgtgccactgcactctagcctgggcaacagagcaagactctgtctgaaaaaaaaaaaaagattgagttaaagttaggctttaattaggcgtaggattttcttaatgttggttgcttttaagttaagatttgtagttgtccaagaaataagatttgggtttggtttagagttgggttagcgattaggttcatgtaaaagctagattagagagacactggactgcatttagggctagatgtatcatttgttcaatgggcattaggattaggagctgcttgtaataggcaagttttgctcactttggtcagggattctgatagagtgggatcccatggagactggcctagtttgattgaaatcagcccccagctccattccaggccacaaggctatgaggccggtatgagatggatggacaggcctctttgtctgcccatcaccaggccttggtgctagtgatgacaccgtcactcagccatggtgtccgggcatgga

SEQ ID NO: 8076 - DNA, 1027 bp, Homo sapiens
cagggttagctggaggagactgctgaagtaatttataataggtaaatagtttcatgtagaatttatgataacaacaacaatttggatttatgatactctttctctgaggaatgcctatgtggctatataaaatcccatctatccccagagatgattttgctaaaataaagaaattttgaaggtggcctacggacctataaaaagaattatacagaacagtgaaaatacatgcaggttttattcacaattctctgccttggcaggcttgacatattcccatctgattatctgccattctggttttttttttttttttaactttctaattttgaaataattatagattcacaggaagttacaaaaataagatggaaaggtgtttgtgtaacatcttacataatatgtaataatcaaaccaggaaatagaccctggtaccatccatggacctttattcagattgcactctgtgtgtgtgtgtgtgtgtgtgtgtgtgtctgtctgtgtctatgtgtgtctagtcctttgcaattgtatcacgtgtagattcagataaccatcaccacaattgaggtacagaactgtttgttccatcagcacaaaaattcctcatttaccccttggtagtcacacccatccttctcccctcctcctcttcccattgtccctgattcctggcaacttcttatgtgttctccatctctataattttgtcattttgcaaatgttacataaatggaatcatacaatatgtcactttttgaaactggctttttaaaaacccagcataattcccttgagacccacagatgttgctgcatgtatcaatagtgcattcctctttattgctgagtagtattccatggtatggatataccaaagtttcttttccccattgaaggatgtttgggctgttttcaattttttgactattgcaactaaagctattacaacacgtacaggtttttgtgtgggcatacattttcatttctctgggataaatgccaaggagtacaaatgctgtgttgt

SEQ ID NO: 8077 - DNA, 1032 bp, Homo sapiens
ataaattacaattggaataatgatccagagagatttataacattctgtataatttaaaaatagtattcagctggccagatgcaggaggattgcttgaggccaggtgttggagaccagcctgggccaaggcaggaggattgcttgaggccaggtgttggagaccagcctgggcaacatgcatatatacttatctacagtgaatacatagttgcctctagagagggagagtcttggctaggggtttcgagaaagactcacttttcattgttaacctttcatactatctgtgtgtgtgtgtttttttatcctgtgcatttactactttattaaccaaaaataattattctatatgaataaataagtgaaataacaccaggaggcagaatattatttagctaaaagtgaattaggtatcttctttctgcctgccaaaaccattctttctaacctgtgtccattagaatcttgaaagctggacttgcttgctggcttttagtaaaatttggcaaatgtgacggtataagtagaggctcgaataaatgagtgtatctcgccgggcgcggtggctcatgcctgtaatcccagcactttgggaggctgaggtgggtggatcacgaggtcaggagatcgagaccatcctggctaacacggtgaaaccccgtctctactaaaaacagtaaaaaaaattagctgggtgtggtggtgggcacctgtaatcccagcttcttaggagactgaggcaggagagtgatgtgaacccgagaggcggagcttgcagtgagccgagatcgtgccactgcactccagcctgggtgacagagcgagactccgtctcaaaaaacaaacaaacaaaaaagaaattagtgtatctctccctggccagcaaatttccaggcagacatggcagttatcactcttgtcccaagcagtgtaccttgtatgggcagtggagcaagctaaggagacacaggagatatatgggaacctaaagtggaattttcaaattcttgctcatgatttcaaaattctctt

SEQ ID NO: 8078 - DNA, 1076 bp, Homo sapiens
cagaacctaaccaatgccaggaggaaaaggatgtgaacacagccaagttctgaatcttaagctcatgcacataaaggacccagggttatgcttagtgcttctgaaactgtttagacatttttgacatgtgggtgccatgttaagatactttatctgctcagatttcttcccttgagcctctctagaataagaatttagaggctttggttgaattcttgaagatgtggtatgttacacattttaaggaagggcctttggagctacgggtgttgttcaaagtgtgacttgccaaagggaggaccatgtttttggaaactcttgcttgagcagttcctaagcaatgtctatcaaaatacctattatgctaggaccatggttctcactttttgtgttaaagacatagttttgtataatgttagaatttttgatagtacattaaagaattaaaggtaaatgtcatttttttttaaaaaagcaagtttcagaaaattgaagaacctgttcgtgattatttacactattgttcaccctctggtgtgttactgtttgaacagtattgtttgcagccctgaccttgttctcttatatcctttgaggtaaagttcatatatgttcctctgaacatgcaatctttattttattttcagcaaattgtatcatgggcaatattttggcttagtgtctgatagaaatccctgtaaaattgtggattgttagttgaacaaaaataaattctatatattgtttaaaatttgatggtgcacttattcagggttactgctataccacttgtctgcacagtgatggttgagagccacttttagaagcacaaagttgtttaagacttgatcctgtggaatttatgactaaattagccaaaaaagatgatgtatagctgtgaaaagctagcaatgcctaggtgtatggtaggttccatctaacagttcagatggcatgtttggaagagtcacagaagtagaggctttatctagattttaaagaatggatgaatttgactagtccccagaagtagcagtcaggggcaaaggtaggctggggctggcagtataggtgaa

SEQ ID NO: 8079 - DNA, 1044 bp, Homo sapiens
agctgggatccttgtgaccttgggaaagttttttcacctctctaggactcagtctcctcatgtgtaaaatgggattcacaatagtgcctacttataggtggaaggccaacaagaaagcacacccagtagtcaaaacagtgctgggcacagcatccactcagtacttgctatgagggttgttgtttgaagaattccttttccccttttccccttttcctaggcagcccagagccctcagaggaagccctcagcaggctgagtagattatcttaagctcaaccccttccctgcctgcctccaaggatacagatgcaggttagaaggtgtctcagagggggtatggcctttgaggtttccagggatctaacagggaaacttctgctgcagagcagctccaggccctccagcgctgacccaccaaattttgctgcatcaatgtgcttcgctgagctgttatgtggccctggcgtggctctgaaggccgactgagaatcccaatccatctaggaggatccttggaattaagccaactggggatgagggcaaagagaggtggttgggatgggtcccaggggcagaggcctccctgtgctactgctgagtgggcagcagctttggattctgagaaggggtcattttgctggtgctaaggccgggagcttattctgatgctgcgggctctctgactggcctttcacctgcagcccccaagctcaggcttcccagaatgaccatcctccggggctggcaccaagaactggctctgtgccgcagttagagagagaccctgctggtccctgctcacttcctcaacatctcagcagctcaaggccaggcctctggctgccattcgtgactggggcctgggttaagaagcttaggacactatcttcaagacaaatgtgaagtaaacttgggtggtgattacacttgacctgtgtaaagtcagcgaaagtagcaactgaaaggggatagtgggcttggctggaggcagctcccagcttggggactgctccaagtagaatgtggggcttgtgaatgatt

SEQ ID NO: 8080 - DNA, 1876 bp, Homo sapiens
gaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgctttt

SEQ ID NO: 8081 - DNA, 1050 bp, Homo sapiens
aaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctccttttttttcttcccacagcgtttgctgccaattgatggggcaaatgatctcttttttcagccacctccactgactcctacctccaaagtttatactatcagaccttattttcctaaggatgaggtaattgtctctctacctaccaacttggtgtatgggtatggtgcacacttaaaacttaaccttttaactcactggttaaaggaatccttctgtcttaaaactgcaaactttagatggagaaagttcattaaaacattcagtgtatcttgagaaatttaaggagtttagacttttaacatcttgtgccaagttctttaatttctcccttgagaaagtcagatgaaatgtattcagagttggagttacaaaatagttaatgtgtctaaatgatgtgttgtccttagactaattatctctaatatattggtgttctgtaattttctttcaattgtgaagtatctacaggctgttgacaatcagctaaagaaaaaagcaagactgtttaaagacagtaacagggccaggcgcggtggctcacgtctgtaatcccagtactttgggaggccgaggtgggcaaatcacctgaggtcaggagttcaagaccagcctaggcaacatggtgaaaccctttctctattaaaaatacaaataggccgggcttggtggctcatgcctgtaatcccagcactttgggaggccgagacaggcggatcacgaggtcaggagatcgagaccatggtgaaaccttgtctctactaaaa

SEQ ID NO: 8082 - DNA, 1050 bp, Homo sapiens
tattggatggacagcggcagatgttcacagcgcgtcatgattaattagtttaaattgcaaggttctatctgtgaggtagctcaggtagatttaagggcggtagacatgaactgaagtcacgtttgcgcagcgactgaggcattaaccatgttttcatttacacagctcttcgtacatgcagctttttattgtaatagttggaagtgctagttatgttgtagtctcaaagtagggggtaggggaaattggctgatcttaaagtttgagaggtatagtttttttcctgcagtgtaaattacactgagttacggaatgggacaggttctcgtatagtctaaattttgaccctgtttcatatttattttacaaatactacattttatgttttttaaaagtacccctacccttgaaaaatgacaaaccagatacaaactcttaatgggcctgaattgttaacaaaaaattggtttgctttgggactgtctgactagcacactatatttgtactgatgagactgttaacttgaacaggaggtagaatgctgtcttccaatggaaaagaactatattgcgctgctttatcttgtcagaagactaggcaagtgattttgatttggcctccaaacatttgcctttatgtcttactgttagctagcgttattgcctattaagttagttaactggtgaccttaaatagagacttctgtattccatgtgtatgttcagtgtattgcaaagattattataatggctggtcagaggaaccagatactgtcatacttttaagaaaagtatatttagctctgggcaaaataacatcaattggctctccttagttctcagaatctgtcagactggtattattagccaagtctgattttgaattgtttttgtccaaaaaaatttttctcattatgtttcattttgtcaacttaatttcttgtattttattctactgaccttagttttctgacaagattaatccttctcccccgcccttttcccttacctgtacccttcctcaaaatgtaaaatgtgacttcagacagg

SEQ ID NO: 8083 - DNA, 1124 bp, Homo sapiens
gcctgggcgatagagggagactccatctcaaaataaataaataaataaaggaaatactgaccgtgcgcagcggctcaaacctgtagtcccagcacttagggaggcctaggcgggcagaccacaaggtcaggagtttgagaccagcctggccaatatggtgaaaccccatttctactaaaaatacaaaaattagctgggcgtggtggcatgtgcttgtagtcccagctgcttgggaggctgaggcagaagaatcacttgaacccaggaggtggaggttgcagtgagccgagattgtgtcactgcactccagcctgggtgacagagcgagacttcatcttgtggggctggggggaggctctgtatagctcctgtacatgggagacatctacccttaggctcaagagacctcaatattggttgctggatgacaacatttgccttccaggtttctgctcaggttcttataattcattcttatagggatttaaacttaagtttctaaggcccttaggaattttgaacctgaaatctggattattgagcttgaaatgtattacagaaaacatttgatattcagtttttaatttaagaattattaaaagttaaattcttaatgatacacagtattgtttctttctcttctcagggtttatctctgcactgagcatttatggtggtagctttccaaaattatatagatacctcttacacaatctcaagctcttacagcaagcttgtccagcctgtggctcaacacaagtttgtaaactttcttaaaacattgtgagtttttttattttttattttttttaagctcatcaactatcattagtgtattttatgtgtggcccaagacagttcttccagtgtggcccagggaagccaaaagattggacaccccttgtaacatcttagaagttttaaataattatcttcatatccacatagctttacaaaagctcacgacagggagagtattttcttggttctgtagtaatttcagggggtttactgattggaacccttccttttcctcctctctccagtccagctggcattcagtcctttaaacaatgtggctatgcagtacttttgattactaatgacttctattatcttcttcc

SEQ ID NO: 8084 - DNA, 1112 bp, Homo sapiens
atgatactttaatggttaagataaattgccagtacctgacaacataagcagcttaatgtgtaactgtgtctcagattattttgttaagcttacagttttttgagtctttttattgatcttcaatagattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttaaaagtatgttagaaagtactgactttaacttgctctgactgaatgctttctggatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaat

SEQ ID NO: 8085 - DNA, 1024 bp, Homo sapiens
ttgaagtaatttaagggtttttagacacaaattttcaaaagagaatgtaatagtagatgttggcatgtttacctcccaacgcccttccattcctgcatccctagtagtatagagaaatctcatttttcttagaggtcaaattaatttggatctaaaattgaggttccacttaacaaatatgataaagcatctttctgaatctaatgtgttctatctctaattctgattatctgtgtgaccattttatttatacatttatttatttttgtaggtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaagtgagtatgtttaatgtacctgctgctgaagcctgggtggttccccatactggtaatgtggaaaaggttcttaaatgagtacactgtaactgacagaaaattgaccatgttttagaatatgttctttaggccggttatg

SEQ ID NO: 8086 - DNA, 1032 bp, Homo sapiens
ccaacactgtaagaggctaaggcaggcggatcacttgaggccaggagttcgagaccagcctgggcaatatggcaaaaccctcatctctactaaacaaaaattagccgggtatgcctgtaatcccacctactcaggaggtggaggttgcagtgagtcaggatcgtgccactgcactccagccttgggcaacagagcaaggctctcaaaataaaaaagcagcggctgcattttatgcctttcaaatgctgcaggaaatagaaatggcttaagttcagtaagagaattgacaattcagtgtttttgagaagtggcaatgaaagggaggaaaatgtttattgattttagcctgtttccccaaaaggataagaaactatttggaagtgaaaaagaagggcctcttattttctgttggttcagatttcaaaggtgtgaaaactattctttttcccttactgtgacattaaatcacttcaggcttgtaccattttgtatggcctgttgttaagttggacatgacaatttgtaaaatgtgaggatcttttcctttcttgtaagttagaagaaataacctcttcagttaaaccttcagtgaaggttcttttagttttctgttctgctttctaaaaacatagactctgttctttagagcaacttatgactctcatctctgctgcacgagaatatgagatagagttcatctatgcgatctcacctggattggatatcactttttctaaccccaaggaagtatccacattgaaacgtaaattggaccaggtaactccttactttttattcatttttcctgactatgtacttgaaactagaagtttactcagttgcttttacgatgttaaaaggaaatcaaattcctatttctttgttttctttttttgtttgtttgttttgttttttgagacagagtcttgctctgtcgcccagactggagtgcagtggcacaatctcggctcactgcaacctcctccgcctcccgggttcaagtgattctcctgcctcagcttcccgagtagc

SEQ ID NO: 8087 - DNA, 1937 bp, Homo sapiens
tagactgagacaagtggaaagtaaaggttagacaagatgtaaagtgtgtggtttgagctgtgatgagcacactagggagttccagataccagtttgatgcttattcaaccatttaggttatcggtctgcgagtttgttttctgcagtgtgtgcataactagtgttttgtcctcttagaggatactctggggacattcttgagttttctttgtttattcctttccgtttaaggaccagaagtaatattcttgaattttcatttgttcagatctttgctctgtaattaagattgcgtgagagtttgttgtttgggccagttaggctgttgaatttcttgggaatgtggtttcaggcattttttggtccctttgattatatcattgtatgtggaactttttttgagagagagagttttgctctgtcacctaggctggaatgcaatggcgcggatcttggctcaccgcagcctccgcctcctggattcaagcagttctcctgccctagcctcccaagtaactggaattccagtcctggccaggaactttttttaaaaaagaggagcacgatcataaaattaagtcagattctttcctaatcctatctctgatttgtttttaattgctttacctgtttatctcccctcacccttttgttgttgttgtttgagatggagtcttgctctgtagcccaggctgtagtgcagtgacgcagtctcggctcactgcaagtccgtctcccaggttcaagtgattgttgtttctcagcctcccaaatagctgggattacaggcatttgccaccatacctggctaatttttgtatttttagtagagacatggtttcaccatgttggccaggctgggtctggaactcctgacctcaagtgatctacctgcctcagcctcccaaagtgctgggattacaggcgtgggtcacctcacccggcctcccctcaccctttctaaagcagttttactatcattctaggaagtaattgttactgttggcagcttgtattacattgctgccgttccccattataagattgagatctcttaaaaaattggaattaaatatatttggactttatcaacagtggaaagatgatagatgtttgttttaaaataactatcacctaagtaactaatgtcatggtagaaaaaataaaaaaaattacctaagcaaaaatggaataaaagtcaccttgtaacgtcaccacccaaagattaaaggaaccttagtattttattaaatatccttccgatttggtgtattttatgctttttacaaaataggattgtattatatgttttgtaacttgcttttctcaataaagcttaccacattttaaaactgaatataatttcattcttactttgaatctaggattttatggaagaccttgggttatggaacagagaaaagaactctttagaaggtaaatcttcattatatgaaggagagaggagaaccttaaactcttaacattttcttttgtttgaagaaatactaacagtgaatagcccaggtgcattttgatggtttctcaattgcagaagttattttaccttggtcccttttttcttcacctaggcctttgattttcaaacttttcctggggagctgaataagttttgggcttcaccttacccagagctgttgtgttttttaagagtgttttgtatgttggcatacattgtaatacttaatttttttaaattccactgattacaaaaaggttaaaagctactgtcatagaatattagctttgtatgagatggagatgctccaagaagagggaaatggagattgacagcctatgaatgttgcctgtttatacatatgtaattttctttctccttaaggctccagaaatgggaattaaatacatacttgtatgccccaaaagatgactacaaacataggatgttttggcga

SEQ ID NO: 8088 - DNA, 1275 bp, Homo sapiens
aagtctgaccccacccgtcttgggcttggagccaggccacctcctaaggaggcggtggttaagagcctggtgttctgttagcctctgagttctacttctttgtaccttgggatcttattccctagggttgtctggttccagtgaaaaaatatgtgtagtgcttctgtcaccaccctttgtggaaaatcggcccacactgacgtgcttgtacttctggagtgaagagaagcacgtttggcctatagtatttcaagttccacttggcttagaatatttttgttgcttccccccacccccgcaaagattcatttgcaacttagaaaattgccctctttcccagctactgtactttgctctcgagggatgaaactttggctttaatcacagattctcgaagtatctgagatgcgtaattggaatttagtgaccgcagaagcggctttaaaaatgcccttctcgccttttttcccatttacagtcgaaaagaacgatggactttttggtagtgagggaaaattaccagatgcttgtttcagtttctggatgagaatggacagatagtccaccttgcagctctgtagaggcacgaatcggttacattattagtctttccgcagttacagcatgtatttgaattttctgaagtattttggccgattcagagtttcctagatgtctgttttatatctctctcgtatgtaatggcgtggataagggtaaaaaatatatatatttaaaaaaccaaaaaggtatggaaaaaggattgctctcgacgttgagaacatcagcttttctgttttttttcaccatataaattagagtattctttcgaaaaatgggtggtggttatggtacagaccataacaggctactttgctgctacagtaaggcatgaaagagttcagcgaagttaactgtcttgcagaatttgggggattacagaatggaaaactgctatatagtattcatcaaaaatgattgcattgtgtgacttatatcgttgtatttattggcttgagtgcagggagattttagaaaaagaatctggtttttgttatcaaagatcttggagtggggatgagagagtgctgggaaatttcggagctagactggaatgagtctaaggaaacttgccagtccattataccttcagttataaaaggagaaaactcatttggtttaaattcgtttgtttagaatagcattaaaaggcgattcttcctatttaaagaacagagttgtctgccattctctcgtttattcctcctccctccc

SEQ ID NO: 8089 - DNA, 1927 bp, Homo sapiens
ctgataaaagctgtgggcccactatccagaagaaagaaaaaggcaagaattcccatgcatttttgtatccctgaagctcatctatgggtcctaagttaagaacctgtgatctagagtgagtgcagcggctcacgcctgtaatcccagcactttgggaggctgaggttggtggatcacttgaggtcaggagttcaagaccagtttggccaacatagtgaaacctcatctctattaaaaatgcaaaattagctgggcatggtggcgcatacgtgtaatcccagctacttgggaggctgaggccagagaatcgcctgaacctgggaagcggaggttgcagtgagccgagatggcaccactgcactccagcctgggcaacagaatgagactctgtctcaaaaagaaaagaacatgtgatccagtctaaccctccatttcatagaagaagcaggctcagagaagggagacttgctcaaggtcactcagtgagtttgtagcaggactgaggctagactcaatccctcaagtctgtcaacagtggcctttgggcacagtcaagagttgtatgtgggccgggcgcagtggctcacacctgtaatgccagcactttgggaggctgaggtgggcagatcacgaggtcaggagattgagaccatcctggataacacagtgaaaccctgtctctactaaaaatacaaaaaattagccgggcatggtggcaggcgcctgtagtcccagctactcgggaggctgaggcaggagaatggcgtgaacccaggaggcggagcttgcagtgagccgagatcgtgccactgcactccagcctgggtgacagagcgagactccatctcagaaaaaaaaaaccaaagaattgtatgtgaagagtggatgctgtgcatgttatgcataatccaagcaaagtgacactatgacaggctctcacaatgccctctgcttttcctttatggcacttctcagtttgtaaccatatacttacttgggtaattatatacttgtcttctcctatacactgtaagttcctgagggctccctgagtgcctggactagggtttttttcttcaccatcttatccatggggcctggcacacaataatggatgtaaggacatccattattcagtaaataataatggatgaaagtacatggtgaatgtgtgtatataattacataggtatggagacagttgttttttcttttgagactgggtctcacaatctcagctcactgcagcctccacctcccaggctcaggtgatcctcccaccccagcctcccaagtagctgggaccacaggtgcacaccaccacgcctggctaattttttgtatttttggtagagacagggtttcaccacattgctcaggctggtctcgaactcctgagctcaagcagtgtgcccacctcagcctcccaaagtgctgtgattacaggtgtgagccatcacgccttgcccagtttccattttctaaggtagattcaagtttagtgggattgaagcagagaactgctagtaagctgagaagtgccccagagcccaagcctacagatgagatccagaaaaaaaacagtaggttggcattcagattgtcacccaggctggagtgcagtggagtgatctccactcactacaacctccgcctcccgggttcaagcgattcccctgcctcagcctccgagtagctgggattacaagcacatgccgccatgcctggctaatttttatatttttagtagagacggggtttcgccatattggtcaggctggtctcgaactcctgacctcaggcgatccacccgcctcagcctcccaaagtgctgtgattacaggtgtgagccactacgccagcctcagattatttcatcttggccattggttgggttctgagtgttgtcagctgctccatctcaaaa

SEQ ID NO: 8090 - DNA, 1033 bp, Homo sapiens
ggagctgctttgcggtggggatagtcgccgtcaagtggacaagatttgcccagagttaggaggtcattctcaccacttaaatgtagggttttcaaccaatcatgcgggatcccagtcgaaagagcgggactatatctctcccgtaggctttcccaggaattttaaggcgttagagagtcctggaagtgtttacttggggtctaacctgatagagatgagtccggagtccaggaaaggggcgcagcgggaccgaagtggggggggggtgcggggggggctcttctcgaagcattcggctgtagccagcgtatggtggtagtctgtgaacctgccgcaccgagacaaacacaaatagaaacagttatgagagcaaggaatttggagccaggagacagaaggcagtggggcacaactctgctgcctcttctttgccaccccaatacactggcctctttctccttcctcctggctttcttccattggcccaggaagtgtggggagttgccatgacaactctgtcctcttaccccttcggctctttatgccaaaatggtgggggcggggtgcagggtgcggggaggagtgcgacaggcggagaaaggggggctgaaagggggcaataaaagatacggttcattccccatccagctcttttctcaaaacccacatgtgcctgcctggcctccccgccagaacccagaaaaatgctccctgagaaggctgagtccgcgccgcccctccccgccaccccccccccccgtccaggaactttgggggcggctgcttcacatgatggggccagggtgagctcctctcgtgcggccaggagaacatgggaaggctccagggtttcgatcctatgcctgccgggccggccctcccgcgccgcccacgcgggcctacccgggtgagggcggagaccggaccgccccggggcctgggggtggagcttagacgccgagctcgccgccaaaccatgaaccgatgcccccgcaggtgccggagcccgctggggcaggcagcgcgatccctc

SEQ ID NO: 8091 - DNA, 1050 bp, Homo sapiens
gagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggtgagtcagtgacgtgggggtcgcgggagggagggtggattccattcctccagacccttccgcctctccgaccccggcctggcccgcacccacactctgccccattcccaggcactcttatggccggtctgggcggcaggacactgggggttcaaagccttgggtcccgcaggggttggggaggaacagaagaggcaggtgtggagaggcagcaggtgtgggcgtatgtgacacagggctgagagggtgtctggagtgggaggtgttacgtgcgtgagcacctgtcattctgtgtgtgtgtgtgtgtgtgcgcgcgcacctcccacagctggttgccatgtgccctgggcttggtgacagctagggtgagtgtgattgtatgtggcagtgcaattgtatggtctcgtcagatgtttgagtttgcgtaggaccctggttgtactgatgaagttgttttgaccatgtgtctctatgtgcaacgatgtgttgtgagtgtgtaattctgtatgaagtggtgtgtaactaccagaatgtgtcagggctctactttagggtggcttgtctctttgtaagccttcatgaccataagccctctgggcaagaatttgttaaagtaggttgtgttgtgttttgtggttgtgagattagtg

SEQ ID NO: 8092 - DNA, 1024 bp, Homo sapiens
cagtctccattccctgctttccaatcacttagcttcctgcagcccccacccttgggcacttggagccatgagcatttgctctgcctcctacttaagttcccagtcagtgtctccacagagctagccctattgatggtccctttcctgccctgtactctgagctgttctcaagaaaagctcagcccccctgcagtcctgtaaccctaccagcttggtttacacaaacatcctggctggggactgagaccaggacctgcaggcctctgtacccacttcccctgtccttagacctccctctgctggggctgaacttgcgtcagctcagcttttacttaccccatgccaattgtggtgaaggcactgcgtattagatcgtttgtcttgtgctaaacacagcccaactctgatcctgacatgacattcctcaggattttggacttccacagggtcaggaagacatgctctggggtgagttagtttggaacacagaaaccattagtgtaaagtgatagcagagtggaacatttttatgggatggttggcaagtctttaagttgatgtggaggaagttctgggagcaaatggttaacagagagcaatctgtgaggagctggagagggttacgggagcggtgtctcgaggctctgagacactcaccacggccttactcagttctgctcatatttgttcccctggcacaggggagcaaagagggtctggtccagtttggagctaatgagctcaagtttcctgctgtttgccatgctgccctttcctctgcttccttcctgatgacttcattaagtttcctatagcatagcagaaattgaaggaaagctcctgagactttggggcccagggcagacacactctcctcctccttcccctttttgtttctcaggcaatctacacagctatttcctgtggggaaatctccttgaagagtctgccagattcctcttggaaccctctcagagtagggacttgggccctctgaccctttctctacaggcttttaccctgc

SEQ ID NO: 8093 - DNA, 1025 bp, Homo sapiens
tgatcagagtgaatgatcatcccctttcttggtctcccctttcttcctagctcacttctgatttgatgtgtagtgcctctcccctgattgtccttgcctttgattcatgatcttacaagctgaagtcacatctggcctggctatgaacagtcccttctttctgtaaccacagatagtcaagtttcctggagtcagtggaagtctgaatcctccccgcatagaaaatcagagagatgttgtgggagaaaaaccccacagaataaaggctctagcttagtcttgaaagcgtaccctatacccaaaggctgggatgccctaaagttcaatccaggcactggataagaagactgagttggcactgagcaatgaaaacaagtagcagatggtgctgaggaacatcccaagactgaagaaatgtggttcccagaacgggagaaggaaggagacattggcaaagtcttactcagcaactgtgacagcctggccagggaaagcttcaggataaggctgagagcacatttgtggtgtcagggatattggtgagctgagatgctcactgttctgtaacctcttctcatgctcttttgccgtactcagagtaaacagacttggtggccaggctgggctggtcaggaaaggcagggaatagaagagatgagaaagtcgcggtgggtgcagtggctcacgcctgtaatcccagcacttttggaggtcaagtctggtggatcaactgagttcaggagttagagaccagcttggccaacatggagaaatcacatctctactaaaaatacaaaaattagccgggcatgatggcacacacctgtaatcccagctactcaggaggttgaggcatgagaattgcttgaacccaggaggcagaggttgcagtgagctgagattgcaccactgcactccagcctgggcgacagagtgagactctgtctcaaaaaggaaaaaaaaaaaaagagagagagagagattagaaagttggccaggctcaatggctcacacccgtactccca

SEQ ID NO: 8094 - DNA, 1060 bp, Homo sapiens
gacctgctttggtctaagaattctcagcttctaagtatctttagtgcagtaaggcagagaagggttgccctggcttaatgttccgcagatttattttcttccatgcagaagtacagaagtatgtacgctgtgccaagccaggggctacaaaaatgcaaaaaccatacctgcccttgaggccttcatggagtatgtatcaggatcactactttcattttagacctttgcctgtgtgcacaccttagacctctcagctgatgtacatgaacggagtcttcacagcagtcccacctgaccctttgtaagcctaagaaggacagataaacctccccgttctccttgaacccccagtgaaatattgtctctttgcagatccataaactattggcccttattcagagtgagttgccacaagcagagccatgatcatgtagtatctctcattcttgcctcagtttcataaaaaaggcaaaagcagaaccctcgttaggtgtccttagtaatggcaggaccccagaagttcctcagcttagcaaatgattgagcttattagaaagcccaggtaattacacccactaaaaaaccttcctgtagctagtccccagctgagaatagttccaggcactgttgtttgctacctggagtcaatttaatttgtcagggaggattatggggttgttcaggggtggtggggaagagcacaatgggaggactcattagcattgttgaaatactaactcctagcttagagttactgatgtatcagtctgaatcattcttgtcccaacccaaaatggaatattaagaccaaaaatgacacaagcttactgcccatggccatacattttttttttgactagtcctgatttgctggacttttaaatttaactttattgaggtataattaacatataataaaatatgtttatgtaaccaccaccacaatcaagatgtagaacatttccatcacccaaaaaatgttctcttataccactttgcagtcagtcctcaccccaagtctgggccatagacaacggctgatatgattattttcactgta

SEQ ID NO: 8095 - DNA, 1021 bp, Homo sapiens
tgtttcccaaatgtgtctgtggagccccgttataaaagtctgcttcagatcttaacagacaataggaaatatagtcttaatagctcctggattaatccagtatagccaggaagtatgctttgaaattgttagagtccctttctcagtgatgaactgagttgttttttctttctttcttttttttttttttttgagatggagtctctctctgtccccaggctggagtgcagtggcgtgatcttggctcactgcaacctctgcctcccgagttcaagtgattctcctgcctcagcctcctgagtagctgggactacaggtgcacaccaccacacccagctaatttttgtatttttagtagagacagggttttaccatgttggccaggctggtctcaatctcccgacctcgtaatctgcctgcctcggcctcccaaagtgctgggattacaggcatgagccaccatgcccagccaactgagttttttttttttaatcccaacactgtagaatttactgacttccaattccctccagagtaacaggaagacggccgaaaggctttaattatccaaaatggggctttgagacaactaaagccactttgaagtaaattattgatagcattatgcattgtttttctttctttttttaagtaacaagtcaaagtaattagtgctatttttatctttgcagattcactgaattataagggattttaaggctgccttaaaaaaaactcctcactggctgagtgctgtgttgctgtcatttatgtaagctagaggccctgctgagggaatgtgtgtgtgttctggggctgtttcacatgccactggtgtaggtgtttggacgccttactgctcttggcggtaaggtgtttgctcaggctcttcgtggcattaaaggttctcttctgtgtttctcactgaggaccttcccaaatgtatattattaatcttataagccaaaagagaaccaaggacactcttataacaggcagctgcaaagccaagccatttagt

SEQ ID NO: 8096 - DNA, 1048 bp, Homo sapiens
ttaaacactgaaagaacctaagaggccatctatgtcagtctccttcccaaagcataaatctcatttgttggagatatattcagcttctgtttgaatacttagagaaacagtgcttaatactttaggttccagaccattcattcattttttatttatttatattttttttgagagggagtcttgctctgttgcccaggctggaatgcagtagcacaatctcggctcactgcaacctccgcctcctgagttcaggcaattcccctgcctcagcctccctgggtagccgggattacaggcacctgccaccatgcccagctaattttttgcatttttagtagagatgggatttcaccatgttggccaggctggtctcgaactcctgtcctcaggtgatctgcccgccttgaccttccaaagtgctgggattacaggctgagccacggcccccagcccgttcattcttttaaatgatgagtatctcatatgttgcagtctttctctttataacctgaacctgttgattccatttctgcctttagttacaacactaaaaaatttaccctgttttctaaatgttaacttcttcaaaggagtaacatgtgtactactgctgaacattctttctctctcagctattcttcatatgctatggtttcaaaatctctgacatactatgattgtcctttggacatattcttacttcttaatttatctcctaaaatatggtgttagggtctgccttataccaaataagcattcagtgaatgtttcctgcattgaatgacatctagaactggaacctagatatgtagctcagattacaaggagactatttatacgcatgatatggacatattttatttgcagcctccaattgcattatgttattcagcagctgaatcacattgttggttcatagcaaacttgagtcccactaaaaccttcaaatctgcttaaagtgacctgccttcaagctagttctctcccgtcctacacttgttcagttgatagtggtattttgttttggtttgtgtggtgctgcttttta

SEQ ID NO: 8097 - DNA, 1053 bp, Homo sapiens
cctggacaacaagagcgaaactctgcctcaaacaaaaacaaaaacaaacaacaacaacaacaaaatatcttattgtattgtattttttgtttgtttgttgtacttcgagagacaaggcctctctctcttgcccaggctggagtgcagtggcataatcatagctcattgcggcctcaaactctggggctcaagtgatcctcctgccttagccttccaagtacctgggaccataagcatgtgccactgtgcctggcttgtgccctgtcttttgtatctcgttttctcccactaaggtagggcctgccgattgtggcccgtttttattggctcaaattaggaactatttctagaatattgctcccaggagaaagggagtcaatcttgagctcagccctctgtcctgaatcaagctacctgactatgaaaaagatctctttagtggttccaggtgcattctctgagagtatcatttgaagccttgtagatatggggcctcaccctgtgtaaagtctcagattttataagaacgtgaacagccaacctgaggaaccttataagaacctttcattatatttgtgagttagttgggagagatcttgtatgtatctggtgaccttactttaactattgttttggcaaatgattaaacattcctttttgttggttaactacactgacattttctctttcttattttattttatttttgagacagtctcgctctgcccaggcgggagtgcagtgacgcagtcttggctcactgcgacctctgcctcccaggctcaagtgattctcgtgcctcagcctcctgagtagctgaggttacagggatgtgccaccacacccggctagttttttgtattgttggtagagatggggtttcactatgttggccaggctggtcttgaactcctgacctcaagtgacccacctgccctggccctccaaagtgctgggattataggcgtgagccactgcatccagctcttctttttctttttctttttgtagtgacaggatctcactatgttgcccagccaggttggtcttgaa

SEQ ID NO: 8098 - DNA, 1854 bp, Homo sapiens
cgggtatacaccactacacccagcttcctttgatccattttgagtgaatttttatatatgatataaagtaagcatccaacttcatttttgggcacgtggatatccagtttccctaatgcccactgctttttttttttgtgacagttttgttcttgttgcccaggctggagtgcaatggtgcagtcttagctcactgcaacctccacctcttgggttcaagcgattctcctgcctcagcctcccgagtagccaggattatcggtgcccaccaccacactggcctaatttttttgtatttttagtagagacagggtttcaccatgttggccaggctggtcttgaactactgaccctcagatgtgagcctcggcctcccaaagtgttgggattacaggcgtgagccatcgcacccggcccccactgcttttctgagataactacagctcagatttcttaacttgagtcaggctgaatttggaacttaactgtgattagagatagaaatggagcctctcccgttttttcctacatatttccattcctttttgtttcttaggtttgctcattcctctgctgtttaagagatagcataatgtagtggttaagagtggggactctagagtcaggttgtctgagtttgagtccttgctgtaccattactttggacaagttatttaaccattctttccttgagttttctcagctataaagtgaggataacaatggacctatgtcattattgagattactaaatgacaatatatataaagcatgtagaatagtgcctggcacatattcagtgctatatacatgtttattattattatttttaaaaatttgttgtcctgattgtgcaagtctgggaatcttatcagccccttccatacccaactttgttcagtcctttttctgtactcatctgggcttagtagggaccagagacacaaaataatatttatttacaagctgacatcaggggcaatactggaacttaggctgtcagcctgagcctttgcatcattgatgggaaaatagtttgggtgggaagagtttgtgttttctatcactttcagtcctttgaggagatgtctgaccatgcaaccttggctatatcattgtggtaaaagaatgtctccaaaatgaatacacgtatacctgagaggctattaaccaacatgttcttatctctggttggcaggattataggtggttttataggttggtgcaaaagtaatggcaaaactgctattacttttgcaccaacctaataagttttctttcttgtattttaatttattaaaacatttagctgtgaactttttttgtagatactctttatcaggttgaagaaagtcctttctgttcttagtttgttggctgtttttatcatcaaagggtgttggattttgtcaaatgctttttttgcttctattgagatgattttgtggtttctatttcttattctattgataaaacgtactacattaattgattttcagatgttaaaccttgcattcctgggataaatcctacttggtcatggtgtataatttttatattttgcaggactcagtttgctagtacaggatgagcatctcagatctgaaaatctgaaatctgaaatgctttaaaatctgaaactttttgagtaccaacatgatgtttaagggaaatgctcattggaacaatttgtgtttcagatttctggattagggatgctcaactggtaagtataatgcaaatatccaaaatttaaaaaaaaaatctgaaacctaaaactcttctggtcccaagcattttggataagggatattcagcctatgttttatgtccatatgcaatatctgcagacca

SEQ ID NO: 8099 - DNA, 1022 bp, Homo sapiens
ttttactgttgctaataaccggactcagtatacatctaaagtagcaaaaagatccagtcatggacaggttcagtggctcacgcctgtaatcctggccctttgggaggcagaggtgggaggatcacttgagcccaggagttcaagaccagcctggccaacatagtgagaccctgtctctaaaaaacaaaataaacaaagattagctgggcatggtggcacatgcctgtagtcccagctactcaggatcctgaggtgggaggatcatttgagcccaggaggtcaggttgaggctacagtgagccaagatcatgccactgcactccagcctgggtaacagtgagaccctgtctcaaaacaaacaaatcagttttcttaagagattattggaaagaagtgtttgaatgtcaccacagtaaggccagatcagggaaaaatacaggtagtactaagcctgcaaatgtttaccctttttttttctgacatctattctcacttattaaatgccagactttgtgctactctttcttatgctaccttctttaatcttcaaactctatagggtgtattatgtactttttaaaatatactttttcccagtgaggaaactgagtcttaaagatgttgtatattgtggaaggccccatatttgttccttggcaaagctgagaattaataataggtcttcttcttcttcttttttttttttttttggagacagggtctgactctgtcgcccaggctggagtgcagtggcgcgatttctgctcactgcagcctccgcttcccaggctcaagcagtcttcccacctcagcctcccaagtaggtgggactataggcacgtgccaccagacctggctaatttttgtatttttttgtagagatgtggtttcaccatgttgtccaggctggtctcaaactcctgagctcaaatgatccacctgccttggcctcccaaagtgctgggactgcaggcatgagccaccatgcccagcctaatcataggtcttctaagtccaagttc

SEQ ID NO: 8100 - DNA, 1046 bp, Homo sapiens
aggagagttaaagagagatcaaaagagatggaaatgaccaacagtagaatttcttaggtagcaacacctccttttaatataaaggactattattgctgcctatggatagttgtatgattgttaggctctaaaagcataggattaaagagaaaacacaataatgatgcagatcttcagatgttggtatagttgttggatttataataagtacacatggtttatgtctataacttgaatgaaattacacattgtagtactaaacaaggtggtagtagtagttgtttccgcctgcatcttctgattcccttctggttttactttctctttcattctattttctttcctttttgtcctagctattctatctctggcctctgtgatctctgtggcttttctctcattctcgtgatctgttgtcctcttcctcattatcctgttccattgtcttgtccacattgccttctattcttcgttctggtctgtctcctgagactcagggcttcctgttattctcctcctatccccattttgtatcctctgctctcttgatgaatcgacacttttattggtatgaagtgttctttgtgttattatagtcatgcattttactttttacatgtgtcataaactctagaatacattgccctcatttttgcttaaacaagcgattatcttttttctttttttttttttttttttgagacggagtctcgctctgtcgcccagcctggagcagtggcatgatctcggttcactgcaagctccgcctcccgggttcacaccattctcctgcctcaccctcctgagtagctgggactacaggcacccaccaccaggcctggctaattttttttggatttttagtagagacggagtttcaccgtgttaggcaggatggtctcgaactcctgaccttgtgatccgcccacctcggcctcccaaagtgctaggattacagacgtgagtcaccatgcctggctgcgattatctttgaaagagatttaaaaatgtcttttatatttatcttttctgactcagcatttttt

SEQ ID NO: 8101 - DNA, 1039 bp, Homo sapiens
attttatattaatttaatttaattttattttttgagatggtgtctcgctttgttgcccaggctggagtgcagtggcgccatcttggctcactgcaacttcgacctcccgggttcaagcaattctctgcctcagcctcctgagtagctgggattacaggcgcctgccaccacgcccagctaattttttgtatttttagtagagacgatgtttcaccatgttggccaggctggtcttgaactcctgacctcatgatccacacaccttggcctcccaaagtgctgggattacaaggcatgagctactgcgcctggcctaatttttttagtttttaatttttgtagacatgggattctgctttgttccccaggctggtctgaaatttctggcttcaagtgatcctcctgccttggcctcccaaagtgttgggattacagatgtgagccactgcacctagcctgtttgtgtttttcttttgtatacacctagtagtggaattgctgggttatgtggtagctctgtatctaacattttgagaaactccagacttttccaaagtggttgtactatttttatttttatcaatattctttgagggttctaatttctctactattaacttccctctgtgatgtgagagccagagacactagctagaggaattgatgtgtatttataattcaccatatgaattttgggggacagatgtcaatctggaacatgtgtgtaatgatttacttgctcttctcctggcatcaaatgttctttccatagttgtttccagttttcttttattatgaatgctgtttctttgtaagcatgaaatctatgttcatttgatatgcaaaagtagaatcatgttttaatatgccttttaaaaatgaagttgaacattatagaaaaatgttgactttccctgttccccttttttgggagatggaggaatttgttgactgtttccttggcctatctttgttgttagaggttgtcttagtctgtttgctgttgctataactgaatacctgagactgaaaaatttat

SEQ ID NO: 8102 - DNA, 1050 bp, Homo sapiens
tctttctaagaaaatctttaaaggagttgtttttcacaaattgtaacagttccttgtaattggagtctgtaggcttgtcagatcttcagaaaaggtattgggaaagggccaagggatgtttattactaatccatggtaagaggtttttgattttctgtcagtcttcaggaaagcccggaatagacagggtcttgcctgcttccacgctgcctgtgtagcagtttgcttctgttgggctgaacccattcccagcagagcacagatttttcttcttgctcctaaaccctcatgtggagcctgcacatgaatcctgcagcctctgtgaaaaccttaaactatcacaaacagagccagctccttgggcagatgggacggaagagggaataggaaaacagattactctcattcctctcagcatctgccttaagtccctgcgtcttaatttttattgtttttgcttggaaatttttgaccagttagagatacactgggaaattacactaaagaaaaatctcatggcttaagtagggtttgacataaggctctaggctcatcctattagctgtccagctgatccttgaaagtagttctcaaagtccaaggatttgtacgaagtgtgatagattacagtttcttaaatatagctctcgcttcttactttttctctatatttttattaggatcaatatgccaatgcatttttgcatgatgacaacatgaattttcgagtaaacttacatagaatggtaggtgtttcttttgcttcttgttttttcttagaggaaattttttgtatgtcggcagggttgggatgaaattgatcttactagaacaaatgtgggtggaaagttgtgccaaagggctttgcatgacggctgttcaacagacccatgcttgttgttgggatttttgtgtgtcatggagctgtttcttaatcaagagttttggaagattcacaagcgtggcaatgatactggatttctttttttttttttttctttttttgagggagagtctctctctctctctctcccccccaggctggagtgc

SEQ ID NO: 8103 - DNA, 1072 bp, Homo sapiens
ccttaacattttcccctctctatcatgggtacgtccagcctaaagacttgttctcaaaattcagcaagatttctccttgttagggaggaatcttcactgatttcaagcaggagacccatcaaagtaaaactcatttatattcaatacagatctttccttcaggtagaaatcgaagtttctttaagaagggccttaaactctttggggatacttggggcaggaagtggaatcaacatacccttcccaggatgttgggagaaaaagcaccgttcttggagactggccctagataggagagcaggtcactgggcttaatttggggaataggaagggggctctacaggcttaggaagagtagataaaagttttgtgatgagcacttggtcctccctctgttgtggaaaaagcttatttagtgatttttttgcctgctggcaaattggctatgtgggtagaagtgttagatggaatatgttgcaggctaagtgcattttatctgttctattccagttataagttctgtggaactcccactggatgcagatgtacagaccagtaatctactgataacctttttaaagtatagctcaattgtcatgcaggacaccaaaggtaagccatagctattttgggggctcaggaagtcaaaggtgtggcaggcagctagcatcaaagagcaacattaatattttgaagctttgacaagatgaactattggggccttgtgtacatggtcttcattgctggaaaatagtgatgtctcacctaattgctagatggcaattaggtggtgttgggaaaacctgaagctggaggggagtactcaaaaatagaacaggaaaaaaattggtctctttgaaagctagcaaatcttcttagcagatcttggtaagtagatgcagactcttatgtgtgggaagtggagggattagcacgcttcagggaattcccttttgaggacaggaactgaaagcatcagctcgtggtgagaattagaggactgtcgtacacagtacagtaggaagaggtgagattcagagggactctgttcttgaacacttaaaatagaagt

SEQ ID NO: 8104 - DNA, 1745 bp, Homo sapiens
aagacaaggaagaagaacaccaaagtggttttttctctgctttaacaaatatggtaagtcctgctttttttttttctcctgaaaaaaacagaaacagtgtggtctgcaggggtggacaaatcgggctccgaagttcagatatttgaagtgatggcatgatgacaagagagaggctgctcagagcagattttcttggggagtgtatttcctttactgagtttctttcttttttttttgaatccccacttttgatgtacctttagtgagattcaaaaccaagtgagatggggaaaggagagctttggtttctctggcacttagtttttccacattaattaattaattaattaattttttaaaggctaaagaaaaggtacacattaagccagaatttgcttcctaaagagttggctccgtttaggcactgaccttgtggaacacggtatagtagggtttggatctgagtgctctcctgaatgctcctttgctgtctgccatggctgtttgatcctcatagctggtcctagggttgagcgatcgtgcagtagatctgtgccactcttctaatagcttagggtttgggcttagaggtctgaattttagggaagttattggtccagctggcaagactccagggcaaggtttcttggcatttggtaccagataatctgggactgattttgaagagataaatctaggagattctagaatctaggcagattcagaaagtctgtctttcgggcattattatccaagtattcagctctagggcaagacaattttttggttagttgcaagaagtagttgccccctctcctcctccacttctgcaattctttttcctccactgcttacgaattgttccttctgccttctcagcctgttctcaggaaggggcctgataaactctttaactccaaaatgtaaatgagtgaagtctctcaggggctagagaagtatgagttttgtactggtgtttgatgaaatgaattagatacaattatactgctcccagatatctctgcctttcagtcaagttttcagaaagttttgtaccaaacacatgaagctctaggagcataggtttgtgtatagtttcaagcataattaaggaggtggaagaggtattttttagtgggtgtaggcatcttagtgcttctgatatcatacacattagaggcagcctactccatttacttattcacttgctctgactaggacacaaactaaagattttgttatctgaaaaatggagagtggatctcatatagacagctttggtctgaaacctgaatattgttcccaaagatagctttatgttggttgaagtcagcctgcttcctgtgaagtttttcctaagttagtttctgacttcaaataagcaacttctaggaaagatacagagtgatgaagatgtgtaggttaactgtcagagggactaaacttacacactgaaaaggagagttggacaaaagtactaggctttttctttaaagcgaggtgatttagtaggcaagatgatttactaggcaagatgatttagtaggattctcattatttcatttattacttatgagtcttttaagattttcaaagtgggctggttttggtgtgtgtgacttatggcctagagttccaagttctccccaggtggaagcagcttgttttcttcactgataaaaggcttcctaggcataaagctcctctcatatcctcctgctataagtttgcaattccccttttct

SEQ ID NO: 8105 - DNA, 1066 bp, Homo sapiens
agggtgaggcaggaggatccctttataaagcttcggagtttgaggccgggcgcagtggctcacacctgtaatcccagcactttgggaggacgaggcgggcggatcacaaggtcagaagatcgagactatcctagctaacacggtgaaaccccttctctactaaaaaatataaaaaattagccgggcacggtggcgggcgcctgtagtcccagctactcaggaggctgaggcaggagaatggcatgaacctgggaggcggagcttgcagtgagccaagattgcgccactgcactccagcctgggtgagagcgagactctatctcaaaaaaagaaaaagaaaaaaaagcttcggagtttgagcccagcctgggcagcatagcaagactctgatcctaaaaataaataaataaataatttttgtataattaatttatgcaaaataggttttgttttgttttttaaaaggcccctcaataaataaatgggagccaggcatggtgggtcatgcctgtcgtcccagccttttgaggggctgaggcaggcggatcacgtgaggtcaggagttcaagaccaacctggccaatatgatgaaaccccgtctctagtaaaaatagaaaaaaatagctgggcatggtggtacacacctgtaatcccagctactcgggaggctgaggcaggagaatcgcttgaacccaggaggcagaggttgcggtgagctgagatcacgttactgcactccagcctgggcaacagagcgagactccatctcaacaataacaacaaaaaatacaaaaattagccggacatggtggcaggcgcttgtaatcccagctacttgggggctgagactggagatcgcttgaacccgggacagaggttgcagtgagctgagattgtgccactgcacttcagcctgagcaacggtgtgagaatctgtctcaaaaacaaaacaaataaaaataaaaatgacagctgggcgcagtggctcacccctgtaatcccagcactttgggaggctgaggtgggtggattacctgaggtcaggagttcgagaccagcctggaca

SEQ ID NO: 8106 - DNA, 1033 bp, Homo sapiens
acctcaggtgatccacccgccttggcctctcaaagtactaggattataggcgtggtccactctgcccggtcagcagctgaggtctaaattagtctcccctggtgctaaggtccctgggtgggggattaagagagtagcaggattgctactctccagactgggaagatatggagaccccgctgtagattggagatggggtcttagtgcccataaagctccctatccagtgtccctctttgtcatcccaggcaggggaagctgaggcctcaaactgttcccctcctaagttctccctggacctgaaataaagcccgatagactggcacctctaccctcacctccctagctggtaggaagacaccagaggaagggactgtatgacctgtccaatctccaatctacagttatcttggccgtgccctgctgccagcccagcttctcataacccagtgcctcaggaccccaaggaatgctattgcaccccacccccaactcttcctttgtagatctggccagcctgaaggacatttaccagccaactgccaccagcaactcaccctgagagtgccaggtaacatctacagtgggtctgtgtctggcactgagtgtacatctagcccattagcctgagtgtgtgtgtatgtatgtgctgctgagctagggagggcctggatctgtttatatgtgcaggtaagggagtatatacatgtgtttgtatgtgggcatgtatatgcatatgtttatgtatgtgtctgttggttaattaattcattcaaatattattcattgagccctctttaggtactaggcccattctaggtgctggggatatgatgttgaacaaagcagagaagatgtgactgctgagtgtgagtgaaggctataaatccgtaaatgagggtgtgttgttaaatgtgtggcttagcagtgcgactgtgttgagttatggggctgctgggacagtggttgtgtgactcggttgggtatttgtaggttcacgtcttgtatgtatatgtttgtgtatggagggaga

SEQ ID NO: 8107 - DNA, 1026 bp, Homo sapiens
aagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtatactcacagctgttccccagggaggcataatgtgaactggcaaaataagaagggcgggtaggcatgttgcaaccgtcagcaaacatgtattgtgtttgtatgggatagttttctgggccccaaggctacacgagtgaacaagagtctgccctcatatagcttagagcaggtgggtgtatcactagccacatggggagaggacaaggatctgttaagcttttctactgtgtgtctgtgtgtgtaagggccaggtatatgggtggggggtactgtgacatttatgcacccagatttaatgtgcaggtgacaaaagtgtatgcaatgggagagttgtaagcaaatgggagactgtaatagacataccttcaggtatggtatgtggggagggggcagggttctgacaagcctgtccccaggtgtgtgtggagggccggttgtacctggagttcatgtttgacgacatgatgcggataaagacgtggcacttcagcatccggcagcaccgagagctcatcccccgcagcatccttgccatgcatgtgagtcgtgggcaggacccaggatgcaagagtgaaggcaggcgggggaagggtggaacaaggtctgccatttcccgactgactacttagacagagggttagggtttcttcatctgaacagcaggtttaataagagactatcctctctcaggagtgtcacaatgctcagatgatagggcaggtgagcagaggcaacccaggtgtcagtgttctttcttgtcttttctcccactctaggcccaagacccccagatgttggatcagctctccaaaaacatcactcggtgtgggctgtccaattccactctcaactacctccgag

SEQ ID NO: 8108 - DNA, 1047 bp, Homo sapiens
agtaggtaaagggcacgagaagcagaaggagatcatcaatctcagaaactctgttgtgccaagaggcccactgtccaggggagtgatgaggagagacccagttatgtcaagtggatgaaagcggaaagaggagaaactgaaaaatgtctgggagggagaaccgaagccagactccattatcaacatggaggaagtgtcactctgcgccctcgaggtcaggcccaggttgccagggcccctcctaggatgaaacattctgcactgggactctcagtcttttttttccctccttgggtgtctagaaaatagtgaacaaaggatctggcttagagccagagaaaggtatcgagaaatccatccctcctccacccacagacctgaacttgaaccccaaaccacagctctttctgctgttacagttccaggcatttgaagacattttctctctaaaatactctgagtgtgcatgtgtgtgtggtatgtgtaattaaaatgatactggctttgaatttcctctcaaagcagagatccgaagttttaacctgacctctagccatggtcaccacggagacttgcctcctcccataaccttaagccagcagatcgtgccctgggtgctgctctccaggccaccccctcatgctcaccttttcttgtgatgtctgccccacgttcctctcctcctcctggagacaggagccatgagcaggtcacataggctttcagttgccttgtgtccacaaaaggggccatgagcagtccgagcgccgagctgtgatccgtgcctgagtcagcctccagaggaacactaaatgctcactcgcccatttcttggttttgcttctttttccttgatttgggggacttgtccctaatatgccacagaattttaattttttttttttttttgagatggagtttcgctcttcttgcccaggctggaatgcgatggcacaaccttggctcactgcaacctccacctcctgggttcaagcgattctcctgcctcagcctcccgagtagctgggattacagatgcccaccacc

SEQ ID NO: 8109 - DNA, 1049 bp, Homo sapiens
aaaaaaaaaagtttgagaatcactactcttgaaagttgctagttgatcagcttaactgttatttttttttctgattagaactgcatggttgtccgggcatggtagctcacgcctgtaatcccagcactttgggaggccgaggtgggtggatcacctgaggtgtgcagttctagaccagcctgcccaacgtggcaaaaccctgtctctactaaaaatacaaaaattagctgagtgtggtggtgcatgcctgtagtcccagctactcaggaggttgaggcaggagaatcacttgaacctgggaagcgaaggttgcagtgagccgagatcacgccattgcactccagcctgggtgacagagtgagactctgtctcaaaaaaaaaaaaaaaaaagtagtgtatggttaaatatcatagatgtatagattttaaccttccctccctctcccttctcaaaatccaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggtgagattacaggaaggcttggccacctggcaacatgacagctaaccgaggtggtctgtctcattggttgggctgatcttgatgggcagatgagccattccaagatatgaagggcatggaggaatttggttcttttctgcttagcaaccaatcagatatcatgaggtgccccaacagtgccccaggtaagccaccccacatgtgcagcaagcttcccctttgggagggatgtgagaacagaagactgaggattgtctctaactctaggattctttgatgattgattggattggggttttgtgttgtgtctaatattacggatgctaaaatgcctgtacttccaaggtgatagccaccaataaccatacacgtactagtcatcctagaagtgtttttgtttctt

SEQ ID NO: 8110 - DNA, 1027 bp, Homo sapiens
tgaagttcatgtttcttaaattgttttatttaatgtcacaggaatataaatcctacatagagatcatgcccgttttgctcactgttgtacttggggcacattaagggtgtttaatgataattgcgtgaatggatattttggccaaaaaatgcactttaaaaattaatgtcattgtatttatactgcaaaactcagccctatgataaatttaacttctaatcgctgtctcccttcatttgacagttaaaataaaatatgggcatatatgtatagatgcacagaatagacttattctggtctctttcatccagcctcttaaatcagcttactttgtacctttcaggcagaaccctgatctctataaatatcctcttccctatttagcaaaccctgataatcctgtgatcccatcctcagtagttggattaatatgatgctgtattatatttgcacttgtcttccctagaccatgcttgaaatgccatttatcattttgctggaagaaaacattagctgaactttgcatttctctgtaatttcactcaaaggtgaagtatctgaagttattatttcctaataaggaaaattactcattagaaatgtagaagcactgtattctacaccattaggttaataaagtttatctatagttagaattttttttttttttgaaacagtctagctctgtggcccaggctggagtacactggtgtgatctcggctcactgcaacctccacctcgcaggttcaagcgattctcctgcctcagcctcccaagtagctgggaatataggtgcccaccaccatgcctggccaattttttgtatttttagtagaggcagggtttcaccatgttggccaggttggtctcaaactcctggcctcaaatgatccgccagcctcagcctcccgaagtgctgggattacaggcatgagccactgcactcagccttatagttagaatgatttctttttctttcttatctgtgctttgctcctctccttttaaggtgaataaacattatgt

SEQ ID NO: 8111 - DNA, 1129 bp, Homo sapiens
gagtaatgaggaaagctttaaagtaccttaaaaggcattagtggcaaacctgataaaattttttaaaaaatctgtggttaatagtattgtaccaatgttaatttcatacttttcataattatactgtggttatataagatgttaatattaagggaaactggaggaagaatatatgggaactctttattttcacagcttttctataagtctagaactgttttagaataaaaattaaacacacatagtgccccaagatgacatacttctttcttttcctacagagtaaaagtagcagaatacagtattttctcaaagtactgtggtaaagatttcttgttttcagtttttgtgcttcctattttcacccacctcccttatttcaagaaagaacactgaatggggagggtccgggagaatttgagtgaaggaatctatttgctatgcgagaaggaaaagatatttttctttccaggcacatgaggggttagaatttcctcatttaagcgcacgtgggtgtgggtatttctaggtagcatctgcacatgtcatttcattctgcaaggtgttttataaaaccatagtgtacacactgaaagccatatctaataatctctatgtagagcatgtttaaatcagcttctgctgacctttaacacacctcacatacttcaagaaatctcaaggtaatttaaactctttcctgaggcagacatcatgaggaaggtagagatatgttgttaacagccatataacccctataaatatgtgtataattttacatgtaaatctattacatacactgtgtatactacatatgttaatactttattcatttatagtgataatgtgggcttttaagtgcaaaattctgaaatcagctaacccttaaaaggttcccccattcctgttgtggacagaaatccagtatttgacaactccaaagtgtaaagataaaaatgttttcgtgtttcactcattatccaattacatttcagggaaaactgcctttgcttctgagccggatgaaggaagtagggaaagtatttcttgctaccaacagtgactataaatatacagatgtaagtgcttcatgtgtatatttatttatgcagtggaattattttggcct

SEQ ID NO: 8112 - DNA, 1080 bp, Homo sapiens
ttttctaatttggtagtcagccctctcttatatttcctaccatcctgctcccattatcacaatttcttcatttgagaatgaaggtgaagggaattttaatgtcttttccttaaatatttttgatgaatctccttaaagtgtgctttaaaatctttgctggaaagagagtctgcattatcatcagtactcctattattttatagtttttaagatagaccttcttttacatttaaacatcccagaaactgggctatatctggcaatataccacctagaattcaagttgagttcttccagagaggatttgctttcgcttctttcggtcacctggggaaaatatcaaccatcctgatagtataaattcagagcacaacctacatgactgacttgttcaaattctcagggagagattttccccctccctggacgcagtacaaaatgggaaatagatgtacagtcaaggctgagatgtacagatttctttgtgggcccttctgtgttgtagatatatttctcccttatcctcatattatgagtatatcccttttgctatcctaactttttgtggaatctcctaggctgtgacttggaatttccccccttttcttactggtatataatatgggtacattttataattgatggcattttaaatcttaatcatcttaaattttgttccatgtatgtctccatactgacttttctctggaacttttaaatactgagtatatgagtgagtaaaatgagtattataatttcatgttttattttataagtgataacacatttgttcagatttttagtgtgtgtgctgccgaagtgagcactgttcagatttttaatgcacaggaggctgttctttttttttttttttgagacggagtctcactctgttgcccaggctggagtgcagtggcacgatcttggctcactgcaagctctgcctcctgggttcacgccattctcctgccttagactcccgagtagctgggactacagcaggcacctgccaccatgcccggctaatttttttatttttagtagagacggggtttcaccatgtcagccaggatggtctca

SEQ ID NO: 8113 - DNA, 2053 bp, Homo sapiens
tgacagagcgagactgtctcaagaaaaaaaaaaaagaaaaataatatatatatgggatatatcttgtcggaataagaagagtaaggtagaacatcaaaactgtggctgggtgtggtggcttacacctataatactagcactttgagagaccgagatgggaagatggcttgaggccaggaatttgagaccagcctggggaacataatgataccctgtctctacaaaaagtaaaaagattagctgagtatggtgctgtgcacctgtcgtcctagctactggggaggctggggcaggaagatcacttgaacttgggagtttgaggttgcaatgagttttgattgcgccattgcactccagcctggtgacacaggaaaaccctgtctctagaaaaaagaaagaaagaaagaaaaaaattcaaaactctgttttttgtttgtttgtttgttttttatcattctaatgcttttattcatgtttcatcttcctaaggaatgacaggtaagaatttagggactggtaagaaatttttcagcttattattttcctcccaaaattctgtgtatggaattctattcagcagtaaaaagtgaactgttgatacgtgcaacagctttgatatatctcaagagaattatgctgagttagtaaagccaatctgaaaaggttacactctgtatggttccatttctgtaacattcttgaaattacaaaattattgagattgataaattaatggttgctaggggtagagattggggtgggtggagggagatggtgggtgtacctgtaaaagggtagcacaaggaataccttatgaggaaactcttgtgtctaactctagtggtaaatatattaatctacacatacacagagtgcatgtaaaactgatgaagtctgaataaagttgtgaattgtgtcaatgtcaatttctttgttgtgatatttttctatatggcacaagatttccccattgggggacactgtgtgaagggttcatgaaatctctgtatcatttcttactcaactgcgtgtgaatctacaattactccaaattaaaaagtttaacttaaaaaattctcttgggtaagccaggcacggtggctcacgcctgtaatcccagcactttgggaggccaagccaggcggatcacctgaggttgggagttcgagactagcctgactaacatggagaaaccctgtttctgctaaaaatacaaattagccaggcgtggtggtacatgcctgtaatcccagctactggggaggctgaggcaggagaatcgcttgaacctgggaggcggaggttacagtgagcctagattgtaccattgcactacagcctgggcaataagagtgaaactctgtctcaaaaaaaaaaaaattctcttgggaggctgaggtggggacatcacttgagtctaagagtttgagattctggcaacagagtaagaccctgtttctagaaaaaaaaaaaaaaaaaaagccacaggtggtagtgcacgcctgtaatcccagacactagggaggctgaggcaggaggatttctgtttttcttttttttttgagatggagttttgctcttgttgccccagctggagtgcaatggcgtgatgttggctcactgcaacctctgcctcctgggttcaagcgattctcctgcctcagcttcccgagtagctgggattacagggatgtgccagcacgccaggctaattttgtatttttagtagaaatggagtttcaccatgttggtcagtctggccttgaactcctgacctcaggtgatccacccgccttggcctcccaaaatgctgggattacaggcgtgagccattgcgcctggctgaggcaggtggatttcttgagcccaggagtttgaggttacagtgagctgtgatcatgctatcatactctagcttggaaaacagagcgagaccctgtctcttaagaaacaaaaacaaaataaaaattttcacagtgacaccttttcttacgtcacatgaattccttatctgttctagatacaagatgctcttaaaaatgtgcagtgatac

SEQ ID NO: 8114 - DNA, 1075 bp, Homo sapiens
tttcatcatgttggccaggctggtctcgaactcctgacctcaaatgatccacccaccttggcctcccaaagtgccaggattacaggcgtgagccaccacgccaggcctttactgctatttttatacttttatcagtttgggcgtgaagaatattactgtactacatcataattcttgaacttttcttaacattatgttaagtaatgaggtaattatgggagggacaaaatttcctttcattgtagtttaaagatagtggtcttactatatgtggctatcagcattttattggcacaccattttgaaggaaagaatattcagtgcagattgctaaccaggcttaccctacagtttcagttgctctttgcttcctgttttcagcagttgcctagagctgttggagcagctgttttcctttctttgggggagggtgatggtagtggtgaaggggactgtgcatgttttgcctgtgaattattattttttttttttttgagacagagtttcgctctgctgcccaggctggagtacagtgatgtgatctcctgacgtcaagtgatccattcgcctcggcctcccaaagttctgggattacaagtgtgagccactgccactggctgaaaaagtcttattgtggcataattggtatacaataagttgcacagagtatataataaattttaacatatatatatgtacccatgaaaccatcaccataatgaagatattgaacgtatcaccccttctccccaaaagttttcctgggctcctttgtaatacctcctcctctccgtacttgacctccttaccccagggaaccactggtctgtgttctgtcagattagtgtgcattttctaggattttatatatacggaatcatacactatgtactctttttgtcttctttcactcagtgtagttattacgaattttttaatgttttgcatgtaaatactttattcctttatattgcatagtagtattacattgtacagatgtaccataattttttttatccatttacttgtggataacatttgggttgtttgtagtttctggccattacaaagctgc

SEQ ID NO: 8115 - DNA, 1045 bp, Homo sapiens
tgctgacgtcctccagctgattccaggctgttcccggccacccctgaggccgtcttttcgcttcttgtaaaagcctccccgcccccagagctcctcggtcgcctcccgagaagccaaggggcctctggtggagcgccaggttgacagcgttttagcaggaccgcgagaaacggccagctcgtttgccacacgcccgtgtgcaacacttcctggaaaggtcacagcgaattgcaagccgccacaaaaaacatccggacagctcctggtcagggggctgagccgttcagtggcggcctattcttctccttttttcggggctcctgaaatcggagagggcgagatgccgatctgaggcctgaacccttagtttaagaaaaacgttttgggggtttgactccggcaggccacagcttctaaaagcagcaggtagaggctgctgtccgaatcgacgttttcctgggctttcacctttagggccttgatgtttgaggggggtcgtgctctgaagtacagcgccccgaaatgactagtcaccattacaggggggtgtgtgcgcgcccgtccaggggccgatgagttcttcaggattgagctgtacttggttcccagtgtctgtagactattcatttcgcctcttcaagcaacgaatgcaaactactgaccataatgtgaaagggagaatattgaaactgtgtcatttaccatgaaaacttagtgttattgcgtagagaaggctttaggtttcaaaaatatttaccacatggcttttcaacaacggttagaatttatccagatgaagacatccaggcctgaaagggtgaagttcgaaaagagaaaaaaaataggtgtgagctgagagtggaaaaaaaaaaaagaacaaaaaaggttaagttcaagaaaacatagctggttagtaattaaaataaaaactccacatgcagggttgatactagcatacacagacttatttctgaagtgcatttccattgcagtgtaaaccactacatttcaacagtataggtagctgcattactctcattgaccc

SEQ ID NO: 8116 - DNA, 1085 bp, Homo sapiens
acatctatatatatctctcagcacctatcacagtattaaacacatgtgaggtgaaaaaaggggttgaaaatgctttctcatataaccacttgggaaaagtctttggcatgacaccaagagtgagattcataaaaaaaaaaatgcttttaacttcatcaaaattaaaatcttttgctctgcaaaagatcctgttaagaagatgaaggcagtcaggcaccatggctcacgcctgtaatcccagcactttgggaggctgaggcaggcagatcacgaggtcaggagatcgagaccatcctggctaacacggtgaaactccgtctgtactaaaaatacaaaaattagccagacgtggtggcgggcgcctgtaatcccagccactcgggaggctgaggcaggagaatggcatgaacccaggaggcagagcttgcagtgagccaagatcgcgccactgcactccagcctgggcaacagagcgagactgtgtctcaaaaaaaaaaaaaaaaaaaggaagatgaaggctgggcatggtggctcagcactttgggaggccaaggcaggcagatcacgaggtcagaagttcgagacaagcctagccatctctactaaaaaattagctgagcatggtggcacgtgcctgtagtcccagctattcgggaggctgaggcaggagaattgcttgaacccggcaggcagaggttgcagtgagccgagactgtgccattgcactccagcctgggcaacaggcgacagagtgagactccatctcaaaaaaaaaaaagaagaagatgaaaagacaagccaaaaatatttacaaatgacaacaaatgtatccagaatgtgtatccagaatttgtaaagaactttctagccaggcgtggtggctcacgcctgtaatcccagcaccttgggaggccaaggtgggtggatcacttgaggtcaggagttcaagaccagcctggccagcatggtgaaaccccgtctctactaaaaatacaaaaaaattagcagggcctggtggcatgctcctgtaatcccagctactagggaggctgaggcatgagaatcgcttgaacccaggaggcgga

SEQ ID NO: 8117 - DNA, 1028 bp, Homo sapiens
cactccagcctggtgacagagccagactgtgtttcaaaaaaaaaaaagtctgggctggatgcgtgcctcacacctgtaatcccacactttgggaagccaagatgggggtattgcttgaagctcaagagtttgagaccagcctgggttacatagcaagacctcgtttatactgggaaaaaaaaaattttgaagtagccaggcatggtggcacatgcgtgtgtgtggtcccagctagttgcgaagctgaggttggaggatcacttgagcctgggagattgaggctacagtgagctatgatcgcgccattgcactccagtttgtgtttatggctacatgatagtttcagaattggctcctgagagtcattaaaaagacacattgacaagctggtctagatggctcacgcttgtaatcccagcactttgggagtctgagacaggcagattgtttgagcccagcctatgcaatacggtgaaactctgtctcctacaaaaaatacaaaaatgagtctggtggtggtgcgtgtctattttcccagctattcataaggctgaggtgggaggatcgcttgagcccaggtggtcaaggctgcagtgagtccagatttggccactgaactccagcctgggcaacacagcaagaccctgtcttcaaaaaaaaaaaaaaaagtggggctgggtgtcgggccaggtgttctggctcacgcctctaatcccagcactgtgggaggctgaggcaggaggatcatctgagattaggagttcaagaccagcctggccaacatggcaaaaccctgtctctactaaaaatacaaaatttagctgggcctggtagcacgcacgtgtaattgcagctactcggtaggctgaggcaggagaattgcttgaacctgggaggcataggctgcagtgagcagagatcgcaccactgtactccagcctgggcaacagagcaagattccgactcaaaaaataaataaatgtatacatacatacatgcatatgatacatacgtacaaaaattagctg

SEQ ID NO: 8118 - DNA, 1024 bp, Homo sapiens
gtagctggaaatatagacatgtgccaccacacctggctaatttttgtattttttgtagagacggggtctcactatgttgcccagtgtggtcttgaactcctgggctcaggtgatccacctgccttggcctcccaaagtgctaggattataggcatgagcccctgcacctggccttgagtttaaatttctttagatagacatctgctctctctggtttaccactggtcttcaacattccctattgacttcacatacctaacttatgtattcatttatgttactggcctgggccttgtgggcacttgaatttgtgaacctttttctagaattctggtgagtttttactgtaattgccaggaacacaaaccagattgcagtgagttgaggagtgaggaagtggagccatggaaaagcttagcaaagaagcgaaggagagtaatagccagagcagcactggaaatacaggatatatgagctgcaaccccttctctgtgttgctcagttcaggtctgtggcacatttcccaatgacctttccttttagctagttatccagtctgcaggaaattagaaatagtcccttaaaaaggtggattgcggccaggcgttgtggctcacacctataattccagcactttgggaggccaaggcgggcggatcacctgaggtcgcgagttcaagaccagcctgaccaacatggagaaaccccatctctactcaaaatacaaaaattagcggtgggtgttgacgcctgcctgtaatcccagctactcaggaggctgaggcaggagaatcgcttgaacccgggaggcggagattgcagtgagccgagatggcaccattgcactccaacctgggcaagagagcaaaactccatctcaaaaaaaaaaaaaggtggattgcttgcggatgcagccttggtgagagccaaagaattaagatctggtatcaagaaaggagatagaacgccacaaaaagtagataaaaagacttggacacatagcatctggaatcatatagtatgg

SEQ ID NO: 8119 - DNA, 1099 bp, Homo sapiens
cacaccagctaatttttgtatttttaatacagatgaggtttcaccgtgttggcgaggctaatctcaaactcttggcctcaagtgatctgcccacctcagcctcccaaagtgctgggattacaggcatgagccaccacacgtggctgacagtcatggcctattgggtaaatccaggtttctgctccctcttagggctgtgtggtgtgatgcactgtttctaggttatgtgattggtttgttgtattaaatgttgtgggtgattataacacaaggacaaacattttgtgtatcttaagtatagaaaacatatggtaaatatctctattaaagacaagaaatgcggctaggtgcggtggtggctcatgcctgtaatcccagcacttcgggaggcagggtgggagaatcgcttcaagcccgggaggtcgcagctgcaatgacccatgagtggctctgtactccagcttgggcaacggagcaggaccatgtctcaaaaaaaaaaaaaaagagagaggccgggcacagtggctcacacctgtaatcccagcactttggaaggcagagacgggcagatcatttgaagtcaggagttcaagaccagcctggccaacatcctgaaaccccatctctactaaaaatacaaaaattagctgggcgtggtggcaggtgcctgtaatcccagctactcgggaggctgaggcaggagaatcgcttgaacccgggaggcagagtttgcggtgagccaagatcgcactactgcacatcagcctggacggcagagcaagactcggtttcaaaaagaaaagaaaagtgattcttggccaggcatagtcgcttgctcctataatcccaacattttgtggggccaagatgggaggatcatttgaccccaggagttccaagacttgcctgggcagtatagcgagtcccgtctttacaaaggatagaaaaattagcagacatggttgtgcatacctgtggtcccagttacctggggaggctgaggcagagggattgtttgagtccaacacttcaagaccagcttagacaacgtgatgaaaccccatctctacgaaatacaaaaattaaccaggtgtggtgg

SEQ ID NO: 8120 - DNA, 1108 bp, Homo sapiens
taatttttttgtatttttggtagagacagggttttaccatcttggccaggctggtcttgaactgctgaccttgtgatccgcctgcctcagcctcccaaagtgctaggattacaggtgtgcgccaccgcacccgcacttttttctttttttttttttgagatggagtctccctctgttacccaggctagagtgcagtggcgcgatctcggttcactacaacttctgactcccaggtttgagtgatcctcctgcctcagcctcctgagtagctgggattacaggtgtctgccaccacacccagcttatttttgtattttttgtagagacagggttttgccatgttggccaagctggtctcgaactcctgacctcaggtgatctgcccgtctcggcctcccaaagtgctgggattacaggcgtgagccaccgcacccagttgatcccattttttttaaagcaaaaaatgaataacagaaaaacccacatgcacacatagtgttctaggaccatacacatcaaactcttagaaactgaccaaccccagctgggtgcggtggctcatgcctgtaatcccagcactttgggaggctgaagtgggcggattgcctgagttcgggagttcgagaccagtctgaccaagatgagaaaccccgtgtctactaaaaatacaaaattagccatgcgtggtgatgcatgcctgtaatcccagctacttgggaggctgaggcaggagaattgcttgaacccaggagaggcagagtttgcagtgagccaaggttgcgtcattgccctccagcctggacaacaagagcgaaactctgtctcaaaaaaaaaacagaaaaaagaaactgaccaccctctaggggctaggattgaagtgaggatttatcattctactttctacaattttttttaagtttgttactatatacctgtctttttatttatttatttattttgagatgaggtttcgttttgttgcccaggcttggggtggagcggtacgatcatatctcactacctcaaactcaagcagtcctcctgcctcagcttcccaagcagctaagattatagatgagagccacagtacccagcacctctgtgtttt

SEQ ID NO: 8121 - DNA, 1376 bp, Homo sapiens
tgcccacctcggcctcccaaagtgctgggattacaagtgtgagccaccgcgcccggccatcatgtgttcttaagaaagatttaagttcatttaaaatttagagatcaataattatccaaatatgtttctttctcatagagactccagtgtctcagggttactgtggttgatttagtggtatttactctttgatgtcttattgtattttgctttgtttgatattcagaccttattttgcttttatgagatgaaatttagaacatacacctcacattgatcactaaaaattcttctataagatgtgatatttgattttgttaatcctgccataactaattccatcttaaaagttaggctggccaggcatggtggctcatacctgtaatctcagcattttgggaggctgaggcgggcggatcacgaggtcaagagatggagaccatcctggcccacatggtgaaaccccatctctactaaaaatacaaaaattagctgggcatggtggtatgcacctgtatagtcccagctactcgggaagatgaggcaggagaatcacatgaatccaggaggtggaggttgcggtgagccgagatcgcaccactgcactacagcctggcgacagagcaagactccatctcaaaaaagttaggttattattattacttatttggtgtatgatattaagccttctattaaatttagtttccaaataattttttaaggactaatatatgatgtttccataccatttattatatattgttactaaattgagggtctatgtatttgaccttaggagtacaaagatgagacaaaattcatgccatcaggggactcagaattttgtaggaaagatatataagtaaacaactaactaacaataggatgtaatgaatgcaacagtggagataacacaaaagtgaatgatttaactcaggaatgggtttgaagaacaaataggaatttgccagacacagaaaaaaagaacttagtagcaaagaagagtatgtatggccaggtccggtggctcacgcttgtaatcccagcactttgggaggccgaggcgggcacatcacaaggtcaagagatcgagaccatcctggccaacatggtgaaaccccgtctctactaaaaatacaaaaaaaaaattagctgggcatggtggtacgcctgtagtctcagctactcaggaggctgaggcaggagaatcgcttgaacccaggaggcggaggtggcagtgagccgagatcccaccactgcattccagcctgggcggcagagtgagactccatctcgaaaagaagagtatgtatgatcaaaggaatgagccagtgtggcttatcaaagcacactgattgaaaaatcttaacttggaa

SEQ ID NO: 8122 - DNA, 1075 bp, Homo sapiens
ccaagacctcaccactgcactccagcctgggcgacacagcgagactctgtctcaaaaaagagagagagagatgtattaaatgacactgaaggaatataataagccagatcaagatagtggaaaactacatagcaaccaattctgtttcttcagcaaataaattaaaaaggaaagagatgaagaataaacctacagatgaaacctattgagaaaagtaacttaagggacatataaattaattacattgtgtgcacattatttggatttgatttgaaatatatatgtatttttaataatctcaaattgggctggggacattgggtcatgcctgtaatcctagcacgttgggagcccaaggcaggtggatctcctgagttcaggagttcgagactagcctggccaacatgccaaaactctatctctattaaaaatacaaaaattagccaggcgtggtggtgggcacctataatcccagctacttgggaagctgaggcaagagaatcacttgaacccggagggcagagaacttggcgaagtgagctgagatcatgccacttcactccagcctgggcaaaagagcgaacctctgtctcaaaaaacataataaccccaaactggaaacagtgtatataacctattagctgatgaatggataaacaaaatgtattttcatataatagagtattatttgacagtaaaaaggaatgaagtactgatacatggtctgacatgggtaaacattgaaaacatgatgctaaggaaaagaagccagtcacaaaaggccatccatatattatatgatttcatttatctgaaatgtgcagaacaagaaaatccacaggagcagaaagcagattagtggttgtcagaggcttggggaagaggctgaatggggagtgactaccaagaggtacaggtttctttttttcttgttggagatggagtctcgctctgtcacccaggctggagtgcagtggcgcaatctgggctcactgcaacctctgcctcccaggttcaagcagttctcctgcctcagcctcccaagtagctggtattacaggtgcgccccaccacg

SEQ ID NO: 8123 - DNA, 1027 bp, Homo sapiens
aattcgagtcagattagcaaccaaatggagattgtataaataagttatttaaatatgaagtacatttaataatattatagatttatgaataaaagttattaagtagggatttgttcattcagaacagtagtctaaggaaaattaagtgaatactttttaaaactaaaaccaaatgctatgttaatttggtgataaaaaatgtctcaaagcatttttgcatatttggcatttagaattaaatatgagcttaaaattttatttgcatgtaacattttttgctcaagttattttgccctacttgttacttcaattattcactgaagttttagaggtaagaatgaactcctttgtaacatatttaagttcagagttgatttaaagattccgaaatcacaggtaacattgtatacagtgttactactataatgtgagtcatcaggaaaaggtaactttttaaaaaggggtaaatcagaccttatagtttcttgggaggtaaatatacaaggaataggtgactttgatctgtttagattttcagtgactttgtcaagtgtctgtactgaaagttaggtgaattatacctagttggatatactgtactgttttatgaacacactagctcagagacatgaattaaagcataggaatagataggtaattctctgggtgaagcatattatacatgtgtctcagagattgatgtgatagagggaatgcagttttaagtcctcatgatttttttttttttttttttttaaatggagtcttcctctgttgcccaggctagagcacagtggcgcaatcttggctcactgcaacttccgccgtctgggttcaagcaattcttgaacccagcctcagcctcctgaatagctaggattacaggcatgcaccaccacgcccagctaattttgcatttttagtagagacggtgtttcaccatgttggccaggctattctcaaactcctgacctccggtgacccacccacctgggcctcccaaagtgctgggattacaggtgtgagc

SEQ ID NO: 8124 - DNA, 1028 bp, Homo sapiens
acacctgagtgtgaatttcagttttattacctaccatatttgtgtgtcccaaagaaagttatgacctctgtgagcttaattttttttcatctgtagaaaggggtactaatacctcatttgcagggctattgtgaggactaaatgaaaagcatgcatatgcacatgaatacctaattcaatgcctggcacatagtactttctcaacaaaaagttagatacccttgtctccctcatggcttaaaagtaattgatttaaccaagaaatctgtaggcttctaggtgaaaaggaaactgagtaaaattatgtccaggtaattattctgcaaaaaaagcaataggaagcatagcagccttcttgtaagaaattttatattgtaaatgttactatagagaggaaaatcacattgattatgattaaaagaaaaatatgaaattagactaagctgtaaaatgttaggatgctaaatgtggggtgagggggaatctaatatttaagaatatactttttcctggagatctattgtacatcatgatgactacagttaataatgtattatatacttgaaaattgctaaaagtagatcctaaatgttctcactacagtaaaataagtatgtgagctgatggatatgttgatttgcttgattttattagtttacagtatatacgtatcaaaacctatagatatacacaattttaatttgtctattatcccctaataaagctggaaaaaataagtaaattctcatattttccatcaaaaaaagagaatatacttttaacttctaaaattaagtatagaaagtagactaaaatactggataaaactgcctttgccttaaccactaggtggcagaaatgacaattacatttgtttatttcataaaacttcaggtgactgtgttctagaattacaatgaattgatgtttctcaaatatttatatatgttgttttatgattaaacatatagcttaaagtattaaatattgattaattttgctctcatttttcagtgctaatgaaggca

SEQ ID NO: 8125 - DNA, 1065 bp, Homo sapiens
tcttttgaagtcagtcaggatcttcaaacaccaatttgctggttgtgatgcccaattttccaaacagatcaggagcactttgttgaatgtatattgaattctgggtggttcttcttcaacacccaccttggcctatcctcctcttgggagagagaaatctggatttttttaagcctcccctttgctccagtctagtaaacctctttgggcaacagaagccttactggaaagctgcttagctattattagatggtgctgagggaagaaagtaccttactcttatgtaatttccttgccctgaggagtagtatatcctggtcaatgaaatcagcttgactattttttattttttatttttttgcatcccagcctaatttctttttattccatcttgaattctcacccaagcctgattcatcttgcctgcttgcttgatttttctctttctctttctttctctctctctctttcttttcttgagatggaatctcactgttgcccaagctggaatgcagtgccactatctcaggtcactgcagcctctgcctcccaggttcaagtgattctcctgcctcaacctcccgagtagctgggcttacaggcgtgcaccaccacacccagctaaatttttttgtattttagtagaaatggggatttgccacattggccaggctggtcttgaactgctggcctcaagcaatacatctgcctcggcctctctaagtgctgggattacagatgtgagccaccgcacccaggcttttcatttcctttttatttatgtttcactccatcttcatttggtctctttgcagaggtggaagtccccaatgttttttatatgatttctcatgctctcacaagccaacagcattacatgcattaacatatgtgtattcagttactcacatgtgcctatacacagtacgccaatctcatagagtaactacctcatgctcactcatctacacacattatcttatctatcaagcctcctgggctgaggtctaggctaggggctgtgaggcccaggggtctccaaacttgggtaagcatacttactaa

SEQ ID NO: 8126 - DNA, 1047 bp, Homo sapiens
cttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaacggaatcacctcttaattctccctgtcaccaaaaacacccatccagctgaacagccaatgtcccattatcccaaattgcaaagtggacttcaggatcccagggccctctgaaagaaaggacactggagggtgggggcaggtaggtaagctctcgcttttttttttttttttaacagggtctcaccctgtca

SEQ ID NO: 8127 - DNA, 1034 bp, Homo sapiens
taacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatct

SEQ ID NO: 8128 - DNA, 1051 bp, Homo sapiens
tggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagt

SEQ ID NO: 8129 - DNA, 1037 bp, Homo sapiens
ccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttgg

SEQ ID NO: 8130 - DNA, 1024 bp, Homo sapiens
gtgtgtggggggtgggtgtgggtgtgtgtgcgcgtgcatgcgtgcccagggcgattctcctaaaataggttcctgcgcacgcctctgacagggcctgtgtgccaattctcctggcaacttctggatagctgtggattccaccgtcacatcttgggcatttcccacccagatctacagaagggctcagggatgggtcccctgggcctaaggccccagctgctgtggtgtgtccgctagtctctctgcacctgcagccacatggccaagagattggccgacactagttccctctccagccatctctaccccagcgctatggccatcccatcataggtgccctgagccctgtagacagaaattggaagcctgcatcctatcaaagctttcctaatagctcatcttcattactttaggaagaaaagatgattggctgttctggtgtgtccttatcatgagacactttgatgtatgttcatgctgctcttgaacccaggtgtgctgtgggagttcagtatggtaggaagggtgggagttgagacttccttgtccactgacagaggtgcgggtccaagcctgacattcgcagggtgcttcagtgaaccaggagaggtgtgttacctctgtcaagccctcgggttcatttgtgatagagccaagaccagaacccaagtctctgcctttgctcctgtgtcccacatctaccagtatggacctgcttcctccagagtgggcgcatattgggacatgcggaacagaccacggtcttctgtgctgctgtaccaaaggcgtgtaccccattagtgagcagatcccccagcacccagaccctgttccctccccacatccccttcttcccagggcttggcagcccaaggggcagcagagttaggggaacagcaatagctcggggtgcagagtctgtgctaagagtctaggctttggagccagactgcctggattcacatgctgcctgacacagagtgttctttaaagccctgtgcctctgtctccccatttgtaagat

SEQ ID NO: 8131 - DNA, 1050 bp, Homo sapiens
tttgcaagcccagacctgtcatgtggggcggtggggacctagttgaagacctgggagatgagctggggttctaagtccttgaggtcttcccgcgactgtgcagtggtacctggcggttttcccctcctctccgttgttttcacagcagccatcacagagccttctctacctcccagtgctgagcccacctggaggcacccgagagcctcctcccaccaacgtgccttctagatccttgggcggccacttgccgcggtggatggtgacggggcctccagtgctgcccggggagaagccttgagctctccagacaggaaatggagaactgggccatgagcagaaaagagaatcagtaccaaatcacttttgggggcaaagaagtgtcagggaagaagggatgaggaggaagacaggaccgtgtgaagaggaccttctcggaagggaccaaaggcagttagtggagtcccaagacctggggtgctcagaggactttgcatgaatgaacaaataagatgaatgaggctttatcacgtggccatgatcgtcaagcatcagctgaggatgcagtgcccacttaccgcgactgaaacgtgaacacacttaaagggcagctgtgagtggcaccaatgcgaaggtaccgctgacccgcgatggggaaaaggcaaccgttgaccgttagagactgtctgtgaggcacttagcttgaaagctgagaaggcagccaagctccaggcaaaccagtcatcctaatgggtttcaaagaccataaatggtctctctgtatggccggagctcccttggcctttcctgcaagatgaattttcacacactggacatatcactatgtctatttcattttccatcagacatttgttagtgtggctcacagtttattggtcccacttctcgggaagtgtgctggtcgtttctgccttagaacagacgcaggctcctcgaggctggagctgggccaggcatttgctgggtccccaggccatctggctccatgctccgcttcttgtgcctctccttccatccttgtcctggccc

SEQ ID NO: 8132 - DNA, 1044 bp, Homo sapiens
tgctcatcagagcccctctgtgctctcattggtctaaagagagatgtgcatggaaggtgattctgagtcagtaaacaccaggtggcaggccacatgcttcacatacatcattcttttgggatatcatggaacaacaccatgcagtagaagggagtttaaccaatttgtggctgaagtaataggctaagaggctaagtaattgccttagagtccaagagctaagatctctcccctcaacagaggtcatgcagggaggctgagaatgggcccatcccaggtgggaagggtagaagtccaagttggcaatgctgtaggttgaggcgagatgcaggctgggtgagatggctgtagagctccctggaacatctgtggggaaggttgtctctgcatccctccttccagctaatgggaattcatgttgttcattgatccattgaacttagggacaagaaacagctgagagggtctgaggaaggtgatgtgtacctaggactgaggacaaacctgttccagagaacaggagtcaaacccaaagtgagacttgaatagctttaaggaaagcatttgtgatcaaccagtgggcctagggccagaccagaagaggactctttttctccattgatatacagggacacatagagcaggaagattcatagctttggtagctttgccacccagcaagccataccagggcatgcagccgccattgttactttgtctttggaaacccctctacccttgacataagcaaaagtgcataaggcgcctcctctttaggacattcatttgcctcaaatactgcattggcttccctctccagcaggcataatttctggcagcgtggtgacatcagggtcctggtcactctgatttgtgtgttgagcaaagctgcatccaacttcctaggattgtttcttcttaggactgcaggccaggggaagaagtggggagatgagtcaacaaaatttttcctgcctcacctttcttctctgagtctttgcttacttcctggcaccgggcatgatacattgggagttcttatac

SEQ ID NO: 8133 - DNA, 1048 bp, Homo sapiens
ctcccattttgtagtctgaggaaactagcattcgaataggttatgactcatcccctgtcacataacagtaactggcagagccagatgtaccagtcaggactctcctggtgacaagaaatagacccatctcaatctggcttaagaaaaaaggggaaacttattggttcacataactgaaaaccaagagtaatggtttcaggcatagctggatctaggggaccaaatctgtgtctcttaagccctcagctttgctgtcttttctgttgacttaattctctgataggcttcccccaggtggtaacagagatacataaagatgcttcctagcagcttggggcttggcatttatgagttagcagctgtagagagagaacacatctcttcctggtagttccagcagtagtcccaggctgattcccactggaccaatgtgggttgcatgcccatggctggactgtacttaatgatcagccccagagtttgggatgggatcaaccccactgaaatcccatggactgagaatgaaggagggattgtttcccaaaagaaaatcgggcactgtaataattaaaagctggcagacaaaacctaccaatgtctaccatgctagacttcaagccagaggcagcatcttggctctaaagagagattcatgggagccagaactcagggcatggtgtcagtatgcctcaggctgctgaccttcgctatggggattgtgtctttccggaacctgcatgtgcccactgcttccagcctcagcatctaggcctcactcctgccttcccccagcccaagtaaatggcaacaaagccagatgttgcaagtgaagaaggaaggattgggtgtcagggtgtgatctgagccaggtacaaggctgtagactctggggatgtcatctcagctgcaccagaagctggaggcagcccagcaggggaagaggtgacctgcagtccccaggctgcagagggtcagaggtgacatgtgagtttcaggggcagcacttaaaaagacaagcaggggccaggtgcggtggctcatgcctgta

SEQ ID NO: 8134 - DNA, 1077 bp, Homo sapiens
tgtgctcgtggtggctttgccgcaggacacagatgtgggatttcctttgccctccccactctgtgctgagtcagctcttcccactgcagcccaggccgcagcccaggcacagcctcacttcctgcagttctttcccggcctgtggtaacttgcaaagcagcaaggagcttgtttctaaagagcagatgacccagatggctgatctgggatgaaaggtggggatccggcctctgatcacatggcagtgtcactgtcactaccttccagactccgagctgcagaccctccaggtcttgcagggagtaacaagctttgcaggggtcagccacgcaaggggcttttttacttttgaaatgtagatcagtctcccaagcccttcccccgcgacatccccacattccaagaccaggaaaagagccaggccaccttgttacaacttggtatgtgccttcccaatcattctagaagggaatcagctcctgaacacctacccccaaccctccgtcctggatggattgtatcctaggtatcttccccaggaactttctgatctgggccgaaaagcctgtctcttctcatggtctcagtcagtctgtgtcatctaagacgcagaaaatgcacccgggcctgggtctccagagtcctggattctagtgcaccccatgctaatcaccatggcacaaaattgaagaagttaagtttgagcaatcagggatcaccttgcttgttggcaaagtcaccagaaagtgacaggcatgatttcagggctcggtgacactcctgtcctttaccctccactccctccccctggaaatacatcctttccttacctgatgcctaaatgtccttttacaaggttggatcctttccctccatgctgagagagtacagttataccctggtgtccccagggttggtgcttccagccaactcatactccagcgtagatggcagactggatggttactgagaccagggttgatagaggtgagagggcaagtgggcagctgaggctagagacagaagaaggtgctaggcctcaaaggcctgtgtggagtctggagaaggggctggcgg

SEQ ID NO: 8135 - DNA, 1022 bp, Homo sapiens
tgctctgccaagctgacttgggaccagagggtggtggcaggattggaaggaggaaggtacaaaggtccaaccgcatgctctcaggtactctggagaatgtcccagtggtgacatgcccagaactctgtgattgcaaagtgggctcttgccaggcccagcacttattggtgccccagaatcttctaggggaagagactaaaattcataagtgcaaaagactgtgctaggcactttgcaggggaagggaagtcacatttattaagcgcctacagtgtccaaggcactgtggttgttcttgcgttctcattaatcttcactgtgaggcaggtattcttaacactattttatgtgtttattttatggggtatggaggctcagagagaataataacttttcatgaaattgatccgattgattttaaactatgcaaaatagagtgctgatccccgcaaggatccctagccacctgcctcatgggcggcctcagtattgacagatagatcattgtctctgtcaccaactgacagagctaattgagccaccaaggcaaatcttgtggcagggactctgtcttgctccaggcagtctgctgtcgttattaaagaagacaaagagttcaggatatagagtgaatggctgcatttgaatctgagcttcattacttgttacaaatatgatgacctcgggtagaccagttacctctctgggccctagtctcttcacttatgaactggagacgataacaacacttttctcataggactattgtaaagagtaagtgagataattcaaacaaagtgcttagcaatgcctggaacatagtcagtactcaatacattggcatggccattagtgtttcttttactcctgatcaatcaatcccattgtgcgtgtaagaaggtttggcggagctgactctttggactgtttttcttctcgttctgggggctgtaaggacagagctgtgactgcctaacttttgaaaggtccatgtaggattgtgaatcctgggagttcctagt

SEQ ID NO: 8136 - DNA, 1118 bp, Homo sapiens
ttcctctgtttttaataaaatacggataaatatctttgtacacaaatctttttccacatatttgattatttccttaggataaattgccaaaagtagatttcggtcaatgggtatatgtctgtttccttattttgttcttttcaaaatagaaaagactttactattttgtcaattaaaagatagtgtattactggctgggtggggtggctcacacctataatcccaggctgaggtgggaggatttcttgagcccaggaatttgagaccagactgggcaacatggcgagatcacatctaccaaaaattaaaaacagaaaaattagctgggcatggtggcactcacctgtggtctcagctactggggaggctgaggcaggaggatcacttgggcccaagaggatgaggctgcagtgagccatgtttgtgccactgcacgtcagcctgggcaacagagctagaacttgtctcgaagaaaaaataaaaatgaaagatagtatatttttgttgtaaataattcaaataatacagaaattataaactaggaagctgtctatagttctgtcctccttccttcccccctactcatagttaccctcgacctaaccactgttaaaagttaagcctgtgatgatggatatgtttatgtaataggcagtggtgatgtacagttatcacccagctcatctagttatatacattaagtatgagcagcttattgtatgtcaatcataattcaataagtggtttttaaaaagtcactagcaaagcaaagataaagttctgacaccattaagaaatagaaataggctgggcacgggggctcacacctgtaatcccagcaatttgagaggctgaggtgggtggatcacctcaggtcaggagtttgagatgagcatggccaacatggcaataccccgtctctaacaaaaatacaaaaattagccgggtgtggtgtcatgcatctgtaatcccagctactcgggaggctgaggcaggagaatcgcttgaacctgggaggcggaggttgcagtgacctgagatcgtgccactgcacttcacctgggcgacagagctagaccctgtctcaaaaaaaaaaaaaaagaaatagaaatattatc

SEQ ID NO: 8137 - DNA, 1047 bp, Homo sapiens
gacacattgtagaagatgtacagtaaatgaacactgcatacaacagcaaaaaaaaaaaaatgtgaaagtagttttaaaaataatattgaactaaaatcccaaataacaataatataagttggggggggcagagcagggtatatagaataaagtgttccaaggatctcatataacccaggaggagaataaagcttaaagtaacttttgatgttgataaattaggtacacatgttacaacttctaaggtaaccactaaaagaataggaacagtagatgaaatttccaaactagagaaagtgaaatgtaaaaaaaaagtttaacccaaaacaaggtaaaaaagagaaagaaaatgaaatgcaaaacaattgagataaacaaaaagcataaattaaaatctatgtttaaacccaaatataaaaagatggaaaaagatatgtaaacattaaccaaaagaaaaccagtggaaatatattaacattagacaaattaggctttaaggtaaaaatcattactaaagataaatgggcttatttcagaataataaaatattaaatttaccaggaatatatgaatacttaaaatatgtatgtacctaatagcatagccttagagatttaaaacaaagcatgacagagtgacaaggagaaacaaagcattgatattaatggaacattttaatacacttctttcattacatgatagaataaacaatgtattctcaacatagcagccaaggtgagcaaagcatttttctctactaggcaaagccctccagtgatttcctgtcattctgagaaaaagccaaaatccttactatgtttttaaaggcccttcatgacgtggactccaatccccacctctggccttatctgctactactgtgaactcttgtccatcctgctccagccacactggccatcatgctgtttccttgaatctgccagacatgcttctccctcagagtctttgtactggcttttccctctgtctggaatgctcttcccacagaatctacatgggtagtttcctcatttcctttgggtcttt

SEQ ID NO: 8138 - DNA, 1009 bp, Homo sapiens
tatgacatgcctgggatagtccaagattcccctgtctgcttgttctcattcagaccagttgtattaaatatttcaacttctgttataaagaaaggtcaatatatactattccacctgtcatcctaaattatgcacaaaatattcaaatatcttactcatttaacttcattgcttccagccgttcaaaccagggccagatgaggtaatcaatcatagagatagaattgccaccaaagaaggtcgtcttcttattagtcagaacctgaacattaaacagcataaaagtatttcttacttgtgcatgtagtaagactcactagaaatgctgaagggaaataagtagagcaggtgagagaagcagtttttactccgatgtatccaagttgggtttttttctgatcaaaaagcttaattaagctttagaatctgttggtctgggatgaagtaaaacaatcaacaacataaactggaaaattgaaaaataaaacaagtcacagagtacaacatatttgtaatacaaaggactggtattcagaatatagaaaggattcctgggaatcagtaagaaaaatagcaaacgacccattggaaaaatgagcaagacttgatcttcaagaaagatgatgtccaaatggccaattatcatttggaaaggtgttcaactgcattagtcattagggaaatgcaaattaaaaccaaaatgcaataacactatacacccaagagaatgcctacaatgaacaaaatgaagttggcaagggtatggaaccactgtcgtagaggtgtaaattggtacaaccatgttttaagagtatgcatactcatcacccagcaattgtacttggcaatgtaacacatgttcaccaaaagatatgttatgtgaatgttcactgcagcactatttgtaatagcccaaatgtgaaaacgtttactatcaagagtagaatgggtaaagtgtaatatactatactttggaacactgtataaagaacaggaaagaactacacac

SEQ ID NO: 8139 - DNA, 1030 bp, Homo sapiens
gtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgcaaggagtagaaatggtcactgtttgtttttaacttcaggaaatctgtgaggctcccagggcagagttggggacaggggggtggatttcctattgacaaagcagaagctttcactccctttttattcttacactttcaggagactttaaaaaataacaaaacagaacatttctaccctgtctttgaggcaacttgtgtgctgcccgcagggctccagaaagggcctttgaaagctggctgtagggtggattccagcctaagaccttatttcacagagctaatgtcagcgagaaatataggagctggaactaacaggaagcttttgggttttaaagaaagagattgtattttaaatagaggattttgagtcctctaggggactttggcctttccactaaggacaaccctgccctc

SEQ ID NO: 8140 - DNA, 1058 bp, Homo sapiens
agtttaacataagaaagaattacttggtttgggtttggagttgaatgcaattgggcccttgtttgcagaggtagaaattgggaaaagcgagccccaggtttgaggatatgactcccaagagacagagactgatagagttttataatgccaggtatataaagaacagggctttatcttaatcaattcctttctctaagaactaaacctagatactgagttgtgtgtttctgtgtgtataagaaataatacatttgctgaatttataatgatggccccttgtaagtaagatttgtgttcaagaaactcattttatgaataattttttttctggggatggatctctttcataaagtggttatccactgatgatttaagaatcaacagtgctgatctcattcttttctagtctttcatcctctagtggtgtgttttttacttctttgtgtgtcctagccatgctctttgaagttttagtgataacattcaggacagggaaaggtcagtggtcaagcaattgaggatttagaaagcgggaactggatgttaaagccaatcaggaaagtctccgtgcacacggtgacaagaaagccatccagggcacgctgaaagggggacaggcataaatagggaatgaacataaactcagcttaaattgtcttgtttgaaatatatccattacctggcctattggtgacatgaacctctcctacattactgggttagggttatttactgtaaaattatagtaaagttagacacagaactctgactttctctgtctgtcttggaagaagtttgggtgagcagagaacacgttttaccattgcatttgcaaattgaattaacttatctccccatttcttgtcctcttgctttttatcacttataagtggttgagtgagaaagagaaatgttattttgctttccataagtgtttgaattagctatcgatggttatgtgctaattatatgataagagatagttttcctctgtcctcataagttgctgccttctgcaaagccaagtttctgtgcctccagaatacatgacacctcat

SEQ ID NO: 8141 - DNA, 1039 bp, Homo sapiens
gttcctctaggtcaaaaaagactgggacccagtaggatcagtacagttggcctcggaatgctctggcacctgtgtcatccagtgcctacataacacccaaggttggcttcatcctctgccattcctacttctcagcattctctagtgcctggcttccaggctggaggaatgatggctgtgtcagcaggctggtagctacattaagggatacccttatgggaaccaagagttaaagggcccatggggagccttacgaccacagagccccagattcttctgttggtgaaacatttcctttccaaaatggaacactggacaagattttatctagagtaggggctagactgtggccttacatctgtagaagatagagtgatttgaggggaatttgttcccagatagagttaggtggagctgactggtcctctcaaatttgcaaaaggaagcaggggacggaggggagttctggtggagtgcagggaggctgtcagtgtagaccgaattagctacgaatgtgaaaccggagatcacatagcgtgtgcttgaaacctggtactcctgcttactagctgggtgatcttggccatgatgtttcacctccctgtgcctccattctcatatttaacctggacttaataatcaatgtggttatgaagatcaaatgatatatgtgaggcagttaaaacagcatctgctgtacctaagcactttgcaagtgttggatattattgttaattcggcctctcacttaccagttgtgactttggacaagtcattttccctctctaagccttgttttttttctgcactgaaactctgaggtctccaagaccctttactactgcagcaaacccactgttttcaagctttgatggctatgcaatctgaacatgatgcattgtgtttttgttgtaggctatgtggaacccataacttggctcaggaaagtaaagacttattgtttgagctccgttctctcattctttttggtttttaggatttcagaaggtcacttgtatgaagaaagccaggacttttg

SEQ ID NO: 8142 - DNA, 1068 bp, Homo sapiens
cttcagggaaatgcacattaaaaccataatgagataccacttcacttcagttagaatggacgttatcaaaaagacaaaagaaaacaagtgttggtgaggatatggagaaaagctaactgcttacacaccgttggtgggaatagaaattggtacagccattgtggaaaacagtatggaggttcctcaaaaaataaaaaatagaaataccatatgatctaccatatgattccaatactgggtatatgtccaaaggaaatgaaatcagtatgttgaagcgatactagccctcccatgtttattgcagcacttttcaaaaatagccaaggtatggaatcaacctaagtgtccaacaatgaatgaatggataaagaaaatgtgttatacatacataatggaataccattcacccataaaaaagaataaaatgtgatcatttgtaacatcatggatgaacctggagaacctgaaataagccagacacagaaagacaaataccatatatctcacttatacatggaacctaaaaaaagttgctatcacagaagcagagagtagaacagtgcttactagagactggggagaagagtaaggggagaggttgtttaatgggaacaaagttacaattaggagaaataaattctggtgttctattgcatagtagggtgactataatttacagtaaaatattgtttattacaaaataggtagaagagagtgttttaaatgttcttaccacaaatgaatgatgaatacatgaggtaatgaatataccaactaccctgattggatcattatacaacatagatatgtattgaaacatcaaatcataccccacaaatgtgtacaattacagtatgtcaattaaaaatattaaaaatgaaaaaaatgactgccaaatacattcttaatatattattaaagaagtatatagtagtggaataaagtcatttgacttcaagtcaagaaattggatcctgatatataacttgtcacctactagtgggcctttttctaaaacactgtagactttaagtcttccaatctgtaaaataagtgttttatactaga

SEQ ID NO: 8143 - DNA, 1062 bp, Homo sapiens
gagttgctgcacacaccagcttcccagaaatgtccacatgtaaagctctggttgctgatgatgtgtggccctgcaggtacagccttctcagtattgcattagggctaggctctgaatctggtcacgtgattttcagtgataacttaaaaaatgtctccattgtttgcacagattaaagatgctgttgctctctgtgaactctttaactggctggagaaagaggttggttcttagtctttgtttaatatgtggatatacattattcagacctacctatatgtgattctaactctagcatctcccatgctctgctgaccatgagatctgagatcttcatcaaatttttgggctctattttaataattctctctggaaatttggtgtgtgtagatttcaaaattccttaattatgaaaatagtaacaagaatgaagaaaagttccataatagagtggatgctttttgggttagggaatcataactaagtggaatttcattataaggaaaaatgagtcttataatattattataggcaagctgattgtattaggagaaaaagatctttgtgtacattttgaacttcagtttaagccttgagcctttttatattaaattgactcttggccattaatttcttgctctagttgacaagagggtggtttctctgtggtgttattaaacaatatcatgttccctttaagtattgtataaacaactctttaattgggaaaagaaaatattgtctttattcccactagtgtaactttttccctcatgtttccttctggtgattgttcatctatgtaaattattattattattttattttattttattttttgagacggagtctcactctgtcacccaggctggagtgcagtggtgtgatctcggctcactgcaacctctgctgcccaggttcaagagattctcctgccttagcctcccaagtagctgggattataggcgcctgccactgcgcctggctaattttcgtagttgtagtagagatggggtttcaccatcttggccaggctggtcttgaactcctgaccttgtgatc

SEQ ID NO: 8144 - DNA, 1055 bp, Homo sapiens
tctaaagtatttgggcacataagtgggcaccagtctgcttgtgggacagatacaggtgttacgagaggggcctgacctagacttggagatcagagcagactcttggggaaagtaatattttgaagcagagagtaaggataaatgtgggtgagttaggtgaatggcagggtgaggaggggcggggaaccatgatccaagcagagggaacagcattttcagagactctggacagtagagagcacagtgcatgtggaggacctgaagtggttcagtgaggtcagaacatagtgaggccagaatgtgagcaggggccacagaaaagagaggccttgtgggccacattcaggagcttgggttctttttctgaacaagaatagtgggaagctattgaacgaatttttcagagggaaccacatgttagatgtacaagttgtaaagaatattatgactgaaacatcggtagatggggaaagacttagaggctgtggcactaacccaagtgagagatggtgggacctgaacctgagtggtgactgggcgaggctgtagatgagctggacagattagatggagatttaggctgtgggtcccaaggtcttaatgaaggacgggaagagggtcatcagtgaaggaggacactgcccagatttctggcttggcagattgggtggatgggggcagggaatgcaccttggagggcaggatttgggaaaggagtggggaggagagaaaaggggcttggttttggttgccaggaaacagagcctgatgtgtatgtgtgtctgtgttgccacctctcactcatgttccctcctttttctgccacccacctctcctccatctgcaggctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatcccc

SEQ ID NO: 8145 - DNA, 1059 bp, Homo sapiens
agtattagtggcagcaaaggcaaagaaacagggaagcttcggatgctcttcagaaacagtgggacaggtttccctggcaagagaccagggaagtaaaaagcagtggtgggaaataaagctgttgttacaggattcttcagttgcaggtaatagaaactgccttgagataccttgagcaataaaaatgctttataaggattcaagggcagagccaccatattggcacaactccagattgtgaatggtgctctcagagttatgtgtgtcagggcctcagatagggtgtcttgtggaacatgagggcaggaatgtagcaggccctcaagaagaactgggacgggagggttttcaggtcttgctgcatatcagtttctctttttcagccaactggttgggtcatataaacctgacaacacctacatttatatcttttcctctcttactttcaagataccagattgaactagaaccttaatcccccaaattcaaagtccaggatgagaacttgattggtatatgtagcaacttggttctgcatggtcctggttactctgtgtgtgtgcacgtgtgcgtgtctgtgtctgtgtgtgtgtctgtgtgatgtcagacatgagtaatgggggtccaccagtccaccatgatggagggggtggtagataagggtatttctgtaagttgagcaaagatcacaaaacatgtccattctggctggctgacttcctgcctctccccagaggtcctggtctacatggttgcgacaaggtcaggcctgtattaacctgggaacaactcaacctcaagattggatctctgcctggagacatggatttcctggccttaggagcaaatgaagggcttgaaatgaataagcaaagggatcggatatttgaggcaacagtatgaagtttaggatactttgatgtttagaacagtgttccccaaactgtgtgtgttcttcagtattcctgttgtgtcttgtaagatgctctacaaaaaatatatttgttagttgagaaaatagtgaaatgagctgaacagtgtttttttattgtggtgaaa

SEQ ID NO: 8146 - DNA, 1131 bp, Homo sapiens
ggtgagccactgagcccggctaaccaacttccatttctttttgagacggagtcttgctctgtcacccaggctggagtgcagtggcgcgatctcggctcactgcaagctccgcctctcgggttcacgccattctcctgcctcagcctcccaagtagctggaactacaggtgcctgccaccacgcccagctaattttttttttttttttttttgcatttttagtagagacggggtttcaccgtgttagccaggatggtctcgatctcctgaccttgtgatcggcccgcctcagcctcccaaagtgctgggattacaggcgtgaagcaccgcacctggccccaacttccatttcttaaaagcattcctatttttatatttacatttcattttcctctgaaccagaaagctctttaagaacctgtcccctttgaaagactcttaatcttctaaggacattcaaacagggattgcatggagtctaggggctggaagtaaccaggggtcggggcttctcaaacttatgtgtttcaatgcctccttattcttgtgccaactctgtgattatttgctccttgtttttctcctttaattgacatgttttaataaatttagagagggaactttatatcattagtctgatactctgctttttagaccctctgcccctaggggcatagttctctcttagttttcaataattaacacgtatagggttgtcagtgtgctagctgatgaccactaaaaatactttttgtgtactaattcgtttaatcttcacaatcatcatagcaaccctttgaagcaggtaattatttttatcatcatagcttcacagaggaggaaacaaagatactgagaagttaggcagcacatccacagctagtataagtaaggactgagtttcaaaccctgcagcctagttccagagtctcaactcagaatactgctttactggattctggctgatatgtgagcctgtctgcaaagttttatacaggaagcactgattacctaaaattgcaaatttcttgaaggcagagaccatctttaatacttccatctctctcttagtgcctacttgtgtacctttgacataatacttgcttagaaatatgctcagtttgtgaaagag

SEQ ID NO: 8147 - DNA, 1685 bp, Homo sapiens
cgtttacaaaactaaaattttgacgtatcagaaggcaagtgttatgagtattagtaaatgtaatgatattttccacaacttagaagttacagtaaatggcttccagcatgggaccacttctgtacccattttttaacactaaacaaaggcaatatgtttttcttcttttaaacgttgaaaccagaatatattttaacattacttaaaatttgaaattttttattttttccaacactaatcaggaatgatttctgttttctttcccttaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctccagggtgtgttaacaaaagggtaaagtctttagctgtcagcacttaaagcaattaaacctccaagtacttgcacacggcattcatgcaagagaatactgagtgtgtgagaggtttcagtaaatgcttaagtattccttccattagaagaaattggatcttaaagggcaaa

SEQ ID NO: 8148 - DNA, 1054 bp, Homo sapiens
tggagcgggaataacaaaaaccagaagaagcttcacttgattataattaatttgcagtggttggtaaaggcaggcaccaagccagattcaccactttataaataataaatctgtgggggtgatgttgtgaaagatgcatggtaaggttgcatcagcaaggtgaatcactgagtgggtgggaccgtctagaaaagcatctgtgtttggaaagggatcattctacagcttagtccagaacaccttgaacacacagcatagcagaatcttgactgtaatacttggagcaaatgtcactggcaaaaatggcatatatgctgggatgttcataacaaatagttaaatattgttggtcctttcgcatatagaatctcggtattagaggaaaatagtaaactgaaactctatttctgttctgcaagagccaatttcacctattgtattacttcgttaccaattgcagctgtgtagtcagtcatccataggattctttttgttagacacaaagtagaaaccagctgttggccgttgagacaagtaggaatcttaggaaatgttagcctgccagttcctacttttcctaactacctgcctcaccacccccatcaaatggtggtcatgttttttgtcacccaccattcaggggagatgctatcaacgaaccacgctggctacacacaaataccttttcctcagatgatattaatcatctttgccttaaaaactgaagctctaccaagttttcactatgagagaaaaaaaattacaacacctagccttgtagttaacaccacaactgactaatggaagttgacaagatctaaatgcttatacaaactatcccaaggtcacaggaaattaatggcaatattatacaaggttagggtagttcactttctataggaatttggattttacttcttaaactacaatggaaatgtctcaggcagtctgctttgggaatgtattcttgaataatactgatttctcattgaaggaaaaaacactatatccaacaactcagatatggcagaagtgaagtcaatgttccgggaag

SEQ ID NO: 8149 - DNA, 1015 bp, Homo sapiens
gggaggccaacgggggcggatcacttgaggtcagaagttcgagaccagcctggccaacatggtgaaaccctgtctctactgaaaatacaaaaattagccgggcatggtggcatgcgcctgtaatcccagctactcgggagtctcaggcaggagaattgcttgaatccaggtggcggaggttgcagtgagccgagatcgtgccactgcaccccagcctgggcaacagagcaagactccatctcaaaaaaaaggaagaagaatagaattgtagcaataagtaaatttcagccatgtatatacgtgaactaattgagaaaataaagctgtcttcttattaacagatatatggccaataacttttatgttcaacaattgctttatcaatgtgtaattcattttgaccaattttgtgccagttgtaataactgaatccaaaatattttaaagtttaaatttataaacatttttgtagcaaagaagtatgataggatgatcattaaaataccaggcatgaggccaggcacggtggctcacctctgtaatcccagcactttgggaggccgaggtgggcggatcacgaggtcaggagatcaagaccatcctggctaacacagtgaaaccccatccctactagaaatacacaaaacaaattagccgggcttggtggcgggcgcctgtagtcccagctactcgggaggctgaggcaggagaatggcatgaacccgggaggcggagcttgcagtgagccaagatcgcgccactgctctccagcctgggcgacagagcaagactccgtctcaaaaaaaaaaaaaaaggcatgaaaatacgttacactagaataaagtgggttggaaatagaggtccaggaagaaaaaaagatgatataaaacttctaacttaaaaatgatcttctttttattaatggatgatggtagctatcaaattgctgttatgtttagattatattggatatgtttttaaaagactgaggtaacagttatttttaaatatgctg

SEQ ID NO: 8150 - DNA, 1026 bp, Homo sapiens
gggttaatcataaattaacctcttatgacggccgtgatatagaaatgtatatgttaggccaggtgtggtgactcatgcctgtaatcccaggactttgggagaccaaggcagatggatcacctgaggtcaggagttcaagatcagcctggccaacatggtgaaaccctatctctactaaaaatacaaaaattagccgggcatggtggtgtgtgcctgtaatcccagctgctccagaggctgaggcaggagaattgcttgaacccgggaggcagaggttgcagtaatctgagatcgtgccactgcactacagcctaggtgacagagcaagactccatctcaaaaaaaaaaaagaaagaaatatatatgttagaaaaagtctaaaaaggaaatttacaaagactacaagaagatagttccctggaaaagacagtgtgatggtgtgccaaaaacacctttcctgatcatacacatataagtaaacacccataccgagttccccctgactctagttaggagctgtctttaaccacattagtccctattcgggatcatcaaatttgggaaatacctgttcctagcttgttatgaacatttaaaaatcttatttttttccccttcaaactgtgcttataatagatagcaaagtggggaataaaagtctaactacaagcttattaatttgaagtaataggacttactgctttcagtaatgtcactgtcatccatcagactatttcacctcaatttcattttctccctcaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaat

SEQ ID NO: 8151 - DNA, 1050 bp, Homo sapiens
gaattccttatacattcctgtcacccaactttgcccacaattttttccatcttatatgacctccactctatctaaaattattaagactcgttccagtcttacctcttccataaagtctaacctacccccatagactcatctgaatgtgacatttaatcacatactactctatggtagctcatgaagtctcatatttttatttaattctgctatcttatatctgtaacttcataagattctaggacagagatcatgagttatctttatttctcctattatatctaatatagtgctatttaatagtagctatgtcaaattaagttatgatgacttttattcattcaacttcattattaaatgttcttcattattcatttgtagtttgtctgccatgtctctacagaatcagtgaatctcagtgttttcacctgagaagcttcatgagggcggagaatatactccctgatccctgggccacagtaagcactctaggaatatacacagatgaggacattagagagtgaatagcgagaagaaaacctcactctcagcctctggttcttagcatagggcctttttttccatgctaaaacaacctgtggcctttaaattatcagcaacttgaaatgctggaaaattggggttttgccatatcactctgacagttgatgaggaaaggcgatttttcaacattgagacaagagacttcatttttttctttttatttcttccaaacagatagaacagttgaaacaaaaagcagataagagagtcagaagtgtaagtacttcttttgcagtggtaatttttttttcttttgttaggctctgtacttccatacagtttttttaattgactgactagaaaccaattgttggcctttattaaatagtattccttaatacatttgttgaaatttgatgcagttaacttttgtttttatttaaataattgggactagaggttgggaggaatttagtccatttatattgccaacataggaaaataattatcctcaatacagctccttaatgtgaaacctatccttac

SEQ ID NO: 8152 - DNA, 1093 bp, Homo sapiens
tgtgagccactgtgcccggcccaaaaaccattcttatgacttattgcattcacgtaattcattcattcattcattgaaggcctactgtgggccaggtattatgctaggcccttggaatatgatgaggactcctgggccaaggctgtttatttttttattgttgtttgtttgtttgtttgtttgtgacagagcctggctctgttggcccaggctggagtgcaatggcacgatctcggcttattgcagcctccaccaaggctgtttctaacatactacactgtctctctgaaggcacagccagactttaagggaactcttggttttaaaataatctggttttgtttatactttattatcgtctactagcctgggaccaaattctttgaaaaattttccccaatgcctctaatttagaatcatattagaaataaactaagatcctataatataaaagcctatatatgtggaatcagtcatatctaggaaaatcaaataatagaataaagactgaatacattcattatttttaaggcaagtgaaatattgaggttgactgaaatgagtcactgttacttctcataaatagattaatcgtaaatttaaagttagttaaaaatagtgataaaagattttaatagcaaattataagtaagcactgattaaatggattatatcaatgttttattaaaccttgctctgaaaatagtacttatgacataaagtttgattaacatactagattcagatttgattatggatgggtgtaatcattgttacggagaggtaccgtggtgcagtagttaagaacaaggactttggagtcagacggatgacatggtaattgtggtacttaacctctgttatccttggtatctttgtctatggaatggagtaataaaagctatctcagagaattatgaatatgataatcttaaaggaaccaaggtcgcattattaaattttactatcatttaatttccagatgaaaataattctcagaaacaaaacttctattgagtcatggattgaagagaaggtaaattttaataattgtttcttcaatattaaaaaagtatattaataaaggactggt

SEQ ID NO: 8153 - DNA, 1054 bp, Homo sapiens
ataggttcatggtcaaaagtttaggaaacatcacatgtcatacacagtgaggtttggctgtagtaccttttttcatgtaatacattaacatcccttagaactgagaaaaacgctttagaaactgctggtttaaatcataaagttttaaaatcattgcactgaaaatataacattgggaagtatagtccaaatccatttatagcttaaaaactactgggaaatttatgcttatgaatgtccatgtttcctgctaagggaccacacctgatggcttgtcagaaaggcagaatcttgggctccacttcagacatactgaagcagaatctttattttaataaagtgcccaggtgatgcttaggtatattaaagttcgggaagcactggtgtatatcatgtgctatgtactattcaaaatgcgtacagaggagggtaagatgtaatttgaactctgaaagagcttataacctaagcaagaaacaaacgcacttgtgcaaatcactaaactataaagtagaacgtgatgggtgctgttaaagttagaagaattgagcattgttagttggggacctgagggaggagtgggaatttccaaaggagatggggaagagggcatttcaggttgaaagaatggtgggaccacgtattcagaaacagtagacagccctgtgtgactggggaaaagatcatgtagggcagagacagctgaaacaaaggcagattgtgacagtcttaaatacatgagaaattgtagaccatagaaagttgtaggggttttcaggcagagtctgacacagtcagaggtgtattataggaatattattttgacaatacacggtttgtgctgaagaaaaactacagtaaaggaaactagttaggaagtgattaaaatggcccaagaaaggggtggtgacgggtaatgtcaaggagggagcagatttcagtaggactatcaactcacgattaactcctcactctaaaatacctgctaagttgtcagctacctttttctgaactcctgaatccactaagatttggggtaagtagaaccaactag

SEQ ID NO: 8154 - DNA, 1035 bp, Homo sapiens
gaagaagagaagaaagaaagatataattatgaggaggaggtagaagtagaagaaaatgtcagtggatgtgaagaaacttctaaaatgattttttaaaaagtgattgatcaccgttccggtaaaaagctggaagatggccctaaattcttaaagtctggtgatgctgccattgttggtatggttcctggcaagcccatgtgtgtcgagagcttctcagactatccatctctgggtcccttcgtgatatgagatagacagttgctgtgggtgtcatcaaagcagtggacaagaaggctgctggagctggcaaagtcaccaagtcttcccagaaagctcagaaggctaaatgaatattatcttattcattattcaatgaataatacctgccaccctggtcttaatcagtggtggaagaatggtctcagaactgtttgtttcaattggccatttaagtttagtagtaaaagactggttaatgaatcataacaatgcatcgtaaaaccttcagaaggaaaggagaatgttgtggaccactttggttttcttttttgcgtgtggcagttttaagttattagttttaaaaatcagtactttttaatggaaacaacttgaccaaaaatctgtcacagaattttgagacccattaaaaaaatttaatgagaaaaaaaaagtgactggctttgaatttgataaaaactgcctcaacagatatttctactcaaatttctgaatgaattctatactgagttgattaaaataataaggtgagttgaaagacagtgtcaagaaccaaaagacagaaggcgataaagttgcagtactgtgcttttataccacaaaatctccatataatgagacgacttaggaaaactctattagtagttcagtcaagacttggaaacaaacaaatacattaaaaaggcacctcaaaatttaaatgcatttgttcagcttctttaaaaagttctaaacatgaagcacattttagctgatttttaaaaagagtaagcttgggtaagcatattaaaaaagaga

SEQ ID NO: 8155 - DNA, 1019 bp, Homo sapiens
tgcaataaatggagtcgcctgacttttttggtttcccagtgggtagaaaagttatgttcacactgtactccagtctgagtatacgcaacagcattatgtccaaaaaatacatatcttaattaaaacatactttattgctaaaaaatgctaacaatcatttgagccttcagtgggttgtaactgttgggctggtggaggatctggcctcagcactgatgcctgctgattaatctggtggtggctgccgaaaattagggtggctgtgacaatttcttaaaataagacagcaatgaagttcgctgcatcaaatgattcttccttttatgaacaatttctctgtagcataccattctgtttgatagcattttattcacagtacaacttcattcaaaattcaagtcaacagaaaggtgattgtcccctcgcctgtcacgcaatgcatgttcctggcgaacctggcactaaaccattcaaagatgacctgcttctgggttggggtttcgtatgtagcagagcagctccctcactgcgatctattgaaagtcagccctcaacgaaagtgttcgttaaaaaaaaaaaaaaaaaaaaaaaaggaaaaagtttaaaagaaaacaaacaaaaaaagagttaaaacacatacaaaattcatgtcaatcctctcaaactctgtggctgctttaccaactaagtttatgtaatattctaaatgtatatttcaaaaatgtatcagcacattcaccagcagtagattccatctcaagaaaccacttacttggcttattcataagaagaaactccttatctgttcaagttttatcataagattgcagcaattcagccacatcttcaggtctacttctaattctagttctcttgctatttccaccatgattggcacacctgcagttacttcctccattgaaggaagtcttgaacccatcaaagtcatccatgagggttggaatcaacttcttccaaactcctattaatgttcagacatcctcccataaatcgcaaat

SEQ ID NO: 8156 - DNA, 1058 bp, Homo sapiens
ggaggctgcagcgagctatgtttgtgtcactgcactccagcctgggtgacaaaatgagaccttatctctttaaaaacaaacaaaaaagctcaacttttgattaataaggaaagaaatagaaaagcaatgtttatatgtctttactccgaatgctacaatagaacaaaaatgagatagtttaagaaaccatctgaataaggagaattcttttctaatatagttaggttattaacctaatatttattttatgcttatctttatgattagttgacttttgcagattccattttttttaattctacaagtacacaactgatactatcattttgttttgcagaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggtatttgtgtttctcattcacacaccaaccagtaaacatggcaaaatgatgcctgtttcacagtctgatctagcaatcagctgggctgtttctgtaatgcaaggcagtcattttacccaaagatgaagtttcgtgattttctctttttaaaaagtatagttttttatattaggaaagatgaaaaatagcaaaaattaattttgtatttgacagacactaagatgtcattaaatttgcattggatgggctttgacatataattagttttgattgctaaaataattttttaagattatgacatttctgatttatttttcagctttattttattttttgcagttaatattttatttttgctgtgggtgggccttgaaaattagtagttagtttaaaaataattttaaaatcagtaatagtaagtaatcattttatgcattaaaaattgctgtagcttcagtagaaagtttgagtgttactttgaaatggacaggagtactttac

SEQ ID NO: 8157 - DNA, 1049 bp, Homo sapiens
tatgaaggtggtttcctgcaagggtttaacccaaattcctcctcacctgcccctgttgctgtctaccaggacataatttagtagttctgtaaaatcaaacaggacatctccggttgcttttttttttttttttttttaatttggagacagagtcttgctctgttacccaggctggagtgcagtggctccatcttggatcactgcaacctctgcctccctggctcaagcgattctcctgcctcagcctcccgactagctgggactacaggcttgcaccaccatgcccagctaattttttgtatttttagtagagacggggtttcaccatattggccaggctggtctcaaaagtcctgacctcaggtgatctgccttccttggccgcccaaagtgctgggattacaggtgtgagccactgcacccagcctacagctgcttttttgaagctgtctgctagaattgtaatgtgtgtgtgtatttacagtctatggagagttttttctaccactcttataagaggaatgagggttttatttagcaactaacatttaatgtagtataagcactttaggaggttattttgtgatcttcacattaatcccacgaattagtccctaggtacaattattagccctattttacacaccaggaaactgaagcatagagaggctcattaagctccccaaggccacacagccagtatatggtgcagccaagagtgagccaagatgtggaactaatatttaggcaatttgaatctggagtgtggtacctgtgggaagggcggaggtggctgcttcttgcaagatcaagaacccagggcaaggggaacttgactcttagggcacttccggttcagagggcgcataagttcaagtgagaggcactgcagtttccagcagccaccaggggccaaagaggcttggggcaggggggtggcccaggaggccttcgtttctcctgcccaggttccttgaagccccaaggaagggcttttgcctggtggtccagtgggcacctaatcagcctcgcgtgcctccccccggttg

SEQ ID NO: 8158 - DNA, 1031 bp, Homo sapiens
taagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggc

SEQ ID NO: 8159 - DNA, 1035 bp, Homo sapiens
aagttgtctttgctgtggaattaggacctgacatgaaacgcagatctagtggcagagaggaagatgatgaggaacttctgagacgtcggcagcttcaagaagagcaattaatgaaggtttgtccttaaactaccttgctgctgtcttcaatgctagttacataagatctatattttttgaatgactactatgtataaaccatctagataggcaagaggtggtcccagtcttcaaggggcttgaaatctggcaggcaaggcaagacaggtgtctgttaatagtaactagaatatggcagaatacctgctgggctctagaggagatggcattggtgctggaggtcagaggggtgtggaaggtttgggttgttgtgggaaggaaagagagaccacatgggggcatgtgtgcagtgcatgtgttgaaaggctgctggagggccaggcagagcaaggtggtatccacccaggtagtgccacaccttccttccctcatgcagttctgctgaaggaatgactgtgggattgaacatttctccaagtcttttcccaggatgtgggccaggagaaaaggaatgaaaggaatggccaccatgaaggggtcctcttcataccctccttcctgtagcaagggcctgcagcagcccagaaggacagtctgttatcagtcaagaggctgctgaatcctttcaaatgatgttttctaagcatataggaaatgcacgtgatattagtcaaaggatacaaagttgcatttatagtatgatctcagttttatatgtgtgtatacaaaaatactagatagatataaatcaaaagatagtgttatttctgagtgacatattatgggttactcttcttttcttctagattttccaaaatctgtaaaattagcatgtattacctttatttcttgtttttaaacaaatcaaggcaatttctttttaaaggataccagccccagtcttcccttcccacatcaaaaatccacacacactcacacatgccttctgaggtctcctggctctttagggaaagc

SEQ ID NO: 8160 - DNA, 1016 bp, Homo sapiens
ctgaggcaggagaatcccttgaacctgggagacagaggttgcagtgagccaagattgtaccactgcactccagcctgggcgacagagtgagactctgtctcaaataataataataataataataataaaagaatgatctggaccaacatatttgtggcttcttgcccaaagatgcaaagcccgccaaccctctaatgattaacaactacagtcaagtgatagcgtcatgctttcaacttagctctttaattttagattactaattactctaggagagtgttgtccactggaactttctataaggatggaaatgttctatatctgcactggccaggacagtaggcactaatcacatgtgactactgagcagttgaaatatggctagtgaaactgaggagcagaattttaattgtattaattttttttgtttaaatagcctcatctagctagtgctgggcagcactctagaatagggtttttcagatgtagaacacatgtagaatgaagctttgcttctgacgtaaagtaaggaaaatgagttgacttgtcaataggtacctctgagtgactgggccatggataatggtaataaacagaactttctggaactgaaacttttgccagagaacaagaaaactatgtaagtggggttgtaccgccattgtcttacagaccaatagctaagcaacccctgattcccatctagatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggtatgcaactgtcacggctaagtcaaagggacaaactgctaggagagctcaagatgacatgcttaaaaacatgaaagaaaatgtatcctattatgaagattttaaagaaaagtatgaccaagaggtagcatagtgaaaagaactaacgtggtattaacttgtt

SEQ ID NO: 8161 - DNA, 1031 bp, Homo sapiens
atttggcctgtataaattaggatttgttgaacatcccatcagcacaccaggctagccttgcacataaaaagtttctgttttttttaaaaaaacttttgatttttctacattgctttccactgttccactcattagttgaaaagtaaattgagccactggtatctactgggggctcaatttctagacaatagcaatttgggcattttccccaagctggttatgtctttctcaccataagagtacctccactgcttgcgtttcttcctgttttaatcccactttcaatgaagtgtgtatttgaaataaatggctcatgagttaatcacatctttatatatcctaagatgtattacaaaggcttccataacacttgtctatagtaagccactcatttctataatttttctttcaataaactcaatctttgtaatacagaaattaaccttctgggttgtttttgttcaagatcttcagtttgatttgccccttggttgatctgtttttcccatcgctgaactggttcccataatcacacacctttgcttttcatttccacagatcaaggaatcaacatttaccgaaagccacccatctacaaacagcatggtaaaacccgctttcctccgcgtagcttttaaatagcaaagtcagctgaacttctccttgctgtcctctgaaaggcttttcctgctgctgcttttgagagtaaaactggggcatccagcatattatgcctttctggtctactaagatgtaaatattgtaaaattgattctcctggatggagagacttagcttgattagaaagcttctaacctgttgctgagcccatcaaaccatgtatcattctgttcctagagaaggggaagtactggtcacacagcaactcacaaacatcctagcaagtcttttttctttttgccatcaaatatagtcaccctttaaaataattttgatgagactaatttaaactggtgaaaaaccagccacctagaaaaactaatttgactgagcctacatcaacttggctg

SEQ ID NO: 8162 - DNA, 1089 bp, Homo sapiens
tacaacaatttaccttcccttttgtcacatttgtaataactaccatttggagttcaggtaaatcaggtggtcttttgtctgcctagtatttgcagatttctagaccaggtgctttgaggtattcagaagcccatcatgagaagtgggagaacagaacaatggcacatcaaacaacagtgaagaccagctaaacattagcatgctgggatggaagctgtcgggaggtggggagggggtggggattgtgtgagctgggcagagcaaataagggagtgagggtctcctgggggtcttagtctagtgataagctttaagtatattcatggcatcatgaggagagagaacacaccccctaaattttggtaattacagttttcagcaacttaagaaagttagcatgtgaaagaaaaaataaagtagagcgcatggggcaacagtctagcacaggagtgtgagccagcattctggaatcaaattacctggtctcaacccagggatcaccacatgccgattgtttgactttgaccatgtgacagccattctgctgctagtttcctggaccaggtacagtgctcatacctgtaatcccaacattttgggaggctgagggccggaggattgcttcaggccaggagttgaagaccaccctggacaacatagttgagacctcatctatatatattaaaaaaataagaaaaatggtcctagtttcttcatctgtaaaacagatagggtgatgatagaatctacctcatagggtgttagtgaggattaagcaagctaatctatgtaaagcaattatcagaggccagacttgggggaaatactgagcatgtggcaatttctaccattgttgctacctgtcctcttggggctcgttaatactcggcctgcagacccatctgctgcgggaccagagcctctcagccccttggggtcctcccctccccggtcccatctcagggttgaaggttctctgtggtcgcttcctacccaagtccgtttcccctggccaatcggctcactctcatttttttctcttttattttttgaattagaatcatctgtagactgattttagtccacaaa

SEQ ID NO: 8163 - DNA, 1062 bp, Homo sapiens
actgtaagcaatctacgaagaccgaggaaaagctgcgggtaaggacacaattaaaacatgatgccagctgcatttgtaggccatacgctcgtggtcactaattcttggggctagggtttaggtgaaattactttttactgactttttcccttatagcaaactaagttcaaaggccatttggctagggaaagggttcccctcttaccttaaacgtactgtggtttttattccaaatgcttgtgttagacaaagtaagccttggccttactagtcagcttcttagaaaagcattcaagagaaaagtcaaatcatgcagatgggaaaacaacgactcatcaggttccaggtgcagcatctgctgacctcaccagactgttttggtgcttagtctataatgcactactctgaccccagctctacattggcacattttactggtctctcatttactggatccaaattcaccagaatagactctaaaagctgatggcttgtcagataaaacctttggggaaaataataaccaaccaagacaggtaaattagtcaattctcggaacacctccagatggcagtattttatgtttcagaagcaaagcgctgtacacagttgtaaaactgtgatcataatctctgtcctgttcagatgccctatttttcacacgggctaggaagtatttttcagtgcaataatcagactgaatgaatcccagtgccttgggttaacctaacttagtggtacccatggaaaaactggagtttaacttcaccctatttactgtctcagggaaaagaatggcctggatttattttggaggccagattctagtgcatagtgtaatctcttctcgatctgccattaccaggcatcagaagctatgtatgcaatccccagcagcagcacgaccagtttactgatggggtctagtcactgatgtgtgacttgtgaaggggtgacttggctttggagcaatgattatcaacgagacccattcgctctgccttttttcagatccctttgcctgccgccctgggaattacagctcttattttcctagtgtgt

SEQ ID NO: 8164 - DNA, 1015 bp, Homo sapiens
ggaatcattggttaaactccatttttctgccatcaagaatgttctttctctaccaaaattgctcttctgttagcactactatgtgagcttgtagagggtatgggatttcacaccgaaacatagaattttacagctgaagaggacttgaaattgtctagcccggccctttgcatttttgagatgtgtgtcctgaggcttggagatgttaaatagtgacatatttgaggccctatggatggtaaattgaggtatgattctcagacttcctgattccaaagcttgtagccctttccctgtacctcatgtccacaaagaattcggaactcttttctgctcttccagacaaagggtttcataaaaaatgttgtgacttacactaaattttgcattagagtagatgttatttccccagaatcctggtttgtatgctaaagttcatacttcaatttagagattaactaaatagcaataataactacagatgtctgatttaaccagcactattaaaggcaaacaattttttgcacttcaaatgtgtaggcaggtactttgtaaaactcacctaaataagcaaattgtcagttgttcatagagtttcatgctagccacagtgtagtctttttataaaagcattttgaatatgtgaaaatgcagaaatggggacgtgatttttttttttttttttttttttttgagacagaatccggctctgttgcccaggctggagtgcagtggtgcgatctcggcttactgcaagctccgcctcccgggttcgcgccattctcctgcctcagcctcccaagtagctgggactataggcgcccgccaccaagcctggctaatatttaatattttttttagtagaaacggggtttcaccgtgttgaccaggatggtctcgatctcctgacctcgtgatctgcccgcctcggcctcccaaagtgttgggattacaggcatgagccaccgcgcccggccagaaatggggacgtgattttttttaaggagcagggtac

SEQ ID NO: 8165 - DNA, 1021 bp, Homo sapiens
ctgtcgttgatgccttgaattcgttcctaaggatatcatagatcaccacaaacttggcagctcaaacatgacagaaatgtattctgtcacatttctggaggcctgaagtttgaaatcaaagtgttgtcggtgtggagtgggggttcttctgggggctctgctggagggtctgcttcatcctgtcccctggcttccagtgctgcagcatccttggtgctgcgtggcttggagctgcatcgctccagtctctgccttcatcttcatgtgggtccagcttgccctcttggtcagtttccttgtcttgtctggtcccgtcctgtcctgtattttgtaaagacttgtcattggattcagggcccacctgaatccaggatggccttctctcaacacccttaccttaattacatctgcaaagcaggttggacatatctttgggggaccacagttcaactcagcccatgccctcccatctaaaaatcggagtgcttgctcttccctctcaggtttttcctcctggaggtgaggaaaggggcaaaagccttgttcttgtcgtaatcaacagccctgctctttgaggataaaaagcaacaacaaaaaaaaacggagtcccaaggaatggcatctactattagttaatcgcaggtcccagaaaagcaccagccagaactgcaagtcttctaggaaatttcttactgaattcagcaaaataagaggctaatgagaagagtgtttgcatatctgatagtctaactgaaaggaaacagaggaagaaaaatgtgcttttgtaagccctgagagttttagctgaatggcagcctttccctgtgattaactggcattaattattgtttcaaagagtttccaaggttgactgaatccagtgtgaagctcacaaaaccaacaccatctatttgttttatttctcaggagaaagttatattaatgcaaaaataaagaattgtggctgggtttgtgatctgttttcaatagtttctttaaggaagcagctgttttttgtgtt

SEQ ID NO: 8166 - DNA, 1031 bp, Homo sapiens
aggggagaaatatgtcctgcccttctgtggaaaggccttggagaaatgtggttttggtgtcttctccagcccctggccacctcctcaggagccgaacacgtttttgtcttgcagggatggtgctccgtactgtgaaaaggactaccagggactctttggggtgaaatgtgaggcgtgtcaccagtttatcacagggaaagtcctggaggtaagtggcagaccggctccctcatagctaccgccatctttctcagcggccctcagaaacaaacaagaggggaccctttcccacctcctccatctttttttcacctgtggagaaagaaagtagtcgcaggtgactattttcaagaattaaggtgctgcactctcctcaaaggctcacgtggaaattagaatgatggagaatttgcacaggaaaaaaaaaagaatgataaaggttctggtaggagttatgtaggacaggctatattagaccattttcatttttagaagttagacaagagtaaatgaaaagggtgtgaaatcatgtgtgtatacatccatgtgtgcatgtgtgcatatgtctatgcatgcatctgtgggcgtgtgcagattcagggagcagaggctcagaatggaagctaagaaaggaagggtgggggaaaggtagaggcattggcttccccaaacttcaaaaaccacatcctgtgtgacccagagcaccctgtggccggggctgagctgaagcctgtcaagttcaggtgcaaccgcctccagctagggagctttcttcctgctttctcagcagccgccacacaggcttctgcctctgggctgagccagttcctctggggtgagacacagaattctggggccagagttcagaaggagtcgctaccctacttctcccaggcctgtggggtgtcagccaggtccaaggaagaagtaagactgcctcatctgtggcccacctgccagcgtggagagtatggcccaagcagaggtgggtcaggaagccccacaactagggggatgactacaggtgctgc

SEQ ID NO: 8167 - DNA, 1824 bp, Homo sapiens
gacccttctagaccagaattagagacagacacatatgaatataaaaattgaatcattctatgatcatttttctgtaacttatttttttctcttttattatgtcttagggaccttcaccaaatgattttataatgtaaataaccactctttaattttgctgtctagtacacttagatttattgtcacattttcttaccgtggggacattctttcctccccaaacacggacatctactctttcagggcgttcttgaaccatttcaatgacttacctgtgtttactttatcttaaagctactatagggaatagatttaagatgaaaatgctgaactcaagatgatccttgttgcttgaaactcagtttgattctattatattaatgaatggattgacatacaggatcctgagagcttaacagtgtaaaggctgcacctcaggacaaaagagaaacatgattctgctctattcactctgctcctatagatctttagtaatcacatgctgtagctttggtttttcagtgggtaaatggtaattgagtgaaatgattcggtgtgaataaaggtgcttctaataatatttccactcttttgggggtgcttccaggaaccctcagtaccaaacacagatgttgacatttactgcagttcagatctcttcatttgtagctcccacccaactatgacatggcactcctctctgttgctaatggatttgagtttgtttccctgatatgagtaatttatgagtgatgggaaagggaattacaaagccatttcttcattccattcttgcgggactcttggaagacctagccttgctatatatggtatatattatagatcagtagtcctcacatagcagctctttttctaagtcttggagacttcccaaagcttagattgcctgggttcacattgctctacaagtcactggccaccttctaactggaacactttggacaggccaccaagaggtcacatactagtattatcttaacccttagacactgattaaaggctgttctgttttattttgaggtctgtgccagtccacaccactgctttctgattgcactgacctcagccatcaacagagaaaggcaggtttgtttcgtttcgtttcatttttgtttgtttgtttgtttgtttttggtaggtacacaagggtttccataggaaaaagggaacttcttcatagcccttaaagtgagaagggcactggggatcgtttagtccaggcattcatcctagagatgagaaaactggggatcagaaagggtaagtaggttgctgaaggtcacacagcagattgtggacaaagtactcattctctgtgtctcgtcacaccatgtagtggatgagagaccacaattgccagtgtgttgacagctgctatctctgtcacaagatggtgagcctttcagaagtggcactgtgtctccatctttaactttccagtgcataggttagtgtttcccccactgtagatcttcaaacaaccaaaacaggttggcccgttgtcagagcaggaacaggaacctgtgccttcttgattcagaaacttctccaatcctctccatttattcttgttctcagaaaagcctagctccttccttccctgtggagctgtcaggaatcaactcgaggaggctcgggtcctggcaatgtccatcccgaggaacatggccggcccaaggaggagtggcatagactccctgttgtgcttgccacttagagctcacactggcttgcctcatagttttctctctaggataaaatacctggttcggggctgacatgggcaggagagaaagcacgctg

SEQ ID NO: 8168 - DNA, 1031 bp, Homo sapiens
tgtctttatttaaatgaatttaaagtcctctgtttttcttgtactgtacaaagagtggattttagtttggctttccagaaagatagggcaggttttggaagaaatcttacacgcagagagactgtaagtaaacagagtaagtgatacatctaattatatttttagtggtcaagccagaaagaacaacgttctttctcttccttgttttttaactactctcctcccttctactccgtggcatatttttaaggtatttggagtctttccacttgctaccagctggaatctacagaaaccgtatctctagaacactcagcagttgacttgaagctcagtcataattaaattggaagttggcaaattattccaagacttaaaaacaggcacaccttatgtttggaacataaggggttttgctactctgcattgttttaaatgtactctctatagggaatatgggcaatacttttaattagctttttttaaacaaaaggatattttgaaaggatatgtaataaataagtctgaccctgcttacattttatttattattctcagtagctggttcccggatgttttaaaacaacagcaaagcttgcagctgttcatccatctctctttagtaagagaagatcatcctgtcctttctctcctggcacagcttgaaagcattagctagttaggtggctgctgatttaagactttgatacagtgacttacaaccttctgctctaaaggatatacttagagctagtgtttgtttacaattaatagtaatttaggactttgagatagtcagccgttaattttatattaaaatctgactgctgacatgtatgtctccatcgttaacatagtttaaatattggggtggtagccaggatagcaattcagaatattgggattttacaagacttatcactaaatgtcattcatttccaaaaagagggaaaatgcatcgtgccgattagcactacttttaggtttcatatgagagaatggaaatgccagacaggttttcctgcttccaa

SEQ ID NO: 8169 - DNA, 1029 bp, Homo sapiens
aggttttgagaaccaagcttaaaacttgatgatatgaggaatagctggattactaaaattgaaaattagggctatctaagttaatggatttattgatgggcataggttttctttttaacagcaaatatcactcttgttctgtttctattgtgtcatgatttggatacctataaaccccaaatacctaatttgtttttagaagccattggcacacaccctgtgtgaagtgagcacctcctgacaggttcacgctgtgcaggttttcctccctcctactcgctggcatttacggtgccactgccccgggctgagtgggctggcccggaggctggctctggtccccagcccctactgctgggcagatcagctgcttcgaaaaccgcgtgccagctcctgagggctgatcaccacttgccccagggcaggagaagccttgcaggctgccagatctgagttctttagtttgtacttttgagtaactggttgtgtctctgactcagactgttttatgagtgccacttaaattctcaaaaaaccagagtggccttacttaagctgtgatgagcggagtgtgggaaggaaggtgggttgggttggtggacagtgaggctgagaattgtttttctctgatcccatggagcagaaatgagaagggaaggggcgtgttttgtgtctgacctggaattttgttctcttccttcctcccccagagtgccctgagtcatgaggccgagagattcagattactgtgaattctagttcttattgaacccagaatggaccagaaggcctcagcatagccctaggacttagtgatccattcagcatctgttatgagttgaattatgtctcctccaaatttctatgttgcagccctaactcccagtatctcaggatgtgcctatatttggagacaggctctataaagaggtaatgtagttaaaatagcctaatccagtatgaatggtatattagttcattttcacactgctgataaagacatacccgagactgggtaatttataaagg

SEQ ID NO: 8170 - DNA, 1047 bp, Homo sapiens
tgacagagggagactgtctcaaaaaaaaaaattatctgctcagggcatttagctattctcagggcctgcttggccattcaccaaggatgcccctccagactgatatgtctgggaacagcagggagcgatcacctgggcacctccttagacatacatgctcaatggggtcctgctggccaggctgagtccataagccatcacccacgagctgtgaaatcctgaggccaagatttccttgtgctgcctccactcccagaggtgaagctcacctgtcagggagttactgctaactagggaagctgcccccaaagggatcacgccagtaacgtgtttggaaaaaaaacacagttaatcctccagtgccaccaaaccagactttgtaaagctactcaatctattaatagtgtggcagccctccttatctcaactgagcacaagtgccaactagtttccaggtcaggcgtttatgtagtaatcagtgacatttgatgttagccagatttaccaggtgtgctgaccctggcttaggatctttgagagcaaagtagggactggggtctcagaccttctgggtttggttctaagccactgctgggaataacttctttatttagacaccagtagttattcttgcttgtttatttgcacagttggagtggtgaagactgaaagtaagtggcaggcaaatgtctgacattgaacataaggaccgtgtttggtggttcatgttgtgcagaaaccaggtttggttgtcttctttaagattgtttttatgcttgctttttttttttatttcaatgcatttttccctgtcttgttactcccatagttgatccaggctaaaaatcgtcaacaaggaggtttcaggattatgattcaaaggatactggaagtcattccttcccaaagatctctctctgtgttttctcattggctgaagcagcctgtggatctcctaggggtcctgtgaaaatatgtttctccaacagatgctggcgaggctgctgagaaataggaactcttttacactgttgttgggaaagtaaa

SEQ ID NO: 8171 - DNA, 1024 bp, Homo sapiens
gacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgca

SEQ ID NO: 8172 - DNA, 1097 bp, Homo sapiens
gctggtcgtggacctctctgggacctcgtgtcctcaactgtaaaataaggcaaacctggctagtacggttactgctcaaaaatgacacaggtttgaaagcactgggcacagtgacaggttctatgtgaatgtagttggagcatttagagttgggctgctgctgtttctcctctgcacctgttaatgttgctgaaccttcagcaccaagtgtccgtgatgagtgttgagctgtaggtgattggagccttactctatggcagtcagattcgttcattcattaactcatttattcaacagttatttaaagaatacctgctctgtgcaaggcataattctaggtgctctccttctctgcctggtgtaggcaagaccatcagcaacgtgaagatatagaatagaaagtgacggagatgaggtgtgggcagcaaggctgaagctggcaccctgctcggggcgcagagccagtgaggggacttggtgggagggctctgggagagctttgagatcaccgtgaatgggttaaaataagccttgggatcactcggctgggaggagatgtggaggggtcagtttattagaaaatggcttatgtggaccctggaaatcagcttctttgccctaaagaaataaaaaaaggagaaacattaaatgcagcactaagagctttagttaaaatgtagaaaatggggttggggctgaggtgctgttgacaagaggatgctgagtgtgagaatgggttgctaataggagttacggaatttccccaaaaggggaaattgccatctggtgacaatggagtgatttattcatttgacgtctaatgccacaattccctgtctcctgagcaatagtgatattctcaatgccctatctaagaaggaagatattaggaactagttgtttgctaagctcaaagtctctgttgaccttactacaactttcctgaaagaaaaatgacctagtgtatatttactattgaatataattttccttaggaagtctgcaagcctattaaagattaatagggaatctcattttcatgtgtttctgtttaaagcgaacttgtgcaagtgtaggttgttagccattcagaaatc

SEQ ID NO: 8173 - DNA, 1050 bp, Homo sapiens
gcagtccacgtggataactgtggatagatcacagtttgttgagccattttcctattgatggatacatgggctgtctccagttttgattattatcaatatgctggtataatattcttgttcaagtcttttgtggacatatgttcaagttctcttggataaaaacctaaaagtagaatttctgggccatagggtaattgtatgtttagttttataaaaagctaccgaatgtttttccacagtggttgaaccattttccattcccaccaacaatgtatgagaattctaggaacatcacattttgttaaataacatttgatgtcaaattttaaccattgtggtgagtgtagagtgtatctcattgtggtttcattttgcatttctctgataactaatgatgttgaacacatttcagatgctacttggccattcatttatcttattctgtgaagtgtctgttcaaagatttggcccatgtttaattgggttgttttcttatattgagatttgggcatttttaatatattttagataccagtcctttgtcagacgtatgttttgtgaatattttctccagtctgtggtttgtctattcattttcttagcagtgtcttttgtgaccagaagtttttaattttgatgaactctaccttaccaactttttatcttttatggttattgctttctgtggtcttgtctcagaaatatttgtctagctccaagattatcttatgtttcttctaaaagctttatgattttagcttttatgtttaagtctgtgatccatattacattagtttttgtgtatggtatgaagtagggattgaggttttttgtttgtttgtatttgggtttttcttttttaaaaattattatccaattattctagtaccatatgttgaaaagactctcttcccccattggatttcttcagtgttgctttcaaaaaaatcaagtgactgtagatgtgtgggatatttatgagttctctcttcttttccattgttcaatttgtctatgcctatactgtaccacactatcttgataacttaa

SEQ ID NO: 8174 - DNA, 1050 bp, Homo sapiens
taaatggaagctagccaaaaaataatgttttaaggcagtggtggtttaatttctaaaccagcagacagcactcaacctgtcaggaactctggggtcatttaagtgggatgtagttgacaaagcctgttgctctgcaaaggcttgaccctgaccaggtaaccatgggagattgatcacttttcacatgtatcctagtcctcacgtgcacaaacctactcttgctctagaaattccagaaagatgtataaagggaggaaggatggtgaaatggtaaccctgggtgctctgggaaatgcttcattctttgtttatcagtcagagtgtagctcattctgtctctgcaacatttgagaaccttcgtgtccaacctctaaacccagtctcctggctctagaacttcatagatgactggctttgtagtgttaaacaaatcccttaactacctcagcctatttcttgatctgtaaaattgggacaataaggaggccccctcggagtttttatttgttggatggatgaatggatggatggatagatggatgcatggatggatggatggttcgttgctctaaccattaaataagatcaggtttataacacacttagtccagctctgacacacagttcagtgctcaataaaagcacttgtcatctactgtcttcctaataaacagtaattacttgctgaatactaaaatgtcatcagcttagcaaatctaatgtagcagatactaaaagaaacccaaattcttttaagaagttcacagcacatctttgccttgtgatcatggtcacaaatgtgtgtgagtttgaaacatcatcaaaacaaaagacacttccttggatatttaaatcggagcatacccaactgctgctgagggcatgtgatatggtttggatgtttgttcgtctgaatcgcatgttgaaatgtgatttccaatattggaggtggggcctggtgggaggtgattgggtcaggcgggcagatccctcgtgaatggtttaacaccatcgcattggtgatgagtgagttgtcactcagtacacatg

SEQ ID NO: 8175 - DNA, 1006 bp, Homo sapiens
atttatgaagcatgtccagcaaggacttgctgacattgcgcaagatctggtggcatcccatgtctaacatctccgtggtgctgggacagacagatcaaactcggggacacagacccttggaggttcactcaagttagaacccctcaatgagtggagcaatggggaggaaatatgtggccagcactggcggagagtgtgaccttatggctcatccagatcccctgcctccgtggctcacaaacttaccgtgtgcattccattctgaaaagggaagctgaagaccaggccgtgcgagaagggactgtgttctctgggtctgtgggcctgctgcaggccaccccatgctgggggagtgaccacagcacagcccgcggggatggtggccttgtgggaaaggcgaaggcatgcttccaatgagcaaattgtatttattcatgaatttgcatgaatttcaagatgctgcttggagtttgcacttagcaactgacagcccaagaagaaatgggccttgaaggcaccacggtgatgctggaaatctgagtctgtgaataaattgtttcccaacaacatattcaatgggttgagaacaaaaaggcttgtctgcaatgtcgagctatgctttggcttcttgtgtttctcgagtaagtgcctggcatgtgggcacttggtgtggacaggaatgaggaagaaaatgttggcctgagctcccatgagtctttttcctccccaaatcatatgtgttaatggagcacggggttatgccctacccatagatttttatggtattttctttccttagagccagagaataactagaggtgtttagtgaccttctttatgaacaggttcctcttatgggtcattacatcgattttcctcatccaggcctggggtgattaagagtgaggcaggtggcctttcccacgctatggaccaggggttgcctgccagcagcagcatgtgacattaaaatggtcaggagcacatgtgactgttacagagaatg

SEQ ID NO: 8176 - DNA, 1021 bp, Homo sapiens
tctgtctctctctttccctcatgagagagaatgtgagtttctctcttgtgagtgtgtgtgtgtgtgtgtgtgtgagagtgagagaaagagcacatgaaagagagagacagagacagagacaccaaggcagaacaactagaaacctcataagtacacagtgagggccaaggtttcttgagcttggagagtaacagcaattcaccaggttgattcctgattggaagtgatttcagggaccaaggaaaatgctgtttatggccatgattgggtagctgatctacattatcatgtgagagagcaggaagtaagtttcatgtgagttatatcctggccctgtgcttgaataagggttttttcccttgggacagcctcagttttataaggagagaaatggacccaacatttcaaacatatggaagtgacttcttattatccacaatagggggaggatagttgagagatggagacaaaatgtcgccacaccatctccatgtgtctgctattttgagcattcctgagctgtgtttggggactaggacgtgttaaaggcagaatgagacttaagatagaattgctgaagacactgaggctctgcttgattcaaaattcacctcagactcagagatttcaggacccaaagctcttaggagctccgtgtttccagagaatacaaagtctgaagaacaattctaaaattcaataacacgttattaagaactgtctgtcccttgcaaggtggaatgagaaggcacaatattggaaaggagtgctggttacatacttaaaaagaacaacagttattatgaaaaacttgttttaaaaatcgtataaatggtttcacaggtggaggacaaaatgcctgtgatactttgcagtgacctccgcaactggaaagaaaataagaaaacgagggccggcttcagggggatggcagggtctggcagggctcaaactccgctaaaggcaacactggattgctgctaaagtgaaggaaagaccttatttttcaagtgcaaatcat

SEQ ID NO: 8177 - DNA, 1033 bp, Homo sapiens
ctatacttccatgttgctcatggaggcctttgattagcaattgagacaggagagttccctttaccctctggtgggacttgcagcaggggtggctcctttgctcagctgcttccacgtgctcaaaccccttatggtgggtggtgcatgcatgtgagtgggtgcaggagctggggcgagtgcctttgggcactggcaggaacaaacccccataccagcccacagcaatgtctaggggttgccagcaacctctggagccccagagggtgtgtgttacaatcagtgctcttttagtatgtgctgtctgtggatggctaagtgttacacagctcagtggagggtcactgtgacagcttcttgcacccgcacctgggtccttgtctagtgcccaagaggaatgaggtcacatggacttgaaggatggtgaatgtggagattttattgagtggtggaagtggctttcagtgggatgtggagctggaaaggggatggagtgggaagataatcttccctggagttcagctggggactgaactcttctccaactgaccttggccaaattctgtgaccgtagtctctgacatccagctgcctcttctcctcttgatgtttggacacttcttctcttctctccttttctgccacagcgctctgctcctctgccagtggagctttggatttttatgagcacaggatatgggccatggtaggccaaaaggcaacattcgggcgggaaaacagggatgtgaagttttcgtttaggtccgcaggtccagcttgagggtggagccctcgccagggaccccaccatcttctacctagtatttccctgcctcctgtccatatcaaaatgattaggatcagcttttggggaaggtactttttagtttatgttttaacatttaagatctagcatagcctttggaaggcaaaaagtgaactctagtcatcaagtcaggggatcttgatgttctcaggggcactggatgagtttgtcagattcttgtcccataaagacagtggtccctcttgacaa

SEQ ID NO: 8178 - DNA, 1059 bp, Homo sapiens
agccatcagggatctgtccccttgacccaaacacctcccaccaggctgcacctccagcatggggtttacatctcaaaatgggatttggagtggaggtccaaactatgtcaagaagtgaaagatggaagagaggaatgagtggatgcctttgagagtccttaagtgttcatgcaggcacttttgttccatcttcccaaggtctaaacatgtcacatacttttttcagagcgccgacacgtagtaggctcttagtaaatattggcagatcgacatttttcacaaacatgtgacatttatagctttaaaatccttgggctataaaagcataggttcatactctttctgctgataaattaacaattctgtttgtcatcttttccaaataatactgcatttgctgcattgtttgtggcggaaacgatcagcctgcatcagacattagtagcccctattttttttttaattcacttaggaaaaagctgaagacagatcatttggtaaccagctgggaactccacctcacatgtgggcctgcttttcgacttcatgcttaggtcctgcaaagttgaaatgggtaggtccctttggaaaataaggcaatacacataaaaggagaataaccaagactttcatttcctcctgaatttgaaaagcagtgctgctgaatgctttgtttccttttattaccatattgacgtttacgttttgtaactatggtcatggagcagtcccttggtgaggggtgggaggtcaccctttccccatgataggacaatgccaaacaaagggaccctgacgatggtagaggtctgggctggctaccttgccgatttttctgaagctttgaatgtagcttacgaagcaaagctagcgagaaaattctggatggggttcccaggcgaggattgtaacgagcataaaatcaactaacattaatctcgccctttaatgatctatgcatggtaatctaacattgcattttttcctcctccttctgtccttggcggaaggcagcctgctgagctcctgcttgctcaggcttcctgataaatgtcaagc

SEQ ID NO: 8179 - DNA, 1101 bp, Homo sapiens
acaaactcaggggatatttagaaactactttctgcatattcagcaggtcaagagactgcaaagtattagtaactcaccagctatcctgaggctcctcatttaaggttttatcatgagccaccttttttttttttttttaaattttatttatttatttttttttattgagacggagtctccctctgtggcccaggctggagtacagtggtgcgatctcggctcactgcaagctctgcctcccgggttcacaccattctcttgcctcagtctccggagtagctgggactacaggcaccctccaccacgcccagctaatttctttttgtatttttagagagccaggatggtctccatctcctgacctcatgatccacccgcctaggcctcccaaagtgctgggattacaggcatgagccaccgcgcccggcccatgagccacctttttatagaaggttaactctccttggctcaggtccagggctggcacaggtaatctggggaggcaggttggtctggaagcaggtctaaatgcaagaatacctccttcaaggttgggttagagagggtctgcatccctctctgtctcttctcaggtaacaggacacagaatttccccaacaaaagcaggatttgtgtctcttaggagaccggttcttctctgctggctacatcagaaaatacaacacagatgtgattgatggtgagggattagtgacatttccgtgaacttgggacttgatgaaaccctttatcttttattcccaaagtgtggttttgttcacctcatctccccaaagtgtgtttggttttatttccctttgaatggtaaaggatatgttaatagatttttaagaatcaactcaaaaaaccccaaagtcttaaaaacgctttctgtttcttttccctccccaaactttaatagcccctggagtgggtgtggaggtggcaggggtcctttgtattttccaaacccgctgtttgcagaaatggctgttatgactgcagcaacataattgctcttaaaatgcctcaataataaaaaaaatctatttttattttgtaatcttgaggctccttggcttccatttttccaggccactt

SEQ ID NO: 8180 - DNA, 1077 bp, Homo sapiens
tgcaactctatgagcaaaattaacatctttctactctctctccatcccccattattatacagaataagaaagatatgtacctgtgatgattaattttatatgtcaacttgactaggccacaggatgccagatatttagtcagtcattatcctgagtgttcctgtgataaagttcaacatttaaatcaataaactgagcaaagcaatggccctccttgaggaaggtgggcctcatctaatcagttgaaggcctgaatagagcaaaacgctgaccctcccgagtaagcgggagttcctcctgcatgactgcctttgagctgggtcattgtttttttttttttttttcccctgcctttggactcaaacttaaacattgactgtcccagggtctcgagcctgccaacctgtaccgtgggttctcctgggtctccagcttgctggctgcagatcttggaacttctcagcctctataactgcataagccaaatccttataattatctatctgtctgtctgtctgtctgtctgtctgtgtgtctgtatgccctactgcttctgtttctctggagaaccctgactaatacagtgtctgagcacagaacatagttctcagcctagcagcttctgcgagtgctcaccaggcacccatgtatgtgaaaggtattaaatcaggtggtcatctgtctccttctgcaaggcggtggctgcccactgacccttctacccaaagtgcatcccatcccatgggcccaacttcaggcaggagagctggaaggatgaggtagagtggctactccagtaggacagttggagaactggtcacgtctactctgcttgtgtggggaaaatggagcccctcctttcaggcttatcaaaggcctcctgagcacaggtttctgggcagtggtgggggctgaacttgaacctcccacctgccaggtggaggagaaagcagcctggaagcagagctgggagatgatgttgtgaggagcaggtctggagttctggagcctctgctggggcaggctatggctcactgcccgtaaaggctgcagagagggtgcacagatgcagtttca

SEQ ID NO: 8181 - DNA, 1066 bp, Homo sapiens
acctcatgatccgcccgcctcggcctcccaaagtgctgggattacaggtgtgagccaccgcgcccggccaatttttgtatttttagtagagatgggatttcactatgttggccaggatggtctcgaactcctgacctcatgatccgcccaccttggccactcaaagtgctgggattacaggtgtgagccaccacacctggccgcaagccctttttatggcagcaaaaatccgttcctgagaccggagctctcatgacataaacatctcccattaggccccacctcccactcaacacagttgcactggggagtacatttccaacacatgagttttcggggacacattcagaacacagcatagagtgagagaccccagtaatcccgagagcctgcagggtggaggtcggtggtgtggaggcagttgactcagattctgcaggtttgtctgcagggagagagggaggctctgagactgagagccacagggtcatttggggagcaagaaggaggatctgacaaccaagaagaaagagggcccgtgggctgggaaggagtgggttctgggcaaacagtattccaccagtaaggggacaaggggacaggggaggcctggcagcaaggtcactgtggggtgggggttgaggcatgggagagggaagggaggggactgggtggtgttcgggaaggtgaccacagtcagagacaagcgttgtgaagcctgcttggaactggagaaggggtcagcccctttgttccaggcggcaaaagggcagaaggggaggggcacaacgaggtggacccaggtctgctggaagagcaaaggttgcagagggacaggctcagcgcctggtggcccaggaggccacgtgaggatgtgtctgtgggcaccgaggcaggtgaaggagcagagagtgcagagcgcacaggggctcctgagttaggaggaggagccgtaggggctcgggggcaaaatttaggactcagaaagcccaggatgttggtgcgtttcaaatttgccaacaggaaaggagtgagcagcccatctcagaaggggagggaggaggtg

SEQ ID NO: 8182 - DNA, 1111 bp, Homo sapiens
actttttctgcgcagggctgcagggagtgggaataggagcgactgctgaaggatatgagtttctttgaggagtgatgaaattaggtaatggggttgggcgcacaaccttgtgaatatacgaaaacccactgaactacacactttataactgggaattttatggtatggaaattatatctgagtaaaacaaaaagagaggcaggaaacatacttagcagctgtgccattttggtcaaggtacttaatctttccaagatccactttcctaactggagagtggggtgggtaactgtacctcataggccatttgatagaaaatgggactggacatgcagtgccctccttggagcttggtctatagtaagcactgggtaaatggtggctgctatttctccccctcctccccctcctcctctatccccccagaccccatggaagaagctaatagcgtgagcccccttgggtcgcccccacaaaggtctgtggtcatggtggcctgaaattccaaaagcatctaattttgaagtggaatgtggctgtccactcgtgtctcctcccacaggcatggagaccagtgggtggggatcagatgattaaagagcactgatgttttgagctttatccaaaaagatttgggaacttcagaagcatttggtattgtgtgaccactaaaggaaatttagtgaattctagaaatagggtcagagggagacaaagaagaagtgagaacatggtattactttcatctattcaagtacctgtttttttgagtaccttttatgtgtgaaatcctatacaagttatggcagtgtagaaatcaactcagtatacaggagtgtgtggtcagggtcagagtggtgagggggtaactgtgggtgctgggggaggcagagattctgtccattggggagcatcatggaaggctccctgtaggaggtggattcggggcagggtggggtgtggttcacaggcagcaactggaagggtgggtatttcaagctggtggaatggcacaggctcagctcagaaggaagaaagcagcagacaaacagctgtgggaagaaagcagttgaggtggaaggagggtaaggctgtgggataaagccaggat

SEQ ID NO: 8183 - DNA, 1026 bp, Homo sapiens
aaatagcctgattttaggcaatcgttagcaaaggcctgacatctgacagccagcagggaaaaagaaatgcaaatatatatatatatatatatatatatatatatattgcattttttaaaatcataagtaccagaccttaaaactccttttcaaattgggcatttatttgatggatacgtaaatctgaaagctaacaagaaggactgtttagagaaactagaatgtcactattgttgagaccacctgtcacatttcctcggagcctagaaccttgtagaataaagtcagccctatggttctgtcttcatctttaaacatgtatttatggagcagaattgattttatgtatctcagagagtctgtgattctgctcacggccatttgctgactaatgactttggcagaggagaacagcaagcaagttcatgaattatggctctctttgaggttctcttatcaagactattttttattttaagaacatctgctttgattaaagccattagagctgggaccacataaaattgtgtctgaattttatatgtgttgcattttacagcaggaacccagatgaagcctgcattttaatccttaaaccaataagaccagcgatgaggattaacctaacaaactaaactagttcctcctcaattgcctggtttggggttgtaagaaatcctggggcaggagacttgttggccaggatttgatacttttatttatttgtcctctacattgctgcaaaaatattttcatttctttatatacccctctttctggcaaaaattgtttaatgtgttggggtggggtgttccaggattgtgagttaatctataaccaccctcatcaccttatttttatgttcactaaagttaaaaaagattttctgctcactagctctgcaagactgaagtgatgttaaattatctaacacgtagctaatagcaaaggagacatgatgattaatttttgtttgttccccagaaagctcttctgtttgtttcccagaaaggtctgttccccaga

SEQ ID NO: 8184 - DNA, 1744 bp, Homo sapiens
cgtggactatgtctttcatttccatttttttttactaaggacactagtaggtgttcaataaatgtcttactttttgttgagtgtcagtcagcaagacatgagggaacacagcagagggcaatggcgtctacatcttgcccactccgcagtggtgctcctggaaatgtggatgctcaggagtgggccaagctggaggggagtcaggcagggcttggacaatctcagaagagaagctgctttgattccaataaggcctggagtgacgactcaatcttgtgggggcgaaatgctctcttttcatataaataggcctctttggtaagggagaaagcatctttattactgctgtgcataattagaacagcggggaggaatcaggggcttttaatgaatgagcagcgtgtggcagggaatgagtgagcgcctgccactgcgggcacccccaggcctgggcatccccaggagtgagcggggccagcgaggagacgaccaaggaagcacaggcagtgctcagaattgaaacctgccccactgaagcgggccctgctgatccttgctgcgttcctgtcattgcaaatgactcccaggctgcagctttgcagatgctgctctgagctctgccaggaccacccctcttcttccagccttgaccgtgacctggcagccgcagatgtcctgcggggctggcagctgctccatggcaccccttctgggcaatcctgagctgcagagtttttgccttgattttagtccccttatttttagggtggccatatgtcctggtttgctggaatagttctagtttatgcctcttttcctagtgaaattagtaataatgatatctttcaccttctaagtatctcagtttggaaggtgaattatgtggttgcgctccttatctttgtcttctcagccatccgggcctcaagacggatgagggaggcagtagggtgtgcaggtaaacctgggctttggtctcagatgcttgtaacatctgggtttaacgttgctgcatctgttttttctgctgtagacaaggacgattaataatctctgctctactggggtgctgtgagaatgaaatgagagagtatttgtaatgagcttaggtatgagcctggtacacagagggctctcagtaacttccagtcattttattatcattgttaggttgatttgggaagcgtagtggttaaatgtgagatctggggccagactgcctgggttcaaatctgtgctgtgtcattgacctgctctgtgaccctggcaagttacttaaccccataaagcctcagtttttctcatctgtaaagtatggattataacagtctcttcttcatatggcctttatgagaattaaatgagtttttatatgaaaagcactcagagtagagccgggcatgaagtagacattgaattaatatgagcaattattattggctgttattgttattatgaataaatgtcccaacttacattcttgtaggcaggaggaattatccagtacatttgtttcctattgctgttgtaaaacttaccacaaatttaatggctgaaaaccatacaaatttattatcttacatttctggaagtcaggaataagtccaaaatgggtctccctgggctaaaaccaaggtgttggcagaactgtattccttctggaggctctaggggataatccatttcattgccttttcaaacttctcgaggtgacctgcattccttggatcgtggccccttcctc

SEQ ID NO: 8185 - DNA, 1050 bp, Homo sapiens
ccgaagggcttctcacccacctccccgcccatccccagggactcactgggctggggaagggtgaagcggcgggggttcgatggtcccttccttgcggggggcagggggaggcacccagtgcggaggacagacgctcgcattttgcagatgtgctagggccgctttctttggggagcgtgattagggctccgaagggtgggggagccggagaggacggggaagggggttgcgggaagaggacgagcaggtttcggagcccagggctgtaaatcaaggcttctcccacggagggcccggctggccaggattccagtcttcctgtgggtcccaagtggggaaagttgggcgcatggaggcgccgcgcgtccctgacctgcagggcctcggcgagagcggccgccggggagaggagcgcggcccaggcatctttcccgggagcgacaggcaagccgcctgcgaggatgatattaaaatgccgggacgcaagggagattcagccacgaaacgagcgcttggctctgcggggccccaaaagctggagaaactgagtccagtggcagcacagccaccatctgcgctgggttccctgtcttgctgtcgggcctgcggcccccaccctctgctgcactccaagccgcacctgcccccaccccagcccattgttcctgcggatcagggaggtgcctccccacgcggcactgcagtggtgggggagtgcagggtggcgggtgggggatcctgacagggctcactccagggagaggcagcggagagcccaggccgtccccaaacacacacccagtccccgcctgtactcttcctcagctggtgaacgcaggcaatggactggcagctgtctttgtctgaacatcactcagcaactggattgactcttttttttttttttttttttttttttacttttttcctttaagtcagaaaataaaaaaatttttaggacgataagtaggggcgttgaattgctaaagcctgagaattactgagccagtttcttgcctctcatgctgggatagggtgggcgatgatacc

SEQ ID NO: 8186 - DNA, 1070 bp, Homo sapiens
tcactctccctccatgcctagattcagaaaatgcccactgcgcctagttcagtgataacaaaggggttctcaaattgtagcctataagtgacttaataatagattaatctgcagtcaagaagcttgcttcaggacagggagatcgttctttggactgagacaattccaggacaatttcagcctgacaatactaggtttatgagttttcagttcaatcaacatccatgtattgctgctgtggagcccagagagcacttcctggaaatttttagccctgagctgatgaagaaagctttttctaggatctgtgcaccaccccttcacctacagacacacacgagcatggaaacatccatggtagttctacagaagtgatgaaggttagtatgggttgatggaagttgctcacctagaatgagagaaatactacctcctttgcatgctgaaagcagtttgactggcttacataagagtgggcccaggcccaagatggtgaaaccttcgtactggtgactcaatctgcagacttggatgggactttccctggaaccttagctgggctgcagctttatttcctagaatctcctcacctgtttgttttcagtttagagttgccgacagataaatctgcatgagatttagaaggtggaagtgaagtagttgtcttaaaaaaattttttttaaccctcggaaggtccgtgtagggcaggctctgttatagcttgtgcatgacattcctgatgtgctgactcacctaactggcatgtggcagtgactggcccacagtttctccagctccccacatctcctcctccagcttttccaaatcctggggcaggtgcatgtgcagctccttggggaaggctcctgcttattctgcagattgtcttgcatcatcaagattggtgcttgtgagagagagataggtgcagctctagtttgtccccagtctctgtcactttacagccgccttccctcccaactgtcagaacagctgactgcaggcccagtgtcagacgcagaagcagcagatttacacagacggcatgactagtgcctctcattcccta

SEQ ID NO: 8187 - DNA, 1063 bp, Homo sapiens
gctttttgaactatggtgtactgcgtttagtgtcttaagagcttaaggaaggagaaagaaaagaatgaccataagattccttctataggaggtaatgattctgcagttaagttgcttcattgaccctaagatactcacatcctgttccttagaccctgcatactcataggtagtttcatgtcttccttttctcattctgtaaggctaacctaagcaatttaaagatctcttgtcaagggaggaaagtgttacccagtaaaacagagttctgaaaagggagcctatctgaattagcaaaaagtcttaaagaataattggaaagaaattatttcaatttttttcatgccaaatgtccaataaagggctgtgcttcaaaataaattttagaaattagcctgtcagaataccagccttaagctactttagtcgtcagcataagttctatttgcacattttttattttattgaacattttaaccatgctgagaaatagttttttcccagaagtcaaataccttgaaaatttctgaccgtaatcattggattagaaagatgcttttactaaatgataatatgataatacaaaggtgaatcactctctgtgaatctagttgaaaaacatacattctaaagcaccaaatacattttattattgtatccactttattctatgcctttttaagagagcttcatgtttggtcaattactggttaacacctttgagtttgtgtttatccattggtcattatgatttaggacatttttattataaagagaggcaggatatgtgggccttcagtatggagaaagaggtaagcagatcttaaaatgtgtctgcatcacagtcaggcagaggcttaagagtttcatgttttcttgccctcttgcttttctcccctgaaaccatcttatctgaaagtggcgctgcttgtctgaattgagctttttcatccatattcacactttttcaattaattactttcaggaaggtgaatatcctcctaacagttgcaattagacaaggtagtcagcctcaaagatgatttttcattttatctagtta

SEQ ID NO: 8188 - DNA, 1025 bp, Homo sapiens
aaatcaacatatgtatagattccatataattgagtaactcctctctggtaaattataaagtcaaagatatactgatttatttcctagggacttataagaaagcaagaaacacttttaatgcttaattataaggattaattaaaattaacattcctgtcaccaacatatgcaaagcaagggtgttttttttgtttgtttgtttgtttgtttttaagaaaaaagaagaaaaagaaaggaaaagataatcagggcttgggaaagcctaatttattctgtttctattttaataatagctacaaaatgtgtcctgttaattatgtctaataagtatataccatctaatcctagtatcttaaatctcacagtgaatgtgaacgttatgaattccgattggttataatttagatcagaattatgctcatcatgtccctttatgctataagaggtaaagggctgaccaggcacattaagtgcaaacctcttttttgctttcatgctcttctgttgattaagattaaatctgataatgttaaaatatagtaagatattttattcactgattcaggccaatcagtgggtgggtatcaaagagagaaaattctaaattatagaatttttttttttttttagatgtagtcttgctgtcgcccaggctggagtacaatggcacgatcttagctcactgcaacctccgccacccaagttcaagcgattctcttgcctcagcctcccgagtagctgtgattacaggtgcctgccaccatgcccagctaatttttgtagttttagtagagacgcggtttcactatgttggtcaggctggtcttgaactcctgacctcaggtgatccacccacctcagcctcccaaagtgctgggattacagggatgagccaccacgctcagcctaaattatagactttttaaaagaaactcttttactttgagacagctataatacctggcaatagaataattaagtgttgcccagggtcagaaaaacaagaatgatttgtattttaatca

SEQ ID NO: 8189 - DNA, 1886 bp, Homo sapiens
tcattctaggctcctagctaagagatctcattcagatccaaagcaagtaccatgtacaaagagaattacttcccctaaactggtttggtaatcaggttcttctacacaaataattgatctggatgatacagactctgcgtcaggagacaatcagtctttcaagattaaatacatcgatcatccctcttaatggttcatgagcagcccaagaagatactagatctttcagagactacttagaagggcacgtttttacaaccttcttttctagtcttcagttaaagatgtgcctaatattgctctatcctgaaaatgaaaacatactatgtaaagagttatctgtatagacttgcttcagagtggcactttgattgtcaaagagttaatcctgctattgaatgtgtttcagacagatctagtggaggatcaatttgttttataacaatggcagctcttttttgaaattagtctacagttttgctttagttctcttgccaggatgtcagctagtttgtcacttaaagaaaaggaagaggtgagacaaatcagatcagccgaatattgtaatcatggttaattaaacctctgatttcctgtcctatcaagagagaaagaaccccttttttgtaactctagctgtcttagcttaaaaggtgaaacctggacaaatgaagttggaattcaatttggatctatttttgccaactggtattttcttcctctcttgcattctctcattgctactattaacttttttttctcttctggaatgaatggccttctttgctgatttacagttttatctaatttcactgtgtttaaaagcacattttctcctgtagtcatgtgtttcctttcttttgactagagtcatttgaacagttctaacagaaagatgatctatattcattctccatctttcctattaaatttgtttaacacctaatttgacatcaacaatctggctacatttgaaccaatatccagacacaaaagcaatttggctgagacaagttagtttctgataaatgcttcagtgtgtgtgtatagatttttctcctttaccattttacacagataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttgttcaatgactgcttaagagacacattccagtttaatttatctacttaaagctctaatacaaatactgtggactgctgtattaacttctaaactttgaaacctaatgctcgattattcggttcttgacattctttagctaaataaaataactgatgccgtgtattttcatattgacagtaatttaccaaataagagcacctttctggaaaaatctgtttcttaagtataattagactatccagattgaatctgagaattctgtgtatgtataggtaattatttacccagactggcacacttcattcatttaatgtttaaaccttttaatgactaaaagaattttaacttaatgtagttacatgtaagctttaacagtttgtatcatttgtcagaatcccctgaaactggcctagcttccaggaatgagaagggttattttcagtgctgtgtctggctggctttgacttattagtaagtactctgttacactaaccacattctcttactttatagacttggcctgtcaaagcactttgaagtcgggtcagcaattaataagtaaagtatttcctttgctttt

SEQ ID NO: 8190 - DNA, 1086 bp, Homo sapiens
taaagcactctggtaaaagcattgagtaggctactatgtcttactattaatctttgaattactcatgcctagtacaaaacctggcatatagttagtctagaacatttactgaatgctgtggaaaaataccaagatttgttttgaaattccttaatttctaaccattgcaattcagtagaatagctgctgtattaaataattcaaaaatatttagactaattttttggacttagagcccttgtgaacatcatatacagaatttagacacagagataccgttagcctaggaagaccaacttttcagcatttttcagagcttcagagatgaatgttcattatgtactttattttgttcacttagagtgcatttttagaaagaattaaactttttaaaaatactgtcttcatctttggtgttcatactaccttcatctttggtgtctaataatacacatgaaataatactttctatattgtacctaacaatgaactgggcaacaatatatctattaaatggaaaatctttagaaacaccaggggatacttaaatcaaaagatttattcattcagttctagaaggcttaacgggaatgtgcgagttagattactatacgggcatatgtgtaagtctctgttggaaggtcggtaatttaagaagtcaggtacattccctttataatagcttcaatattcacttcagatatttttggttaattttatactagaattttgaaacctatgcagaagaaccatgtaggccttttttccttctaaaagcattcagtgctttctaatccacaatgaaaattgattataatttattttttaattgatccaaaattaagaagtatttcattctttttagtgaatatcagagtagcctgtagccaaagccatctttattatgaatagaggaggcagacactggaaatatataaggttcaaatctgaatgccttctattaatacttattatctgctgtgtgtgtacccagccctatcctaggaaacaataagaaatacagaagaaaagaaaccatgctttttgtcttcagagaactcagattccccttggagggataggtgc

SEQ ID NO: 8191 - DNA, 1035 bp, Homo sapiens
gaatggaaccaagttggaaaacacttttcaggatattatccaggagaacttccccaacccagcaagacaggccaacattcaaattcagaaaacacagaaaacaccacaaagatactcctcgagaagagcaaccccaagacacataatcatcagattgaccaaggttgaaatgaaggaaaaaatgttaagggcggccagagagaaaggttgggttacccacaaagggaagcccagcagactaacggtggatcactctgcagaaaccctacaaaccagaagagagtgggggccaatattcaacattcttaaagacaagaattttcaacctagaatttcatatccagccaaactaagcttcataagcgaaggagaaataaaatcctttacagacagacaaatgccgagagattttgtcaccgccagccctgccttttaagagttcctgaaggaagcactaaacatggaaaggaaagactggtaccagctactgcaaaaacataccaaattgtaaagactaatgacactatgaagagactgcataacctaatagcaaaatagccagctagcatcataatgacaggatcaaattcacacataacaatattaaccttaaatgtaaatgggataaatgcccccaattaaaagacacagactggcaaattggataaagagtcaagacccatcggtgtgctgtattcaggagacccatctcacgtgtaaagacacataggcttaaaataaagggatggaggcatatttactaagtaactggaaagcaaaaaaaaagcaggggttgcaatcctactctctgataaaacagacttaaaaccaacaaagatgaaaagagataaagaagggcattacataacggtaaaggtattaatgcaacaagaagagctaactatcctaaatatatatgcacccaatacaggagcactcagattcataaaacaagttcttagagacatataaagagataaagactcccacacaataatagtgggagactttaacaccccactgtcaatattagat

SEQ ID NO: 8192 - DNA, 1030 bp, Homo sapiens
tttttgtagaggcggggttttgctgtgttggccaggctggtcttgaactcctgacctcaagtgatctgcccacctcggcctaccaaagtgttgagattacaggcgtgagccaccacgcccagcctgtaaatgtaattattttcagaactatatctttacatgtacacattcacctattttatggactagttttcaaggattattttgggatgtggcttcaataaaattgtctattcttgtttaagtggtcctggtatactaataaaacttctggacattggtgatataatctcataaatattcgccaatttaaatttggattttaggactttggtgccaccatcacagtagccattctgaaccctttcgatcaccataggagaaaacaaggcatgtgctttaccatgttaattgtctgtttctggggtgttctttgccctagtggttagaatcatacatttctggaattaaggaccagattatctgggatgttcttggaaccactggtttcggattttttatttctgtttctagattattcatagaaataggaagctctgtttttttgtttttttttctttcttaaaagaaaaactgagggttttttttttttggtagataaatccataaagcaaaagttcaaattgtgaccaggctgggcaaaatagcaagaccccatctctacaagaaatttaaaaatttagctgggcatggtagtatgtgcctgtagttccagctgctcaggaggctgaggtgagaggatcattttgagccctggagttcaaaactgcagtgagctatgatggtgccactgcactccagcctaagtgacagaacaagaccctgtctcttaaaaaaagaaaatcaacctgatgattcactgacgttctggtgccagtcaagaagccagccctggggtgagcagcagttttagacttacttcagatgttctgctctgtcattgatcttaggccattctttttcttctcacttcatgtgttcaaaactttatattctcaactgtagggat

SEQ ID NO: 8193 - DNA, 1070 bp, Homo sapiens
agttaaatcacaatcttgaagcaggaggggcgaggcatctatatgatttaaaagccccgcaggtgattttaatgtgtagccaggattgacaagtacagctctcagaagtgcttttacttctttgccacctttctttactgcaacaaattgtttgcagtagatctttagccccttttctcctccctttatttggtggaggatagaagtaccctggaaatttttcctgtctgccatgcaggacacttcctttgtcataaacacagaatttgaggtactttgctgtatgagtaataataaccatagctaacatgttttaaacagttaataagcccaaatactcttttatatgttaactcatttactcttaataacaacactatgagagatgtataattattattcctattttccagatgaggaacctgagactcagagagattaactgatttgcccaaggtcccctagccagtaagtgctcggctgtcattaggatgtactttttaattactgtcctatataaccttatagtacagtgaaatatactgtacctgtaaatctgagagatgaagtcttctcgagctctcaagctgcagctatctttcatatgctgagaattggtcagattcatctgttcttttttttttttgagacagagtcttgctctgttacccaggctggagtgcagtggtatgatctcggctcactgcaacctccgcctcctgggttcaagtgatcctcccacctcaagcctccagagtagctaggattacaggcgtgtgctgccatacctggctaattttttttgtatttttagaagagatgcggtttcaccatgttggccaggcaggttttgaactcttgacctcaagtgattcccccccaccttggcctcccaacatgttgggattacaggcgtgagccactgcgcccggccagattaatctctttagcattggcaaattcaggatttggaggatgtctctgatggaatcacttgagctgtgcaagctcagtttttaaaattttcagactgcaagccagttctgaaacaaaaaggcagctttctctgc

SEQ ID NO: 8194 - DNA, 1034 bp, Homo sapiens
gtacatttgttagaattgttgagccagaattgatatattattattaactaaaatccataatttacattagggctcactttttgtcttgtacgttctatgggtttggacaaatatatagcacatgtattcaccattatagtacagaatagtaccactggtctaaaaatgtgtgctctacctgttcagcccttcctctttaactacaaatccttggcacccacggtttttttttttgtttgtttgtttttttgagacggagtctcgctgttaccagattggagtgcagtggcatgatcttggctcactgcaacctccgcctcctcggttcaagtgattctcctgcctcagcctccctggtagctgggactacaggcacatgcccccactcctggctaatttttgtttttttagtagagacggggtttcactatgttggccatgatggtctcgatctcctgaccttgtgatccgcccaccaaggcctcccaaagtgctgagattacaggtgtgagccactgcgtctgacctcccactgatctttttattgtctccatagtttcgccttttctagaatgtcatataattggaatcatatgtatgtagcctttttagattgacttttcacttagctatatacagtttttttccttgtctttttttgtgacttcatagttcacttgctacttcttagcaccaactaattcttaacaccggatactgttccgttatctggatgtaccacagtttatttatccattcacctattgaagaacgtcttgtttgttcccaagttttggcaattaggaatcaagttgtataaacattagggtggtggtaacgtatggaaggaagggaagtgttctgtagttctgtgattagatcatagttttatcattagctcttagtgaccctgtgtccctaggatgtgacctttacgagttcttctcagttttgttttatttacctcttagatgagacaagaaggctagtgggggctggcgttgggtatttgccttccaccaagtctgttaggc

SEQ ID NO: 8195 - DNA, 1052 bp, Homo sapiens
aacgggacacatgctcctatccacacttgcagttggtctaaccttcagccagaatgtattcataagtagcatttggcaaccctttatagtttacaaatagcattttacatacaccattctactattcctcatggtggctttgggaggtccagctccgttttaaagactcacacaggactgaagcaaataacttgctcaaagccacatagctgctcagaacccaagattgtaagctccccctagggccagaggcctctttctttcagtttttttctttcgtccccctttgacccctctttccttcttccctttctcccctccttcctcctttccttctttttgtgcccacagtgtctggatcatggtacctgaattctttagcctatttgcacccacatctgctaatgtccatatctagccatctattacaccagctgctgaggatttacttggtgccctcatcaagaagtttgaatttctccctccttcctttttttttcctgccactgtcccaactctttccctctacgtctctctagaatgacatctttaaaccccttacactctttggtcttacacatccttaaaaatgattatttataaattgaattataatatccatgaggtaaacactcatagggtaaagtacacaaagcttaactatacaagttgatgatttacacacacacacacacacacacacacacaccccttcttgaatggctccaaggatacccttttaacttcttcccttcagccacataagccatatgatgacacacagtgtctttctcctgtttgaaaagaaattgtgtcatattggtgtgctgttcttgcatagaaagccttttttaagaagtctttttaagatttcttgaaggattttagaaatcatatatctcttctaaccccctgaaatcctgagtttaagtggcttgattaaatggctgatcaaaacttaaaaacacactaggtcaatgtttttcaagatacaactgaggaccagctgcttcagaatcatctggggactggctaaaattccaggttcctaa

SEQ ID NO: 8196 - DNA, 1953 bp, Homo sapiens
gtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaagctttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgtt

SEQ ID NO: 8197 - DNA, 1047 bp, Homo sapiens
catcgttgtaatcttgagacacagggttggatagaagagcaagtggtatcaggagaccaacaggaccatgagaagaaaagaggaatgattgggccgggaagttgcctaaaagtagtgagcagacaggattgtaagaggtgaaaaataggagcttgtgatcagagactaattgaaaatgaaagatctttgatgtggacaagttccaagtgatgaccgagtctaaagcctgatcttcccagacagctgaagtaagagaggacacaggttgaggaaacctgaagtcaagttatgagaaaggggtggtgttacttagatttatttaggatggccctaagatctttggaaaacaaagagccttctcattctttctctaagttctacataaagggatagcttgggcaagtgctgttttagagagtgtgggaagagtgacaggaaacaagtagcacctttaagtgctaacacacctagaatatctatagaagcatacactagaagctactaaggtcagggaagggacagtatggctgggagacagaggtggaaagaatattttttactgtacatctttttatacctttatacctttcaaattttaaactacgtgtaacaattaaaaaataagaaaaataaaaacaacgtagatattacagatgcagatagtaaccagcttgtttaactttaaagcagtttatcccttacttgttctttctggttttgaaaaagatgaatgtgatgggtacggttgataaaaagaatctgtaaaagtacgttattcatagtatagtattttgctacattattttcaagcactgctctcttaatttgaatctttcatcatatgtcttgtaatccctggagtattttagaatttccttcagtggaatcacagctttccctcactctaagtctgatttagccattaatagaatcctttaaatagatctctctctgttcacttcttcagttcaaactgagagatgtcatctaacctaagaagagatagaaagcaattaggagttagcatcctggcactctttttgggat

SEQ ID NO: 8198 - DNA, 1049 bp, Homo sapiens
agggcagggagagtatcctcctcaatcatgagatagtggtattgttgttgttgtttaagattgtgttctcaaataatgacttgagaatatcagcaagcttattaagagctgttataaggaggatggagatcagtagctgctgcccatgtcaactgaggataaaatatggacaagcatttatatttcatcaggaatatttaagataagaaataaagaactttttaggaataaagaatattaatatcatagcatggatgttagtgcttccagatagttgtaattaataacagaaagttttaaagcatttaggaagtagttcatgatacttcactatttgacatctctagtttcacccatttgcattttgctgtaaatgtgaagttctataatatactaattgaaggtactttaaaatgaataagctaaaagtaagactagttaaaatttttgtttttgccttcaaacaggtaagtggaaaggggtagaaacagcaacacttaattcgtatgtcttattaaacccgtctttgtagtattttcattagttattgtgtatttctcaacttaaatattgaacatgagtagagtttaaagtcgatttgggaacagccgtgtttcccatttgtaagcatgttggtttacattgatattggattgtactagagaaataggtggttatatttgaaaattgtttgtgtataaacaatatgccctatgctggaagagataaggatgttttattaactactgtaaataagactacttctggataattcattatattttttaaaggttatctagtaattcttagagtatggacagatgacttttttcctaaatgaatgattgtgaattatcttttgtaagttgatcaatactgagagtgttgtcagaagtttaagtaggaggccattaagcaaaaggaagtatcatgaagcagatttttaatttttgtgatgatacactcatttgtttgcagaaacttgcatattttaacaaaatcaacctgtgtaagataagttatatatgtttagaaattggtatgggcaa

SEQ ID NO: 8199 - DNA, 1028 bp, Homo sapiens
tggtgcattatagtattttatttctggcattactaaacacatcaaaaacatttcttactctatgtgtatagtttaatgtaacctaaataaaatgactaggtataatctaaaattttacttgccttacttccctttcagttttggagagttttagaagtcttgctgaatgaaattgaatgcacctacaagcccacctctgtcatgtattgttgaatgtacatacaaagagtataaaagagcttcctaaagaactgtgatttcaagtaagaatatttgagacagacaaacttacaaatacgttaggccagatgcctcagagttggcattttggtgtgtttttttaaggccagattccttgcagatagcattttggtgctcctatttaaccatttgccatttacagtcttaatcttatcaaaaggaagagaaagattaaagcaaataaagcctttttgaaaatgtcagtttttatgaaaactcaggtttagttcaatttgataatacttgtgaatacagtagggactcaatgaaattttaaccatatataacattctatagtttggcttctttaaatgcctttgagctttaatagtaaatcctatggaacatttcttctcttaaagttcatcttgattaaaaatgagggatgtagttctctgtcttaggttttctaagtatgtttactatgattctaagatgctggggaaagaataggaagttatgttaaaatatacaaacataaactctccagatcaaatcagtggaaggcactatgagtatgagaacaggaaactgagtatgaggtgtaaggcattgtatcatctttcccttcaaggaaaattcgtagtagggaaatcagagcaacagtactgtgagtatcagtagtactgtgaggttccaatgagggagaagtaacattcttttgggaaaacaagaaaagaatatattaaggcggtgacatttgaaccaaacctcatagtatgtataggattttgagatggcagagaggccagttcaagatgaggaca

SEQ ID NO: 8200 - DNA, 1066 bp, Homo sapiens
actttgaattggtcataacttgccattgctattggcattttcaatatcctttattatatttgcaaagatatgagattagacagttctaatattttatagcaaaaattggtaagactttaatcttgtcattattttagatcttagtatatgtcataagtagtgttgaggaaagaattctaggttattaattatatctgatgttgaaaatgtcagcaaagtgtctacaggcattaaattacgaatgtctgaatttaatattcctagggaggagaattattagttccttaagacaaaacatcagggagtaggattcaataatttgtaatacattacaaatatgggtagaaaatagaacatcattaaaacaattatgctaaattatttgatgagtttaggatgctatctttgtataaatacaatctctagatttaaacagtatttaatgttgaaatttgttcagtcaagttagtcactaattataatgaatatacagaataaaagaaacttaattcctgtcatacttttaatgtgccttgagtttttaaaggagtataatactgtaatctaggaacatagcttcctccttcatcttcgttagcatggagtttttgccctgatggttgcaagatgtctaatgcatccttaggattttacctttcaagaaaaagggtgtggtctaaagctggccaaaagcacatgtcagccatgtcctttttaaaactttcctggaagttcctcccagggatttccagttatatctcattggccagaagtgagtcctatggcctcctcagcagcaagaaagtacagtatgagaagccattttaatttttctgcctttgtagaagtagaaggcaagggagaaacggagttatgaatggcttttatgtagccagtccacaagaaaacaaatctatttgatgaccttttcattttttatttttttagagacagggtctcgctctgtcacccaggctagagtgcagtggcacaatcatggcttactacagcctccaactcctgggatcaagttaaccctcccacctcagcttccacctcccgagta

SEQ ID NO: 8201 - DNA, 1030 bp, Homo sapiens
ttttattgttaagaatgttattaatatgtatggttatttttcacaattaatgatgtttttgaatttatttggttttaaggtacccttttaatgttttctgttatcaaatatctgtatcaaataaagagcagtcttacattttattggtttataatcttgtcacaatatattgatttataatcataataaaccaatcatttattattacatctttttaaaaaaatctttgaaactttaaatgtaaccttaccacagaaaaatgattcattatttattgttacgcttacttattttttctttcaattgttttattgagatataattaatataccatgcaattcacccatttaaaatatacaagtaactgatttttaataaatttacagggctgtataaccaccgtcagagtttaattttagaatattttcatccccctcaaagaaactccataaccattatcagtaatgcccattttcctctagtactcctcctgcaaccctaaataactttctatctgtataaatttgcctattcaagatattttatatgaatggaatcatacaatatgtagtcttttgtggctggcttatttcacttagaagtttttcaaggttcattcatagtgtatgtagcatgtattaatacttcatttattgccgaataatatttcattatatggatatgacacattttatttatcccactcatcatttgatggatatttggcttgtttccactttttggctattaggtatgaataatgctgctgtgaacatttgcatgcatgtatgaatgtatgctttcatttctcttgcttacacacctaggagtgaaattactgagctatgtgttaactctatgttaactttttaggtaactgtcaaattgttttccaaagtgactatatcattttacattcccatcagcgatgtatgagcattctaatttctccatatcctcagcaatacttgttattgtctcttttattatagccaatctagtgggtataaagtcattttgatttgccctt

SEQ ID NO: 8202 - DNA, 1111 bp, Homo sapiens
caaattttgctcacaaaagtgaactttaccacactgccataagctatagattaaaagaaaaaaaagtttctttaaatctggaaaacaaaacactgaagaatcagcaatatttcaaataaaaagtcataaaaaattattctcatcagtttattcagttccgtgtaatttattcttattctgccagatcttggttagcagtttcatgaagccatcagtttcttcattagagttttataaattcttatccaggccaatggtatgatcttaaagttatcagaaacttgtattccagagtacttataatgaatcttgacgaataagcaattttggactgtaactgactgcacatgcttttagggaagaaccaaaaccattgtctgtggatgaccaagagttagaaatggccatggctaaaaatctgatgagagttcattataatcagcaattgacaaagaaatttggttattgctatggcattgtaacatttaacataataaccaaaaatcatgactgataactattagatttctaggaatctcttacaaattttggaataatttggaagtcatttgtttcttattttgctctaaggtcctcttgaaatgttctgctatgattactagtttagctcagtcctgtagcctcttgtcttttttttttttttttttttttttttgagatggagtcttgctcacgctggaccatcttggctcactgcaacctcagcctcccgcgttcaagcagttctcctctctcagcctcttgagtggctgagattacaggtgtgcactaccacatctggctaatttttgtatttttagtagagacagggtttcaccatgttggccaggctggtctcaaactcctgggctcaagtgatccaccctccttggccccccaaagtgctgggattacgggcgagagctactgctccctgcctgtcttttgtcttttttatgagcctgcatcaagttgggggaagctggaatgccttaccaaaagggcttccaagtgaattttcaagtcagtaacagcttcatatttctctagcacgcaggtctggatgatagaccacatagtgcaaatggaaaaacactttaggaatgccttt

SEQ ID NO: 8203 - DNA, 1050 bp, Homo sapiens
tctttagctttaatggaggagtatgagttgtgttttaaattaaaagttttttaaaacctacagtttataactcagcacaaacttctccataaaaacaacaatattagtgatgagcatatgaatgcctggataattcataggtaactgaggtgttatatagttggactttggaattagactagcttgaattctggttttgccattcactttgtaaaattgaacaaacttgttaaccttcctaagcttcattcttttcatctggagagaggagccaataatattgccctcttcagggttgtgagcattaaataagataatgcatgtaaaaagcacttagcatactgcctggcaaatagtaaacatctctaatgaatatctctgctgtgttaattgttattgatgttgctattacagtcatctttatcatgtactaatcactgtctgtaatagtcagctctctgtattcgtgggctccacatccatgggttccacatccatggattcaaacaactgtggattgaaaatattttttaaaaatttaatctgcgctgaacatgtacagacttttttccttgtcattattctctgaacaatatagtcttaacaactatttacatagcatttacattgtattaggtattataagtaatctggagatgattcaaaacatatgggagaatgtgtataatgcagatactgggccattttatattagagacttgagcatcctgggattttggtatccttgggaagtactggaaccaatcccccatggatgccaaggggactgtatattatttccatggaacatgcattctgaattttgatcttgtaccgtaggaacactcttcccatctggttcacagtctctctcctgccccacctaaacttcatggcctacttgctgcctctaggcttttcttttctttgttctctcttgccttatcaatgggggcataccaaaaaaccaagacttatgggtgccatagcgaaggcaccatttgctgccagttatgggggagtgtggtaagctttggttttgtagagcac

SEQ ID NO: 8204 - DNA, 1052 bp, Homo sapiens
gcttgacctcctgacattggttgggaatgttaaaggcgcactgggttgctctttctgaacagggactgggcaggcttctgtgtaaacttggccagtcccttcccctctctgggcctcagctcccccatctgtcaacacggagcggtggactagatgttctctgaggtctatcaggtcaccagggcacaactcacagattcctcccctccaggggtgagggtgagcttcggagcaccgaactgggtccttgggctagtgacaacctctcttgtgtcatctgtgagttggggatgagaagagggtgaacttcagaactctgcactgagaatgaatgagatagtgcaggtaaacgtatccagcacatgcctggtacacaggaagcactcaataaatgctagctcttgtagtcactgtggtagttactaggttgatcagctggcatggattgttctgggcctgtagactcagattctcaagcaatttctgcctcagagcctcctgctaaacggacacacttaaacgctgaatttgatggaaggcaggttcaccttgcacttggcttttaaagggctccttaccactgcaactcaattccatgactggatggataacagaagcacccgggaggagggcagcttggcaggagcccacaggaagattcaaggtttcataacaaagcatcttctggtgtgtcaagagtaagactaggccgggcgtggtggctcacgcctgtaatcccaacactttgggaggccaaggcgggtggatcacctgaggtcagcagttcaagaccagcctggccaacatggtgaaaccccctctctactaaaaatacaaaaaattagctgagtgtggtggcaggcgcctataatcccagctactcaggaggctgaggcaggagaatcgcttgaacccgggaggcagaggttgcagtgagccaacatcagaccactgcactccagcctgggcagcaagagcaaaactcaaaaaagtctcaaaaaaaaaaaaagtaagactagaaacgtccacgaccccagcggtgtgttaggggc

SEQ ID NO: 8205 - DNA, 1099 bp, Homo sapiens
ctcactctgtcgcccaggctggagtgcagtggcccgatcttggctcactgcaacctgcgcctcccgggttcacgccattctcctgcctcagcctcccgagtagctgggactacaggcacccgccaccatgcccagctaatttttttgtatttttagtagagacggggtttcaccgtgttagccaggttggtctcaatctcctgacctcatgatccacccgcctcagcctcccaaagtgctgggattacaggcttgagccaccgcgtctggcccaaaaagttttattttaaacagctttattaagatataattcacatcccatacaagtcattcaaagtgtatataatggaatggttttgagtatattcacagatatgtgccaccatcgccacagtccattttcgaacatttccctcatctcaaaaagaaatcccataccctttagctgttacttccccgtcctcccacccctaccagccctaagaaatcatgattctgctttttgtctctgtagatttgcctattctagatatttcatataaatgaaatcatacaatagatggcctatgtgtctggcttctttcattcaacgtaatgtcttccacgttcgtccacatggtactgtgtatcagcgcttcatttatttttatgggtgaataatattccatctcattgatagaccacattttcttcatccattcatcagctgatggagattgtggagataatattttcttggtactttgtgccagtccctgttctaagtgctttatctcattgaatcctcacaacaaccttgtgagttaggtgctttttgttactgctattttacagagaaggaaataggagatgttatctaacttgtccaaaatcacacatctagtgaagatctggttggccactgagtgtaattcccagaggcacacagtcctcttttgagttgtgtcttcagggtaatgcatatgcacctcagcctgctcgtttatccgtaagtggaatcagaaatggcacagggaggggcgaggcatggtggctcccacctgtaatcccagcactgtgggaggccgaggtgggtggatgacccgaggtcaggagttcg

SEQ ID NO: 8206 - DNA, 1023 bp, Homo sapiens
gtgaggttgagcattttttgtatgttcatatttctttttctataaaaagctttgcttctatcttcccaatttttctattggaatgataatctttctcttatctgaaaacagcactttatatagtaaagctcttaatctattgtttatcatacaagttgcatttttttcctagtttgtcctttgctcatagtatgtttctcataccaaagatttaaatatttatgccggcaaaattgttggttttatcctttatggagtctgaggcttatctctcttcaagaaagtctttctcattctcaagattatgggattattgtttttagtcctttaaataacttttataattttttaaaatgtgtacgtctttaatacatctggactttttttctgtgaatgtaacttgaagtgaagacccacttttttttcttaatggataactaattattccaacatcatctgcagaacaatatagcccttctccattaacaggaaatacagcctttatcgcatactagattcttatattttattctatttattctattctgcattctattttgttcattaacatatttgatattcctacaaaattagcatactgcttaatgaccctgactttgtaatatcttttaaaatccagtagggcaaagctgctctcatctttcttcacctaggaaaactattctcatgcatctgttctcctagataatatttagaatcaacttgccagttattttaatcagaaccattattggaattgtatcaaatgtatgaattaatttgggaaagagttgaaatcttcacaatatttggtcattccaaccagaaacacaataatttatttagattttctttgatgtacttcattatttgcttctaaataggtcttggatgtttcttgcatgaattagtcattgcattttcagttttgtggatgatttatgctttgttttgttttgttttgctatagtgaatggaataatttctcattttatattttaacctgtttactattatatgaga

SEQ ID NO: 8207 - DNA, 1024 bp, Homo sapiens
tattctgtgttagcaccagcgttccttatttctaccctgttctctgagtctccatgatcctggtttaaagggcagctgcccgggtgtgctgaaagcgagatagactatatttcatttctcatctgctgccaggacatctcacatgagagataattcatttctatcactgatggcaccagtcccacgtactgtgctgagctcccattacgaggatttatttcatctcgtcctcccagaaatccattgaagtctattcccattttccatatgagaaaacggaggctctaagatgttaagacgttcatccaaggtcacacacacagctagtaaatgaggacgtctggattccaacccgggtctttctgactctaaaagcttttctttctccccgcttccctacatctgatttcatatcaaaatgcccacctttccccaaagaggaagccactgggtgaggaaggagacaacactttgctctttagtcctccaaaaagtcaatgaccataggataaagagtctggatcccacatcccctccagagcatttattccgactctgaaagagacaacagactactggcacatggacagcgtggatggtttacaaatagcctgaccatacctcacttcagtcacctctcctaccagccctgtgaggtggacactgtcattattaccccacttagagaggcaggaatggactcaacgaggttgcacaagttgctcactccccatccattgtgcgcagagccctggctgtcccattccaagtctcccagctttgtagattaccacatatgggaccatttaaccaatgaagttagaccttgcattgtgttgtgaaattgctaagttttctctttttcatgttttaagtattcctgcacatattatttcaggacccaactttttctgcatttattgcctctctgagactcataccttttccatgtatgtacccatttgtactgcgaagccatcaaggaaacagaacaaggagttgccccttatctgtggtcagatga

SEQ ID NO: 8208 - DNA, 1064 bp, Homo sapiens
acaaagagtttttgaagtcttctgaggttctcaagaaaaagtatgttaattctggaagtacaccttggattcttagagcaatgaaatatcactttccattgggcaggaaagaagaagaaagctggatgatgccaagtgttggtggggatataggaatataggcgccttcctacactgctggtgagatgggaaggcagcgctgtgcacagtacgcaccttatggcccagcaatcctgtatttcgaggtataccccagacagatgcttagacaggttcctaaaggactggtacaagtttttcatagtaggacctggaagcaactggggagagtgggcaggtaaaacacagtccaggcataccctgtacacatacacacacacacacacacacccctccagataaaatgacttgaaaaaagtcctagccacaaaaaaaagggaaaaagttgaatgagatttctagaatagcacagtttatgtaaattaacaatatttgcatacgaaatgacagtatgcattttacaaggacacatacaaacaaaagatcccagtcaactggaatggttgcatatggcagggcaggcacatgatgggagtagaaatgatgatagaaggaaataaataaaatgtaattaaaaagtacaaaaaagggacgccatgcagagaacgatgctaatagtgtactatgaatgtggtaggatggattcaaatctctacatttcaagtgctgtccctcccccaaatgtataatacacacacacacacacacacacacacacacacacacagaaggtgttgcaagatagtgacacatgggcaaaatcaggccctcagatatgttttgtttggtctatgcagtacataaaagtggcttgaattagttgccaatacttaaaatgcaggtcttcagctactctaagaagatccaacaagcttgggctgaagacagcaatccccatttgtgcttggcggcttgccccatccctaaagagcctgaagtctgctggtcaccatagtccttatcctttctgccctgaaaaaggaggaggataggctcacactttc

SEQ ID NO: 8209 - DNA, 1035 bp, Homo sapiens
catattttacagttgttgttttgtgcatggaataaaaaggttcttaggacactaatgctttgtgaaggttttaaaggctaatacctttaagtgctgggtaaaaattaaacttgaatagcaccgatgaaatatttactcatcagatggctttgaagtttagcgtcttttggttgcagtcccatctaatggacatgtttcaaagaagaaaatagttatagcattcagctgtgatgttttcttctctgcatgggagaaatctgtgttgttttgattcgtttcagtatttaaattttcaagactagctacttagaaatcacattaacgagagaaatgtttcccacaattctgaatttattcttattgatagggtaatgtttgaaagctgagttttctaacacttatggcatttttaaacagattgctttaactcttttattctataatctttccaacctaaatttacttaattctccctagttttatatcagagggcctaaggtgagtgactgtgtgtaaatataatgggaaatctctcacacaaattagttttgcaaaatatcttgctggataaaagtgctatgtttaaagttgtttagaaacttcctatttcattcttcagttctgataactaaaaagttttccttcaaagtttgaaattgtaatgatgctttaagaatgttggggaaatactggatttttttctacttcttggattaaatttcactcctctgaataatgtagggctttagaaatttgtattacaatgttggttaaaatttttctatttttatgtttcctcccacatgagttatgacacttttaacatttgtttgtgttttattagttttcatatgagtccaacaagcaatgaagacctcaggaaaatcccggtaagttgctgaaggggttagagggttgtcaaagagtaagctggtctttttctctggcacacatttctaaaaatgcctttgtcttcttgccttctgcctcacttacctaagaattgtagcttagcgtagtaattttaggagaaag

SEQ ID NO: 8210 - DNA, 1057 bp, Homo sapiens
gtttacattgtcttataaaagcactcttaaccagttttaatagatctttgttcttatgtagggtttttttttttaatctttgcaagcactgtacactttttactctgaatagtttctcctccttaggtattcttgttccaaaagaatatatatgtttaagaaagagaaacaaacaaaaacaaaaaaacaaaaaaaacccactttgatctctgccacatgccgtagtgattactgtggtgaacagtttttttgctctaatgattgagttattttctggccgatatatggaaggttagtccatagcacaaattaaaggacagtttcaagacctcactgatttatttcttatctctttacttattatttattttaactttgaggtaaattaacaagtgatattgtagaagagatactagtgattcctagaaatatttgaaaacatttcaaattttagaattacagtttactggggaaaattctttaatatttggaaatatctcaaagtaaaactgttgatgcttttgcataaaaacttcagaatgttaaggtaagtcattttatttaaaataacttttaaaatactaatttaaaatgtttaaattctgtagtttcattttacatagactcctttttaaatgtgagtgtatctaggtttattttgcacctgattaaaaacaccattttccttaacctgtcagcagctcggctgagcagtcagaccggattattcgatatcttgtctgacatgaggacggcagtccaaagagaaagatatcacaaattggtgccacacttcaataaatagagacattttatttttcaccaagctaattcaatccagttcagttaactcttttttccccattaaggacagatcaaaaaaggcagccatgaatgactgagttcgtcaagtgtttgacacgtcagtgtgtgaatataaagcagaccacaagggaggggttctgcctttagacttcagacaatacccagtacaagagcctctcactcagatctgcactgtggggagctggagagagtggctcagatcactcaggta

SEQ ID NO: 8211 - DNA, 1025 bp, Homo sapiens
tggagctgagaggttaaagagtgaggtgattttagtgaaaatagttttttggtgaccttcgtcaaagaagcaatgagtattggtggtgggagttgtgtttcagattaaagaatatgaatgagtcaaggtaacaaagtcagcaagggctacttggtagggtttagagattggcaaaataaaaatggtagaatgtccaagagataatggactgtcgacgagtcctagtgagtaaatacaggtggattaggagacaactgggatgatagtgggagtgcaccagcaggtctctaggagagagggagtgtcagaggtgagattgatcagatgggattctgattgtatgagattttatggtataagattttattgattactgttcctttggaaacatgttcagagaaattcagtttgtgaaaatgtcttataaattgtaaggcaaaatgtaaatatgaggtggtattattcaaatccaagtcacttgaagtaattacaccattttacatactgcaggagcaatgaatctttaaaaatgcaatcctaaatggaaaataattttgaacacaagtactccagctctgtgaattggaaaagcatattgttaaatgaaggccaggagtttgtgtgtgtgtgtatgtgtaggcagggtgggttgggggaggctagcagtgaattatcatttacaaagtaagaagaggctatgcatattttgaaaaaaaaaagttaaaataagtagttatggagcatacgccagaaattgaagggcaaaggaaagtataggtaattcatatgagtaattatttttctttggttctttctttctttctaatagagaaatagaacaaacctttgtcctaaattattttacattattaagtgaatggtttatggcatttattttatattcatgtatcagttaagaacctaataggaaacaaatgacacactcaaaacgaataattgagggaagtttagtggggaggtgtctgcagggttaaggacatcaagaaggaatagtacagcaccag

SEQ ID NO: 8212 - DNA, 1028 bp, Homo sapiens
attctttcaaaatctctgcctcaatgtcttttaatgttaaaaaaaaatgtccttaggccgtgagcaacacttaatcccatatggaaaacttctagcattgataagaatttttgatgatgagtgattttcaaattacaaaagaaaagattatctgaaaacattttcaaacttgccaaagacctattcattccttcagtatatgttacatcacagagacaatgatcagttttttaaactaaataataagtaaagcccgaaatactgtggctgacagattcttattcagagcttaggttgccttgatgtatagttactttacctaaaaggctatttgtatgtaacagaactcagtatcctctctctattatgtgttacagccaatttttttttcttctctttaaggtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggtaagtgtcacattcttgtgtactcattggtctgaactacccttttagtttttaaagtttaatttctaaatttagtaaatcaaaatagcagttgctttgtagtattttccaaattttgtcattcatcaaatattgagtacctactatacctcaaattggtaagttccttgaaggcagagcttg

SEQ ID NO: 8213 - DNA, 1030 bp, Homo sapiens
ttgcttccttgccagcagtgctcaaaaagagaaaaagaaaatccaaagtccatgtacataaaagttccattcccgatggtggagggcttaattaaagtcctcagatgtttctgtgcaccttggaaaacatttttatgaaattcatatattaccagaagtggctccaacaattcttgcagttaaaaaccttgtaactcatgcagctccatcaggagcaagctgcctttttcaagatttgttttgctgcttcctttacctccgtagcctgtggcagtgacggctgctcaagggccttaactgccaggatggcactagaggattttccaaggttaaggtcagataacagaatctggaagaaatggatccctcttcctgcatttccttttctcattatttcaataaatgcattgaaggcttgtgatgtgtctggcactacagcaggcactgaggatgccacgctgaacaaagcggctggatcttcatggggctcatatcctagagggaaagacataataagcagactctgcagtgtcacacaacatcacctaggaaatatagagatgcaagtgctcaggcgccaggccagacgtgaattcaactgtggtagcaagaccttgtatcttctgatgggacgttgaagtgtgagaaccactggactctcatatggtgataaactttggagaaaaaggacggaggcaggtgtgttgctgatgccagcaaatgttagaatagtgaaactgctacaccctggactatgaagcaagccagatttgaatcccagctctgctacttacaagctgtgtaacctccggcaggctacttaatctctctgtaccttgggttctcctgagaaatggagataataatagtagctatcttatagagatgtgaggattaaaggaactaatgaatatgaaagtgctgagaatagattctcacatatagcaaacaatatacttgttgggagacaattctctggacaattcttgcatttctacacgtcttggaagcaaggcactaagtacccttt

SEQ ID NO: 8214 - DNA, 1029 bp, Homo sapiens
aaagacatgtcaagcgtgccaaaccttgctctcctaagtttgcttctttccttacacgtgtgctcttaacctcctgccatgccttactattggcaagcagatccctagaacttaggctttaacctgttgactttagagtggcttctaggtcatttcttcttttttacaagtctgcctgtctactaatatgcatcaggtgagtacaagggatagaaaaggcaagaaacaccaaagaggtacttcgtttttattgtttaatctgggttcttaatgggtactcttgagctgtccgcattggtgggcattttaaaactaagagcacactaaaagtagaagataccatcacaatgcttatcctggagatgcttgctggggaacagctctgcagccagagcgccgtgcagggcagagtgtaaaactgaaagctggagggctggagaaacagggactgttttaggttgagttaaagaagacttctgggatggggggatttcacggtgaatggatcttgtaggactggcaggtgggtgtaaggggggcacacatagagggccctgcacaggggacacttaagtactgtggtcctggtgctcagccttttcaccttagcacccctgatattcttttttctctcagtgaattaaaagctgttaccgatcatacagagtgcatttatgaagtagtaattagctttcccatgttttattaatcacatctgtgactgccaatcagagcttctgatcagcatgagataactggtgtgaccatactgagttgctgtaattctagcccagagcaaagaaacttgatgtctctgtcagtgtctgcagccttatcaggggtaaattcctgttcagcctactgcaatgctgaaatagcttgaagatcctcattactacctttgtggaccctcgaggggcctcagtttgagaaggatttccatccaggagactggtataactagggtaaagggtctattgggagtcacgggagatatgggtcctgtctttgtattcattatactttgag

SEQ ID NO: 8215 - DNA, 2026 bp, Homo sapiens
ctccccttcccatcttataagttcttgtgcttgcagtttgactattactctgtttcatctctaaggtagccttattttgattcactgagtatagctttcattgtgtataacagcattttattaatctattttggaatagaaaggtacaggtatctcattttaataaagtgaatttgaaagtgtgttgaatggtgccataaactcagtaggatttcagtgttagttgttattacagtggcttcttctatatgaataaactaggagttcttctccctatgaagagctctgtgccgaaaatcatctttaaaattctattcaacaaacgtaatatcttttgtttgttagtaagtagactcttttggcacttggaacttttatttccatagaaagtcttttagaaatagtagcttcatttcttatccagcttggaagtatagttactttcaagtatagtatatactttcaagtaattgtacttgaaagtatagcaaaattataccagtagaatatctgatctccaaattttggagacttgaccatgaaaatgtcaggaaatggtagagaggggcagtacctgtgaggttgggagagactccagtgcgtagataacctttcatggctctaaggatgggggagtatagtgaggagtggctcaagatttaagggagctttcagggactgaaaagcacacaaggcagcagtaaccagtccttagggatgcagaaggtggtggcagtctggtctgaatatctacctcatttggatcagaaacagaaccttctagataactgatacttaagtgcattactagtgatgataaagcattccatgtcctgctgtatgttgaacaagtgtctcttgaatccctttaacaattctggaaatgtgttaccagttgctgttagatgctagctgctctggagtctgtgagatagttccgagtaaagcgtaagacaggcacataagaaaaaccagcagggacatagagtatggctgccctattgttcttagaaatggtatggattttttctcttcgctggtctctttaggatcacaggactcaacaagctggtgtcctattgctgttgcttgtccagtcttccttttggaagatcccagagttgcgtattttgtgatctcttccaagtagcaagtgactgaccaacagaatcccccaagtcagtcagtttcctcagattttgctttgctaaaggaagaaaaggtaagggaaagcctagtcttcagggttaaaatgtggactccatgtgatccgtgcacaactgtccatctttttatctttttctgcttattagtacccccatctgaaacaaggggaattcacagagaagcatttattttactgcaggttctatgttccttttagtagagttagtaatgctgaagttttgagttgaacacattttacttaaaaaaacaacaacaccctttatattttgcaattatttcagactttcaaaaagttgagaaatttggaaaaagatttcctatttacctttccctcagataccagaaatgctaacattttacaacatttgccttcatgttttctaatttgacatactttatttaaatttaccagttgtcccactaattccctttatagcaaaagaaacttctttttcctagtcaatgactttgcattttgtcgtcatgtttctttagtttttttaatctggaatggttcctcagtttttctttgtttctcaggaccttaatatttctgaagaggccagttactttgtagcatgtcccttataattttgatttgtctgctgtttcctcatgattagttttaggttatgcatttttggcaggaaaatcatgggagtaatgttgtgtgtttctcagtgtcagcgatccagagactcgtgctgtctctttgtccctttcctgatggtgttacttcgattaactacttcaggtagtgtctccagatttctccactgtgatgttattgtttctttctttggaataaataagtgtcttgtggggagttaggagataa

SEQ ID NO: 8216 - DNA, 1009 bp, Homo sapiens
ggccacatccctgaaccttttcttaacccttggtaaaatgctttcttactgtttgctcagcacatccccctcagccctaaagaattttgggtcttttttctttttttctatagtataaaactaatagatatattgggtattcttttgccaagtacagaaggccacaagaagattctgaattatactcctggaggtggggtgtgggcaaattcccccagttgagaattaatgtcaatatagattaaagagctcatattggcatgtgttttgttattattgttgttgctttgtaattcctttttttcctttctaggaaaaaatctccaccatagtctttttttttagtgccttgatccttccctccttcacctcagactttaactactccatagtgtttcgttacgtagagagcatcatgggttatctgggtaaattactggccacactcactattctgacttgcaggtggactttttatcctaaactgagaccagagataactgtgatttcagcaaattcttctatggaaatactgttgcactcttccatcattatatctgatgtaaaaatatctactgtggatggatgtttgttgtgatttttgcgtttttcgttttgtctttttctttttggctgcaggctttaagtatcttgtgaattttttattttggcgtagggaaaaaacaagttgagaaaggggattcagaaattatatttttttctttaaaccttttaaaatcatttgtcacattaaatacttctgtgtttaatgtgtgtgtatgtgtttgtgtgtgtgtgtgagagagaatatatattaatgactaatataaaggaaattataaagccatggacttcatttagggaaatagccaagaaataacataaatggcagttatatggcctttcagaaaataagctgacattttatataaggtttttaaattgtaaaatgtacataacataaaatttactgtcttaatcatttttagctgtgcagttcggtagaatt

SEQ ID NO: 8217 - DNA, 1056 bp, Homo sapiens
ctattttaggccattgtagaaattgttgaactaattgtttctgatagtaatcaaacatatgaactagtaattgtagtataattgtagtaaccgattaaaaacagtaaaagtaaagacagtatatattgtataaaacaaaacttactatcttcttttagtgaaccgtcctcaaatgaaacccagtggaaagagcttactcagtattttggagtcaatgatagatttgacccgcctgttaaaaggaaaaaagttgagaaggtaatatctttgttattgcatcttataccagctagtaggatatgtttgtgattagcctcgcctaaagtacttgtcctcattaattcattcagttaaaaagatgcctactgcataccaaaaagggtgctagataagtaaatatatagttacaaattattaaaaaactgttaagagaaagaacaggttgttgtgaaaatattaaaatgggggcttcactttagcatggatggtcagggaaagcctttcatagaaggtgccacgtcactgagacctgaaggatggaaaaaactgtctatataaagaatgctagcgcagaggcatggataaagatcctagggaagagtcgtcctgggacattccagtaactgtaggaaggccagcctggctggaatggggtcagcgaggaggagggtagcccactatatgattacagaggcaggcagtcagtgaccaaattgtgtaggacctcaaaaggcttagtaaagaaatgggttttattcacaatgcagttgagagtcataaaggcttttaagtcaagggaatgacatgacctatgttaaaaagattcgtatgactgttacctggtgaactgattgtgaggcagcaaaaatagatgagaacagaacagttaagagacttctaggcataagatgatgatgaattgaaccagaatggttctgctgaagaaggaaaaaagtggatggatttgaggcgtattgtagaagtaaaattgatgatacttgcctctggattgcttgcgaggtgatagggagggtttggggcgtatggaaggggaga

SEQ ID NO: 8218 - DNA, 1699 bp, Homo sapiens
tgtattcttgccagtacagtatatggtttttctaccccaattacatactgggttttgtaccacatcactaaaggcccaaatcattgaagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgct

SEQ ID NO: 8219 - DNA, 1049 bp, Homo sapiens
tgtaatcaaggtcaggatgctttgcatgctgtggcagctccagctggtagcgatggttctcagggcattggaaagaggccaccaggttctttagtttctactgggatgacatcgtagcccagtcccagttccttaggttctcagtccccttttacttccctccaccccacatggttttgaggattttttttaagccttttttggggagttgggagaggagtgagaaatgtgtgttgaataaacagattcctgctgttatcaaatgctgtctgctcttcatactttttcctattctgatgttttttcagatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggc

SEQ ID NO: 8220 - DNA, 1090 bp, Homo sapiens
gtttcaccttgttagccaggatggtctcgatctcctgacctcaagtgatacacttggcctcccaaagtgctgggattacaggtgtaagccactgcacccggcccagtattcttaaataaatgcaaaataatctgagtatgatgttataggtttttttctaggcttaccataattctgaagtctttatactttcatacattcatgttttatttgaacatttgctcttaatttaggatgagtttatacctttaaaaagacagccttctgaaaacttttttgtgaagcagtataggaatatagctcttgtgaattttgagcatattgagtttgccttccagagcaatgcatggaattgcttaaacgtgcccatttttctaatcctaattttggtactggaataagagaacagggtgcaggactgcttggtttatagtagctcttatgtcagatttgcttgggatgagatgagtaactgcctctgtaaataacctcaggttgcattgtgtctgcacatgaaggacaaacatggcactattcagccactggccagtttggttatattcagggaaatgtcttgaatttttggtataaataggaatttttgtctctaagtggaattattttataaaacttctggctggatttaaatactaggcagtattccaagggatgataaaatgtttttacaaacttaattagaccatttttgtaattaaactttattatacatgtgctatgaggattaaactttgcctcataaaagtattctgacaggtgctttgcacagagtaagtccgccaaagtggacgttctcatatgtaattctgagcttactcatactggccaggaaggacgtgcacatgccacctttggcagctgtgatggggagcctgcctctgctcttgtgcatggaccttccacattctgtcctgtccaacttaatgccttaattaggaataatattttagaagaagtggtgtctactgatgcccccagaaaaggagaatatagtacagcctgtcttaagaattctgtttctgcctcttcttatctgagcagtcattttatggtttatgcctaaccaaccacg

SEQ ID NO: 8221 - DNA, 1050 bp, Homo sapiens
cacacatgcactgcttgtatgtggtaggacctatattttacaagtatttaattctcctaaccctataagataggtatagtcattacctccattttatagatggagaaacggagacaaagagaggttaaagtttaaaccagaatagcacagctattaatgtcgtttctacttacacatttttatattacttacccctttactgcagcaaaaaaataactacattcaatttctgtaactttctacaatctgatcagtaatttccttcccgtggcttcagatagatctggaaaactagtgttccatttattatcggtgtataacaaatcatccaaaaatacagtggcttaaaacaacagtcttttattttgctctgcagtttgggagggcttggggtggggtagcttatctctgttctgctcagcattgtctgatgtggctcagctgggggctggcactttcagtgtgactcattcacgtggctggtaggttggtgctagcttttggttcctctgtgtttccttcatgagtgagtatctcaagatacaggaaatggaaattgctggtatcttaggtcctcggctcagaaactggcacagtgccacttttgctgtattctgctgggcgagggtcacagagcccaaattccaggagaggaatgtatcccacctcttgataaaaggcatgtcggctgggcgcgatggctcacacctgtaatcccagcactttgggaggccgaggcaggcggatcacttgaggtcaggagatcgagaccagcctggtcaacatggtgaaaccctgtctctactaaaaatacaaaaattagccgggtgtggtggcacgtgcctgtaatcccagctacttgggaggctgaggcaggagaatcacttgaacccaggagtcagaggttgcagtgagccaagatcgccactgcactccagcctggctacagagtgagactccgtctcaaaaaaaaaaaaaaaagcaaaagaggtttgtcagaagaatttgggagccacgtcttaaaaacaacacaaaaatgtaaaatgaata

SEQ ID NO: 8222 - DNA, 1090 bp, Homo sapiens
tgttgccatggaaaggggcagtaacttctgggtgttgccatggcaatggtcaactgacatggcacactggtgggcatgtcttatggggaggtgcttctgccctgacctgtttttagctagtcctccgtttggtcctgatgtccaagccccacctttggagtagatttcttcctcctattactaagttgagaactttcaccttttcatttaaaggaatcatttacagcttctctttggcatatctgaattgccaacatcatctctcttgctctttggagccattattaagtaaagtaagggttgtttgaacatttgctatgataatcgtgacagttgaactgataaccgagatggctaagtgtctgacagatggatagtgtcaacagtgtgcatatgctggacaaagtgctggacaaagtgctgacagatatctcaggcaggatggagctggatggtgttatggtttcgtcacgttactcagaaaggcatgcagtttaaaatttaagaattgtggctgggtgcggtggctcacacctgtaatcccagcactttgggaggctgaggcgggcaagatcacctgaggtcgggagatcgagaccagcctgaccaacatggagaaaccccatctctactaaaaaaaaaatacaaaattagccgggcatggtggcacatgcctgtagtcccagctacttaggaggctgaggcaggagaatcacttgaacctgggaggcggaggttgcagtgagccgagatcgcaccattgcactctagcctgggtgacaagagcgaaactccgtctcaagaaaaaaaaaaaaaaaaagtttgtttctggagttttctgtttaatattttcagactgtggtaacttaaatctcagaaagggaaactggataaggtgggggactactatcatggatagatggatataaaatcttttaaaactgtcttaaatgacacttcctcatttcattttttctatgtgtatttctgaatccagaatccattgaaacaattgtgaggcattttctccccaagtaatgttgatacatttattgtatatgctaatgtgttatctaaaagagagtatatt

SEQ ID NO: 8223 - DNA, 1088 bp, Homo sapiens
tggtattagccacacatttcaatgtggtgatattgttactgcttaatttatcatttttatattacctgttgacttccaggatttaattctcttatacctctaacataccttacctttctaatttttttactatcacagttttgtttgttttttttttttttgagatggaatctcacactgtcgcccaggctggagtgcggtggcgcgatcttggctcactgcaagctccgtctcccgggttcacgctattctcctgcctcagcctcctgagtagctaggactacaggcgcctgccaccacgcccggctaattttttgtatttttagtagagacggggtttcaccgtgttagccaggatggtctcgatctcctgacctcatgatctgcccgcctcagcctcctaaagtgctgggattacaggcgtgagctgccgtgcctggccactatcacagttttaaaaaaatttttatttattttgagacagagactcactctgtctcccaggctggagtgcagtggcgtgatctcggctcactgtagtctctgcctcctgggttcaagaaattcttgtacctcagcttcctgagtagctgggattacagtcatgtgccaccatgcctggctaatttttgtatttttagtagagatggggttttgccatgttgaccaggctggtcttgaactcctggcctcaagccatctgcctgagttggcctcccaaagtgctgggattacaggtgtgagccactgcaaacggccacaatttgtggttttaatcagtaagccatatttacattatagctatgtaaatattcacggaagggcctaaagtgtactgagattacattttattttacatagaatgttgttgttagttgccttgtttgtattggcagaatttttgttgaacttactctttttgtttgtttgtttgttttctgagacagagtcccgctctgtcgcccaggctggagtgcagtggtgtgatctcagatcactacaacctccgcctcccaagttcaagcgatcctcccacctcagtctcctgagtagctgggattataggcgcatgccaccacacccagcta

SEQ ID NO: 8224 - DNA, 1031 bp, Homo sapiens
tcttattggggatcttgtcttgctattttttgacctgcatcatataaaatgttgttgatgaaactgtaagagaaaggcattttaatgtttacttaaggcccagtcccaaatctctaaagaaaatgaatactgtttatttactgtaaactctgtaaaccgtagaccatatgtattcacattgtaaactgttaagcactatataaaggttgattgttaatatccttttatggtatgtcttgacagggcaagctggctttccattttttcttcctgcttttgtggacattcggttattaacctctaaagataaagttggatagatgtgtaatatgtagttgcaggtatgctgattcatcatctgaatggcattttattaagtgtttattgtgtgccaaagtaatattttagcctctggtaatgaagagacacagttgaatgtgggaggtgatagaaaggtaattatgatacattatgattaaatgctataataaagctatgtatttggtagcattcaggaaagagagtctttataaaaatgaatagaagttggccaggaggatagggggtggggatggggaagctggactggaagagacttccttgcagaggggcagcctgtgccaaagacccagaattgaaattatttttggaatacagagtaggaggagagactggctcatgttaaacatggatagatagaaagggctagatagtgaaggaccatgttagtggaaggattttcttctgtagtaatgggaggttttaagggagacatttgtcttagtgtgttaatttagagcggatagagagtggaggtctaggggctagttagggtgttacaatttctgtaatctagacaagagatggagattgaacaaatacaattttaaaagataagaggtttcaatttggagatatttagggactagaatctacaaaattttgggggtgaggaaaggaagatgaagattaaagattgctggtttggatgacgggtagctgtcagtgcctttgacccagacgtggaaggt

SEQ ID NO: 8225 - DNA, 1045 bp, Homo sapiens
ttttttttttttgtatttttttttttagtagagatggggtttcaccgtattagccaggatggtctcgatctcctgaccttgcgatccacccacctcggcttcccaaagtgctgggattacaggcatgagccaccattcccagccaagactacttttacttgtaggcattccaggtttttttttaagggttattgtttgcataatgtatcttttaccatcattttacttttaatttattttttgtgtaaagtacatttcttgtagacaacatatggttggatcttttttaaaatccagtctgacaacctctgctaccattgtgtttaatgtagttaccaatatggtagggtttaaatcatattgtcttgcacttttgtttactctttgtccatctgttatttaaaaaatgttccttttttcctgtctccatttttttttttgagacggagtctcactctgtcgcccaggctggagtgcagtggcacgatctcggctcactgcaacctctacctcccaggttcaagcgattccctttctcagcctcccgagtagctgggattacagtcatgtgccaccacacccagctaatttttgtatttttagtagaggtgaggtttcgccgtgttggccaggctggtcttgaactcctgacctcaggtgatccacctacctacctcggcctcccaaagtgctaggattacagtcatgagccactgggcccaacccttttcctgtcttcttttttgttatttttatgattcagttttgtctccagtttggcttattagcatggttgttttgctctttgggggttactctaggatttatgattatgaaagtttaacttacaacagtctaccttcaaatagtattagactactttacttataatgtaaaaatctaatagcagtatacttccatttatccactattgtcctttatgctattgttgtacattttaactttaatatatgtcataattccccaaatacactgtcattaattttgctcaaaactgtcacgtatctttttttaaaagttggaa

SEQ ID NO: 8226 - DNA, 1039 bp, Homo sapiens
cgctggggcccgcattcgagcgccgggcctgggcttggagcaggtgaccaggcctgggtctcctcggcctggtggtgaggccccccgaggacaggggtcagggtggccacaggtttacgcccccacctcccagcctttaatggccctaggccctaatcctgagaatccccgctatccacccccttctcaccaacatcagcatgaaaagctggacgcgttggaaggatgcagctctcccatcacagccgcccaaccagccagtggcttccgtttgcaccgcgcgttggagcgctttcccctgggcgaaatccatacaaaccctgaggttcggggaggctgtggttcctgccgcggtaagagcggagggacgcaggactttccggctgcacgcagcagccttcctcccaacaggtgctcagggacttcagccaatgggtggccgatagccggttacttaggtcggggttggggctgggccggaaaatctcatggctggagagcctaggacagtgactgggatgtgtgtgtgtgtgtgtaccccctcgccccagaggcctgagtcaaaatgtgggttgtatgtgcagtttgaaaaacaacgtgtattcaatgttatattttgtcttccttccttccttccttccttccttccttccttccttccttccttccttccttccttctttccttccttctttccttccttccttccttccttctttccctccttccttttctttctttttttttcttttctttccgcatcccgggttcaagcaattctcctgcctcagccttccaagcagctgggattacagatgcccgccaccatgccgggctaattttttgtattttagtagagacggggtttcactatgttggccaggcttgtcttgaactccagacctcgcgatccgcctgccttggcctcccaaagtgttggtgttacaggcgtgagccaccgcgtctggcctctttctttctttctcactctttcttttttcttcttgatttttcttttttcttttttttttttcttgag

SEQ ID NO: 8227 - DNA, 1033 bp, Homo sapiens
acaggcgtgagccaccgcgcccggcccatcagagtactttgaatagagaagtactgttaatttaaccacccccattagacattaaataaaatgtctccacctttctttgcttcgtaggcactgtgatgtccatttcagggcatgtggcttttttcacattcttcaaaggggatttctaggttgaaggaaatctgtagaggtgtatgttcccaggttgctttccagcacagtgttatatcggtttgtaaggccacctacaatatatgagactaccagtttccctgtagcgtcagtctgatctcagattaaaaaataaatgaaattttaaaacttgcttatttaagggcttcatattgttataagtacaaaaaatatttgaatggtaataccagtagttgtaatagtaaatggttaccaatgtaatgcttctttttcactttgtcaatggaggactctcgttggggagatagagattcagaaggcacctggagaaaaggacctgaagcagattctgagtggagaagaggcccgccagagaagtaagtagagttgaggaaaataatgccgctccagttcctgttaatatcttatcagtggttttaaaatttggttcattttgtagaggcagggaaaggagagccatgaagaattgtgtgcatgtctgattgcgtgtgggtttgtattttgtttttttgggtctgctgcccaggctggggtgcagtggcgctatctcggctccctgcaacctctgcctcctgggttcaagtgcctcagcctctcgaatagctgggattacaggtgtgtgccaccacacctggctactttttgtatttttagtagagatggggttttgccatgttgcccaagctggctttgacctcttgacctcaagcgatctgactgtctcagcctctcaaattgctgggatgacaggcatgagccactgcacttggcctgtgttgttgtttttgttgttgttgttgttgttttgagatggcgtctcactctggagtgcagtggcgcgatctcggct

SEQ ID NO: 8228 - DNA, 1041 bp, Homo sapiens
ttttctaggttctttttgtgtgtgtgtgtgtgtggagacagtctcgctctgttgcccaggctggagtgcagtggtgcaatctcagctcactgcaacctccgcctcccagtttcaagcaattctcctgcctcagcctcctgagtagctgggattactggcgtgtgccaccacgcctggctaatgtttgtatttttagtagagatgggatttttcactatgttggcctggctggtcttgaactcctgacctcgtggtccactcacctcagcctctcacagtgctgggattacaggcgtgagccactatgcctggcctttaggttcacttttattttctctattccattaatttttttgccctttttgcccgggctggagtgcaatggcgagatctcggcccactgcagcctccaccttccaggttcaagtgattctcctgcctcagcctcccaagtaggtgggattacaggcatgtgccaccatgcccggctaattttgtatttttagtagagatgaatttaaccatgttggccaggctggtcttgaactcctgacctcaggtgatccacccacctcaacctcccaaagtgctgagattacaggcatgagccactgtgcctggccaccattaattttttcctaagtttttaaaaaaacttccacagtataaattacaactttcctttgcctcttcagaacaaaacaaaatcatgaccataccttaacttatattttattgcagtggactgggtatttttgcttctagatatttacacattatctttcctcttagtactcacttaacagttactttaagttttccatccatattagcgaacattatttagtctcaagtatgtttacactgcatcatgttttcccctttgtgagtactttttgtttcttgatcagtagttttcagaatgtctttgtgtgtctcataagttttttctctcaccgttgaacaataaatggttcattatttggccagttcaaaatcatcttttcagaaataatagagacctttgcttctgtttttagt

SEQ ID NO: 8229 - DNA, 1048 bp, Homo sapiens
taacaaattggtatattctttattgagttactatgtgtaacggtcattcaaataatagaaatttttggatgatatttcataagcaaaacaatcatcaaaattgttctaaaggtgaaagttgaatgcataatttaatacaagttttgtttactgtttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttg

SEQ ID NO: 8230 - DNA, 2293 bp, Homo sapiens
tagattttcagtgtagatgaaacgaccttctgttggaagaagatggccagctaggtctttcatacctagagggaagtcagtgcctagcttgagagcatcaaagggtatgctcactgtttaggggttaatgcagctgctaactggaagttgaagccaattctcgtcattccaaaaatcctagggtccttaagaattatgctgcatctaccctttctgtggtctgtacatgaaagaacaaagcctgaatgacagcatatctgttaatagcatggtttgctgaatattttaagccccctgttgagacctactgctcaaaaaaaaaagttttcagaatattgctgctcattgacaatgcatctgatcgtatgacagctctgacagtgatgtataagagagattaatgtttgttttcatgcctgttaacacagtatgcattctgcagcccgtagatctaggaataattttgtctttcaagtcttattatttaagaaatatatttcataaacctgtagctgccatagtgattcctttggtggatctgggcaaagtacgttgaaaacctgctggaaggaattctttattccagatgccatttgtgattcgtgggaggaggtcaaaatatcagcattagaaagagtttggaagaagttgattccaagcctcatggatgacttggaggggtacatgagtagagtggagaaaataattgcagatgtggtgaaaacagcaagagaagtagagttagatgtataggctgggtggggtggctcacacctctaatcccagctctttgggaggctgaggtgggcagattgcatgagtccaggagtttgagaccagcctgggcaacatggtgaaaccctgtctctacaaaaaaacaggaaaattagccaggcatggtggagtgtgcctgcagttccagctacttgggaggctgactgaggtgggaggatgcagaggttgcagtgagctgagatggtgccattgcactccagtgcttgggtgacagagacagaccctgtcttaaaacacacacacacacacacacacacacacacaaaaccaaaaaagactataacctgaagatgtgactgaattgctgcaatctcatgataaagcttggatgggtgaggagttgcttcttatggatgagcaaagtaagtggtttcttgaaatctcctggtgaaaatgctacgaacattgttgacctgacaacaaaggatttagaatattccataagtgtagttgataaagcagcagcagggtttgagaggattggatcaaattgaaattctactcttgagttaaaaaccgtcaaccagtgccacatgctagatgaatcttttgtaagaggttgcaatcagtgtggcaaacttcattgttacctattttaagaaattataccatagtcaccccatcctttagtatctgccatgctgatcattcagcagtcgtcaacattgaagcaagactccactagcaaaaagattatgactcattgaaggctcaggtgatcattagcattttttagcaataaagtattttttgttttgttttctttgagaacaggagtctcaccatgttgtccaggctgatcttgcactcctgggctcaagtgattctcttgcctcagcgtactactgcatctgacttacagtattttaaaattaaggtttgtacattggtgttttagacatgctattgtatacttaatagactgcaaacttctatatgcatcggataaccaaaaaatctgcgttgcttgctttattgcaatattctttattgtggtggtctagaaccaaacctgcagtgcctccaaggtgtgtccgtgtatcataatttttcctttataaagttcctggtatcatggggctaaatgaaaactgtctctcctaaatgcctcaggattactttgtctacctcttgcccgtaattgccttctggggacctattgacatggatgtagttaacgttttcatttttatggcatgacagaaggggcagtggagcagcttctaatttttcaagagtatttctcagtaatttggggttaatgagtaaaaaaaaaagtgcattgaaatttcacaatatttgtacttgcagattactacaatgcagctagaacgtgaaaaggctcttgaacataagaatcgaatgtcacgaatgcttgaagacagagatttattcgtaatgcgactcaaagctgcacggcagtctgtttatgaggtgagcttgctgatttttgggaaatgtttattcatgagctttctagtattggcctaagggttct

SEQ ID NO: 8231 - DNA, 1033 bp, Homo sapiens
cgcatgagccactgcctgtaacaagttatttcttgtatgtgagctctgttaatgaacacctaaggtaggtttggtgcagagaaaagttgtcttatctaggagagcttctttagctgcgtcattgctattaaaagactgaataggagcaacaccatagcatttaataccgaaaacaaacagcttggatagtgtcatcttccattatcaaatgcagatacatagaaaggcagtacatcaggattattttgtaatttctttgatgcctaataccagagaatgttaattttggtcatgtaaaaaaattcatttgtttttgaagcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagtacgtagcatcttagttattaaaaaattagttttatccaggtattttgtactcttagaaccacagtcctttaccatttgttggcttactgggttatttcatgcattttggtacagctggtcatgactaaatctgtgagtaagcatatgtttattgctctgtgaagttttgtgttttttttgagacggagtattatcttgtcgcccaggctggagtgcagtgacgtgatctcagctcactgcaacctccgcctcccgggttcaagtgattctcctgcctcagcctcccaactagctgggattacaggcgcctgccaccatacctggctaatttttgtatttttagtagagacagggtttcaccatg

SEQ ID NO: 8232 - DNA, 1078 bp, Homo sapiens
atttttaaagctgaagaaacgtgccacactggaaggataatccacgtcaccttgttaaaggtgatcttggctaggcgcggtggctcacgtctaatcctagcactttgggaggccaaggcgggtggatcacttcaggtcaggagtttgaaacgagcttggccatcgtggtgaaaccccgtctctactaaaaatacaaaaaaaaaaaaattagctgggcattgtggtgcatgcgtgtaatcccagctaatcgggaggctgaggcaggagaatcgcttgaacccgggaggcataggttgcagtgagctgatatcgtgccactgcactctagcctgggtgacagagcaagactccatctcaaaaaaaaaaaaaaaaaaaaaaggtgatctcttagacttagatttaatatactgcaatatgttgtcccagaagcgaaagacatttacaattggctggaagtagaatttgagccactaaaactctgtgagcaagtcattcggtgatcactgatgggtagcattggaccaacaactagggcatctagattagagtcctcattgtgcccacagagtgtagacttctagaaggataccagttagtgtcaagtgaatggattagctgactgccaagaggcatttgtcaacttcttgagttgaccatatatccaaggtcaatacctgagcgttaggcttccataaccaaatttatgagacagagtgattccattatctcaggaaaagactcaaacattcctaagagtgacttttaaatcggaaagtaaaccaatcatgtattttagtgagaaatataatttagtagattatggcagcctttcacatttccctattcggaaggggactgcatgaagaatctaaaataacttgataggaatgaaattagagctgggaatttttttttttctcttaaaggcagattctaagttagggaattttatttgtatgcatataccacaccttattgcagtaaagatatatggatgcttataaggaggaagtgttagaatgttgtaggatttcagccttgtacccattttacattagagttaaccttagacctgagt

SEQ ID NO: 8233 - DNA, 1547 bp, Homo sapiens
ttcaccatgttgtccaggctggtctggaactcgtgacctcaggtgatccgtctgcttcggcctcccaaagtgctgggattacaggcgtgagccactgcgcctagccatttccttagtttttaaacctgccttaattttgtaaggaagtctggggtatatgaatgtgtgttttctgtcatttaatcacaatctttttctttctttttttttcttttttgagacagagtctggctctgtcgcccaggctggagtgcagtggcgcgatcttggctcactgcaagctccgcctcccgggttcatgcgattctcctgcctcagcctcctgagtagctgggactacaggcgcccaccactacgcctggctaattttttgtatttttagtagagatggggtttcaccgtgttagccaggatggtctcgatctcttgacgtcgtgatgtgccccccttggcctcccaaagtgctgggattacaggcgtgagccaccgcgcctggtcaatcacaatctttttctgaagctagaaaacactgacagtactgagtggatagatgaagtcctgattctccaagtattcgtttaaacacagcccatttctcttactcccatgctttgatggaataatatttatgagtatagtgcaccatggtgatgtacacgttctgtcactagcacgccttaccgtaagattaaagagaagtgcttttctgcttaccaagtatcatttacaaacctaacagatttaaaactttgttctccatagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggttagtattaatttgaggatttttgtagctttgggcagaaaactttgtggtcaggtttaataactcatgattaaatactgggaattctgattcagtgccaagggttctgatgtatggacagggaagcactggtgtcaatcactgttcacttgaggcagttccgcgccagtgggtgagcaggggttaaattggtgggagttttgatctagcaggacttgggttggctctggggaataccgtgggccagttagtaagagaagaagtaatgatgggcaagaagagtcatggcttatttcatggaggctctaggaaaactaattaagctgtgtgtggtaaatatgaagaggctaggtgtattagtatgttctcgcactgctatatatacccgaggatgggtgtggtggctcacgtctgtaatcccagcactttgggaggctgaggtaggtggatcacctgaggtcaggaattcaagaccagcctggcaaacatggcgaaacccggtctctcctaaaaataacaaaaaattagctgggcatagtggcacacacctgtaatcccagctacgcaggaggctgagtcaggagaatcgctggaacccgggaggcggaggttg

SEQ ID NO: 8234 - DNA, 1069 bp, Homo sapiens
ttctagattttttctttatattgcccgaagtgatgggataatatgcaaatattttcttgagtctgctctgtctacttcccattatttcctaaagaactttaaaacgtttaaggagttagtgtttttgtaattatggcagttttctaaaatagatatacatgagtaaagagaaccacacaaaggtattttatttgctatttttatgttttctgtgttgtaggtttcatagaaatttgaattagatttttttcgtgttatagaatgcaatgactttaatttatactcctaattttaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaaggtaaaaatgttatacttggataatgttgaaattctgtaacaaatatcgtctattatatgacatggtatattttaggccatggtttctcagcctctgcactactgacattttgggttggataattcttagtcatggggctgtcttgtgtactgcaggtggtttagcagtttagcagcatcctcagcttctacccattagatgccagtagcaaccaccgccagttgtgactattaagacgtctcaagacattgcccttcctgaacagtattcttggactttagtagttggtcttgaactcctcacctcaggtgataagtaactccgctaaaagcccaattgagaaatttgaatattaggaaaaacacatttaacggatgagctttctatccacatagaggtggagtctattctcagaacaaatagaaaattaagaaaaatacttttttttccttttctttttttttttttttttttgcaagacagagtcttttgttgcccaggctggagtgcagtggcacgatattggctcactgcatcctctgcctgctgggttcaagcgattctc

SEQ ID NO: 8235 - DNA, 1576 bp, Homo sapiens
cagttaaatgacagaacaagtagttcatctgtaatcagttgaaattaggttactataagccctcaatttgtattatgtagttttaattagtacagaaccttgtttcttactatgtaagttagatatcaaagttcattatatttcatactagatttttttactcctaggatttaaagtggtgggtctttgaaaggtgacccctagatctaaattctagtttcccatttgtaaactctgccagcaccacattttagttgtaagcaaggaccagtgattatgtctttggttttgttagggctcactcaaaaaggtagtctggatgaaataagttgattctcattgcatcacaaagactaatgatgagtttggtgaatcctgttaaaacaactgatcttaatgtgtgaaataaaacctattcaaatatttaagtagatagtggaaggtacctaatatattttacaattatgcttatagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggtatgttggagctattagcttttcttcctagaaataatagtctgtgttacttttctccccccttaatgaatagcttcatcttggtatgcattggttaatttcaataaggtaaggaattaaagttgcctaatggactgggaaaagttctgaacaagaaatctcagaatattttgtttctagttgccttctatgaattctggaccaaaccatataatctctttcagacccagtttcttgacatataaaacaatacattgccagtgctgctcgaagtgtggtttcatgactggtgtcatctgtaaactatctggtctgtgatgaaataagtatagagtagaaaagcatatgcaaagtttcttagtagcaattttattgtacattttgtgtgtttttactctgataaaaagtgagctttttctgtttcatttttgtggtaattttgtattttatattcttcggtaagaggtcagaaatttaaaacaaaccgaatcctttactactgattgtttggagaagtgctgctgtagattattctagatttcttagtggtgctttagctgcctgtcttgcattggagatcttgatggtgttaggaagctagtcctctccctggccctttttctctaagaatcctacaaagacgttccatataattttgtagtcatgtgaccttgaagtcttttgtatatttgacggacaatatttgattgaaattatagaggaagaaactaaaaattgggagtctttgagccaagtgaaagtgtgatttgatgtcttgttcttgcccatgtttccttttctatagggacacccatcttaaaatactacctgtagaagataagtaaacatgcccattatagaaaaaaatccataagttaaaagaagagaaatattcatccatt

SEQ ID NO: 8236 - DNA, 1084 bp, Homo sapiens
ggcatcagacaagcctgggccctcatcctggctcaaacctttaatggctctgtgactctcaacagcttccatacctctctctaagcccctgttgactccttagatgaacagggagaggacctccacgttgcaggaatttgaaaaatacctgaagagcactggcagtggtctgacttgtaataggaactaggtcagggcgacctctctgctagtgagtaggttccgctgatttttcagtcccatgaaataatgatttttctctcttcttttctaggtaatccctcagtttgtccagatgaagtatggcctgactggcccttggattaaaagactcttacctgtgatcttcctcggtgagcaggaagggctggaggctgcagtctgggtggggtgtctttgtggtctgtgagccttccttcatctccagaggcacctggctcccttggcacattgtgactgatgacaggtggcctttgcagcccggcaggcccccaagcccaaatcaggtctttggtttgagaggtgacactttctgtagatacccacattaatggctaaagaatgaacacaagactggaaacacaaattacattttttttcttgagacggagtcttgctctgtcacccaggctggagtgcagtggcatgagctcggctcactgcaaccctccgcctgctggatttaggcagttctcctgcctcagtctcccaagtagctgggattacaggtgtgcgccaccatgtccagctaattgtttttttgtatttttagtagagacaggctttcaccatgttggccaagctggtcttgaacttctggcctcaagtgattcgcctgcctcagctttccaaaatgctgggattacaggcatgagccaccgcgcctggccctacattttaaagattatctgtgtaaacgttctacttacattattttacttaatcccgacaacaacttatgggtaggaaatattattcctatttacagaggaggagactgaggcacagggaggttaagtaacttgcctagagttacacagcaagcaaatggttagtatagagattccaacccagtggggtgaca

SEQ ID NO: 8237 - DNA, 1003 bp, Homo sapiens
ctgtctccgtctcttttctttcttttttccttcccttgggagccactgttctattggctattaatgctgtcattgttatatactgcccagaggaccagctttgcaaaactgggttagttttttaaatgtagttagaattctgtcccataaaccagacagcaagtttcctcctacacagtggatatttgtggggattccctgcagctgattcctggagcccagtggcaaaccccagaattcagacagggctctgacgtcagaattcattctccactgcaggcagcgttcctgccgataggctcaaacggactgttccttatctaccttgcagtatgtggggctttctggagctcacaaacaccagctcctcaagacagcctatggagagctcacatatttaactttttctaagaatgtgctggggaccctgggctgacagcttggctctgttgcaagtaacttgactgatggcatggtgtgtcatcagcacacagcctgctctgctctgagccagaggcaagccggattcggggactcatctgagggataagttaggtgttggtattctccaagggtagagacaggactttttaatgttctggtccatttctctgtgtggctcgtctctttgcttgtcattagttcatttgtttattcatatgatccatttattttgatttgttctgtcaatgtggtaaataacagctctggccttcactctctgaaaggtagaacaaatgtggtcccagaaatgagacaggcaaagaaattctttgctgttgagccacctttaaaagctttttttttttttttgtttttttttgttgttgttgttgtttttttaaggctgggtgtgatggcttaaccctgtaattccaatggtttgggaggatgacttgatgccaagactgcaagaccagcctgggccgtatagcaagaccccatctctactaaaaattaaacaactagttgggaatggtggcgtgagcctgtagtttcagct

SEQ ID NO: 8238 - DNA, 1301 bp, Homo sapiens
agtccgcgcaggtggctgctccctactgcctgagctgtggctgagcagcagattggggagaaacaggctctcgcaccttggtaagctcagccactttcggtgagacccccgaggctttgggaagccacccttgggcaggacataagcaggacttatctccctgcagcgtctagggcagcaccgtccaatagaaatatgatgtgagccttacaggtaattaaacattttctagtagccacattaaacaagataaaaacagctgaaatttttaacaatacagtacatttagcctagcaggtgcaaaatattaacatttcaacatgtaatcagtaaaaaacattgctgagatattttactcgcttttttggtacagagtgttccaaatccggcgtctgttaccttcacagcacatctgggttcagccgcatgtggcgaattggagagcagggctttagggggttctctttgaggcctctcctaaagtggggtccagccctgttttttttttaggtggggaaattgagaaggggcggtgagctcaggttgctccagcagagccaaggcttaaagccagaaccactacaaagtttagagtttgctggagcaaacctctttttccccagtgtgaccccagctgcaccattgagcccttaatggggcgtccatcctttgtcactggagtgaagccttatagcaagcagagagtgaggccacagactcttgagatattctaggccattgcttcgaggtcgtatgtgagatatgaacgtaagaccatttgaacccccaaagtctgggattttaaccctcaagggcaatttgatactgagaggttaagggcacagacttctgaatcatttcctggctgtgttgccttgagtacattcaggagtccctctaagcctcagcttcctcacctggagaacctggagaggttgggaggatcccaggagatgatgccagtaaaaggcagatcacagaccctggcaggttctcagaaaaaaaaaaaaaaagccaactgttagtatttatatctttatttttctgctgccattaacctctctgttgcttttctccctcctaagtcctttattcgacgatttcttcaatggacagaattattagatcctacaaatgtgttcatttcagttgtaagtattgttttcagagctaatgaatttcacattttattttgaaacttgaagtctgtgtgtcccttttttttttttttttttttttttgagacggagtttcgttcttcttgcccaggatggagtgcagtggcaccatctcggctcaca

SEQ ID NO: 8239 - DNA, 1058 bp, Homo sapiens
atgttagaccacacacaattccagcggatttcaggccaacaaagccttgatgtgtctagcccacttagcttattaacggactaaaactgcatttgtaattaattccatttcatacagaagccggaagtctctacctgaggctgaaataagaaagggatcctgtcacagaaatactagacacagtaatccacacaaggttaacaaaacagtgggaaatatggaaacaaatacctaatgccccgcctggattcgttcttttaaggttggggcgacagtaggaaaaccacgtgtcacttgcccaagcattcagccttaaagggaatttctccctcagggtctccaggaggcggggaggcggtggctcctccggccccgcccccccaccagcagagggcccgctcaccaccccgtaggccccgcccctgcgtctctgcccgccccgtggcgcccgagtgcactgaagatggcggctgctgtaggacggttgctccgagcgtcggtgagtggctgtcggctggggacaggcgtggagacactggtggctccgggaacgtgcttctcagacaggaccccgcgcttctgggcatgagggccattcgcccttcttggagggtttccgcgggtaacggacccagaggcctccctccgggaaggttccatgcgcctgcgcagaaccgcccttccccactccatcctcgcggtctcttccccgagtccctcctctttcggcgtccccggtccccaggcccatctccacttaaggtcctggccctgattctgccaccgaccctgtgatcttgggcaagcgccttcgcctttctcagactgtgtacttaagatggaaagaatgatgcctacatcaaggcgttgctgtgaacagccccttaaatactggataaaaacgcgcaaagtgctaaaaaactcacaaaggctttccctcccaatcccactcccgcgtgtttctgctgctgtttcctgcttaactgtgggcaatgcgtcgtgctcttttggtacacggctttctctggtggggttcaacacagcccctttcgttctcc

SEQ ID NO: 8240 - DNA, 1201 bp, Homo sapiens
aagatttaaaatattcagcctgggcgctctggctcacgcctgtaatcccagcattttgggaggcctagcagggtggatcacctaaggtcaggagttcaagaccagcctagccaatgtggtgaaaccctgtctccactaaaaatacaaaaattagctgggcgtggtaaccggcgcctgtagtcccagctactcaggaggctgaggcaggagaatctcttgaacctgggaggctgaggttgcagtgagccgagattgcaccactgcactctagcctgggtgacagtgcgagagtctgtctccaaataaataaaataaaataaaataaaatattcgatggcatgcctgtgagtttgctgtggcatctgggtgcctggatggacagtttggggaccacagtacaagtgcaatgtttggtaattccggttgtaagggttacaagctaattgaaggcaaagcaaacacacatatatttgtctcaactaaacaaacagaaaacaccacttccttctctcaagcagtgattcttaactttgctatgcttcagaaacatctgagaaacttaataaaatgagcactccaggctctgtctcagaaaaactgatagagtaggttgtcaaagttatccaaagaccattgagttggggggaggtccccaagaccactctcaggttccctgatttgctaacaggactcacagaactcagaaaagctctgagttatactcagaaaggatccagattcaaaccagcaaaggtgcatagacaggcacggcttccaattgtcctcgcccagtggagtcatgtgaacggcacttacttctcccaggagcagtgggaggcaacatacatgaagcaaccagggaagtgcaacgaagtcttggtgtccagggttttttttttttgagacagagtctctctctgtcgcccaggctggagtgcagtggtgcgatcttggctcacggcaacctccacctcctgggtttaagcaattctcctgcctcagcctcccgagtagctgggaatacagatgcctgccaccgtgcccaacgaattttttttttgtatttttagtagagacagtgtttcaccgtgttagccaggctggtttctatctcctgacctcatgatccgcccaccttggcctcccaaagtgctgcgattacagcgtgagccattgcgcccggctttttttttttttaaat

SEQ ID NO: 8241 - DNA, 1196 bp, Homo sapiens
ttgaaggagacttgcggagggcctcctggaagtggtgaatttgagccagtcggaaggacgcatgggcattgatttgcgctgggaaagggagtggaatgtatggtgaaaaggcagtttttgtgactgtagccatatgaggatatcgaccccaccctggacctcagaatcttgtcagagctccctagggcacttgaaagtgcagccagggttgcgaacctgtactgacctctgtgctctaggtattctcagtaatgacaacactaactaccatttcgcttttggttctgtgtttttgttcttttttttttttttttttaataccgagtcttactctgtctcccaggatggagtgcagtggcttgatcttggttcactgcaacctccgcctcccaggttcaagcgattctcatgcctcagcctcctgagtagctggaattacaggcgcccaccaccacacacagttaatttttgtatttttagtagagacagggtttcaccatgttgactaggctagtctcgaactcctgacctcaagtgatccaccctccttggcctcccaaagtactgtgattacaggcgtgagccactgcacctggccttttcaggtttttttctttgaaacgaagtctcactctgttgcccaggctggagtgcagtggctcgatctcggctcactgccacctctgcctcctgagttaaagcgattctcctgcctcagcctccctaccagctgggattacaggcctacaccaccacgcccggctaattttttgtatttttagtagagacggggttttaccatgttgactaggctggtcccgaactcctggcctcaactgatccgcccgcgtcggcctcccagagtgctgggattacaggcgtgagccaccacgcctggccctaactaccatttaggactgcccgtttgagcctgatgtcacacttggtgtgtattgtctcattttatctccaatgagtgttattattcccattttgctgatgagaaaagcaaggttcagagagattaagtgttttttttagcattaagtcatgcagggagcaaaagtgctggaagccagattccctcttgtccatctgccttcaaagaccatgctccccccatgaccatcatggcctgtgttgctctgccaggctcctgggcagcctcttgctgtttctcaaagctcggtgaggcc

SEQ ID NO: 8242 - DNA, 1026 bp, Homo sapiens
tgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaatctgaaagagggcaaaatttcatgatcagttaatggaagttatttcatattaagtggtttttttttttttttttttttagatggagtcttgctctgtcgccaggctggagtacatgtagtgatgagaacttggctcaccgcaacctctgcttcccagattcaagcgattctcctgcctcagcctcctgagtagctgggattacagtcacgtgccaccatgcccagctaatttttttgtgtttttagtagagatgggggtttcaccat

SEQ ID NO: 8243 - DNA, 1034 bp, Homo sapiens
cagatttcttcctttgagactgtttccaacatgaacttgtttttaaaatttcttatgtaatagatgatgtgttgaatcattcacaatttttaaaaaattagtttgcagatactcctcagacatcagtgtgttaagttgtggttatcttaaaaatatcaaagactaatactggaatatgtattctacacatatatcatttatttctttgatctttctatttgttgtaggtgtgttgatttctggttttctattctgtgattaggctctgcttgatttttgtgtaaatacatatgtgattttttttttcttgtgtttgctgaagattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagc

SEQ ID NO: 8244 - DNA, 1028 bp, Homo sapiens
ctactagttaagaggcaaatgtggtttgatttttaacaaatttatgctcagattttactgttgttacttggtaaaaaatatattggaaaactaaaaatggttatgaattgtagaaaatgtttatcataatttatctttctgattaaaatcagtttattttgtatatttcctgtagatttaaattaaacatcttagtactactttacaggaaagtgtttcaactaagaacaacaatattttctctatacaatttgttgttctatagatttaatttctttaaaagatgtaattcttaactttctgttttgatatttgctttgctttttaatctaaatgtggtaagtagtactattttaaaaatcaatataaaaataatacaggttgctgtttttcaatctttatttatacctgagacctgcagtttttcttaagtccaagtcacaattaaaagtaatagcattctggttattttgcagaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatat

SEQ ID NO: 8245 - DNA, 1030 bp, Homo sapiens
atagcttaggtagtactactttcttcacatctttataaatgtgttttaggtaactactgtcaagcacagggttgcagaatatatttaatatagattttttatatggtgttcttatgatgtaaacttatagctttgtcttggaatattttattcagatacattttcagaacctcttttcttgatcaccactgttatttctctgatctttggaagaccaaattcaaagtatatagaatcttcagtacattagactattttggaaggtagggaattcatttcagtagctggttataaagcttaagttttcttgtttttattttcattctttccatatccagaaaagaaatcaataaaattcagtctttgtagcagcatagaattccatcatttgtagtattgatcctaattttgatcagtagtttatgaagttggttcttgctgtatttctgtatcctgggataccacttatagaggattatgatgcataagtagaacgtaatttaaaaataatattggagaaggaaagtagtggtaaggagtggtcctcatcagatctgagtttgaggttttgtttggtttaatataatcttctattttatatttaacacacttcaccagaattctttattttcatttaatactgatgctcatgattctacaactgcttttatagttccgtttgagttcagcagtattctgaggtgcaaagtcaggtttagctttaaatcttatttaaaaagtgttaggctttcataagcttatgcagtctcaccttgtatattcccagctatcagtaatgttttttcctggattttcttctcagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggtaagataataggatgatggcaccttatgagtacatatatttgcatgtcaaactagt

SEQ ID NO: 8246 - DNA, 2762 bp, Homo sapiens
aatgaatgaattccatcttccaaccacttaattctggtttccttcctttccaatgaagagtgatgactcagcatttgcattcctttctgaatagtgtggcactccttttctctgcatctttttttttttttttaagtctgaatactttttaattaaatgtttaaattgggcaccctaatttcccggcctctccaggtctagcactcctaccttgagtaccaaggagtcagatcgctgctttgtttctcttgcctctcctggtattgataggatcatagtccacttggctctgctctctgatggggaaattgctttttagggaatagatgaaggtggaggggcactcgagaagtttgactagcttcacatctcttcactcctaccaaagaaaggatgctcagtaaagaagatagatgttcagtattgatagagatttttttggtgtggccttgtacaggaataaatgtgttctctaacgtctcactgaagtatccgtcccgttttgagaatctgaggcctactgaagcacatccaatgcttcaatgaaacgcctgcttaatagaacgtctttgtgttttgtgttgtcttccatttctgccttctctccctagaagaaagaattgggacacacttgaaatttgtccttcaggccgggcgcagtggctcacgcctgtaatcccagcactttgggaggccgaggtgggcggatcacgaggtcaagagatcgagaccttcctggccaacacggtgaaactccgtctctacaaaaaacacaaaaattagctgggcgtggtggcgcgcgcctgtagtccctgctacttgggaggctgaggcaggagaatcacttgaacccaggaggcagaggttgcagtgagccgagattgcaccactgcactccagactggtgacagagcgagagttcgtctaaacaattaaaaaaaaaattttatccttcaacatctgttgaagccaagacttggtgttgagttacaatgtgtactttgatataagcatctgggaaagctaggcttaaagactagctaacatgtatttaacaaagataaaagttacattgtatctaaaaatctgaagtatcatcacacactgaatgattgataaatactcatggcaggggtctcatttactgtatctgttccttaccaagaggaatctctggttttgtagtgctaaagaatgtgcttttttgatgtcttttatttatctttgcatctgccttgccttcatccctatcagagtttctccaggggaataataagctaacttctttgtcacttatttccttcctctaccttctctaatctcttgttctttctttgaaacagttaagttgtctatgtttacagttctctaaaactgtgacatgttcatatgaataaataaacatcttaactctgttgttttgtatgtcagtacgtgtttactattctgtcttcctttttccttctcccacccttttccatagggcctttttttttttttaagagaaggactactacatcttcctaggtcttacccccacagcacttagttcactgcctggaacataagaggtactcagaatttctacagtgattatacttctttcattaaattagtattaagttcttttttaaaagtcctggttgaactaagattgtaggcagacattactgtcacatgtggtgcagtctgttgacttttatatattttttaaaaccttcaaatgtaaaatcttgagataaaagcaaatgtttaacaattgggatttttattagagtttaatacaaataatgcatagtttttctaagtgtacgttttacatattctcaaagggttctattagatataagtaacatgatgaaaactgaacatgattttagacgttgatatctagtagggttttttgtttatggagatcttatattttacattgtgagctatggattaggtttttcaagtggccagtatgttttaaaagaatgtgttcttaacaaagcttatcttaaattgtttccttaagatgcctgtgtgttactagtgaggtttttttcctgcagacacacacaagctaagacatatggttctatcttcagaaaacaatatggtgtttagagcctaggtaggtctttaaatattcattacctacagtattactaatttatttgatggtatttaaagtggcaagaattgctttgatgttgagcctaaatttctatttgtcatatagttgctttaaaggtctgttttctgatgttcttcattctcatttgacatttattttggggtattatgcattgagtaacttgtgatctaaaaaaacaaacaagatcatgctgtgtaatactggtgttggaactggactgtctgacacctgccttgtgggacacacatttcaggcttgggttgtgtgtatctttgtagtgcagtgatttgatccatggtatatctgaatctacaatatgacactaaattgtaatagtgttttattgtagcttattttattttcttcatctatcggatgcaccaaaattgctaggaattcgtgtaataccatgttacacaatcccttcctttaaggctattctttcttcctggaaataagctaatgatttagagtataatctgaacatctaagaacaaagcagaagaaaattctataaactattacaaaattgactggctataccatggatttggctatactgtggctataatcaagcccctcattcaaattcaacttaatcatattctttgtttcttta

SEQ ID NO: 8247 - DNA, 1035 bp, Homo sapiens
ggaaaaggtcttatagaattaagcctccagaaagagggggcccacaaagaccctccttttctctccatttctccatctgcgctcaataccccccttcctgccaacccctctttcacgcacccagacctgatacctttctcttttcctccagatacttctctccgtagtttaccctgttaccctaaccttgttgattttttttttctgcttagtccatcattttctcagaaatgtgtcttaacatctcccactatgattgtggatttgtctatttctctttttagttctgtcaactttgttatgtattttaaagctttgttctttattaagtgctgcatatcatgtatgaaaaattacagatataatttgaggccctagatgatagtaagatttatttttgcttctggaaggcagttggggtctgggcaggcacccttaatccagtggttttcaaccacaggtgattttccccaccaggggacatttggcaatgtctggagaaagtttggttgtcagaatttggggaaggagaggtgctactggcatccagtggttaaaagccaggaatactaaacattgcataggatggtccactgataatgtcaatttatcagtgtcaatagcactgaggttgcgaaagcttgccctaatccaattatcagaggcgtttgaaccaaagtaactccatcttgagtaggggctgcgtaaaataaggctgagacctgctgggctgcattcctagaaggttaggcaatctaagtcatgggatgagataggaggtcagcagaagatacaggtcataaagaccttgctaataaaccaggttgcagtaaagaagccggctaaaacccaccaaagccaagatagtgacaacagtgacctctggttgtcatcactgccacactccacttgcaccatgacagtttacaaatgccataacaacatcaggaagttaccctatatggtctcaaaaggggaggcatgaataatccaccctttgtttagcatatcatcaagagataaccataaaaatgg

SEQ ID NO: 8248 - DNA, 1033 bp, Homo sapiens
aaaaaaaacagtctggcagttccacaaaaggttagatagagttaccatatgacccagcaattccattgctaggtacacacccaagagagattaaaacaaatataccaccaagaacttgtatgcaaaatggcttataatagcattattcataatagctaaaaggtggaaacaactcaaatgtctaccaactgatgaacaaataaataaaacatgacatacccatacaagggattatctggcaataaaaaagaataaagtactgctacacactacaactggcatgaaccttaaaagctatgctaggtgaaagaagtccatcacaaaaggccacgtggtgtattattccgtttctatgagatgtccagaatagacaaatatttacagagacagaaaggagattagtggttgcatggtgctggggagctggagtttgggaggaagtgaggagtggctgctaacgaagacagggttttttcgggggatgatgaaaggttctaaaattgattgtggtgataaccacatgactctgaatacactaaaaaccattgacttacatactttaaacgggtgaactgtaaggtatttgaattatggtatgtgaattttttttaactggcaaacaaataaggcatatatttgcgataaaaagacaacagaggcagaaaactagaaattctattaatacccgtctctgaaataagattgcttctgctccaattacagaacacagacttaggctttagcaaatctgggaacagtgaccacattaaaggatgctgctggaataaatgcagattattcaaactgatacacagacatccaaatcagaaagtcatactaaggagaaataagtagttttgtttaacaaagtcttcctatgttcttaaaaaaataataagactagagggaaatatgtaaaagtgcaaaacagagaaactattctgaaacatgtgaaagtaacactggtcctccaaagagcctaggcacaaatggaaacacccaccaaaactcagtagaatattgataacaatta

SEQ ID NO: 8249 - DNA, 1040 bp, Homo sapiens
gtcttctctcctttggtatccctcatgacagctataaataagaaagaaaagttgatgctatttgccacaaatgtctcagtgtgtgcatttgtactgttggatcatgcaagatcactgatcatgagcatactgcagaaaaattatgggttaaagtaattctttaacaaaagcctgaacaattttcttccggccaaatggctctcttcactagcagaatgtggaccacaaaacctgacagatgctcattagaaagaaaagccacactttttaaatatgaaataatctgttgataggcattctttttccaaattcaaaagcctagtgtttaaaacatactattttctctacaaagtatttagaaaaaatttcaatgtttcctctcatcagtttacttaggagttaaaaatgtatcacttgtggccacgtgagttgtgtcaaggatggcaaaatccttgcagggcccttgctctcagaccggttctcttggcaaaataccacctacgtaaatacttgtggagacagtcagtgttactctgtatcaaaacttttaaacacacctagagggatatcctaagcatattttaaatgccatatcactcaagataatgaaactctgggtcttcagagtttttcttgaaactgaggataagcaataacctttgtatggcactgttagggacaagtgaaatacccacatcttttaatccagattcacaacctgaggatgctattctaaagaaatcatcctaaacatgaaaaagtaatacatgacaaaggtatctgtcatgacttctttataaaaggaaaaaatgcttagcaaccaaaattcttggcaattgagtttaatagctgtgtgccaggtctgagtgcgttattcagttcatgcaatgcactgacatggattttctctcatcttacagataacaaaactgaagtaaaggagtatgttttccaaggttaaagagtaattgatagaaccaggagtctcagagtccatgttctgaacccacacaatacatttccaaactgatcacaggagg

SEQ ID NO: 8250 - DNA, 1527 bp, Homo sapiens
agttcaagcatgctggaagcggaggtgggggttttttgagatgcaactgaatgcgctggctcaactgacaaaaactgtgggcctgttgcagaaagagagacatctaattgcgatggccgagaaggtgtctgttctgttgattctgattgggtttcatttgaaacttgattggtcatttgatttctttcctgactagcctgctgagacacagatctggtctctgataggtgggtcactttgttctgtgcatcttgcacaaatctgtggcagtaaatatccataggcttggcaaagccagtcaatatgtgtacgtcgccagcagaaggacttttcttcaaaggagactcctggccttttccaagcccactcccatgagcaacagtaatctctgaaggagcatgaacgctactatctgtgctgctaagagactgggaccgactgcccaatcgaggcgctgaggcaataataccacaactaggaagaacgtaatctattggccctacactctctaatgagttagctagctgcctgtcttcatcagacttagaatttgtaaggaattcatcagagtggtatgagtcattatctgaagacatgtccccatcagactctgcctgaaccttatccatcactcctgtgttttccatagtttcaagactactatctgatttccaaagatttacttttaagtttggttttagaaagttaactttcatttcaggtttggtaaagtttcctagctttcggaggttgccaatatttacattggatttggtctgcttcactttttgatttagagatgaaaatttgctcattaaaaaattctttccctgggccaaagaaccttggttttgagacctgataccaatgatgtcttcgtgaggtttactgctcttcctacaaattagaagagaaaaaaagttaattccccatggaatccaatatgccagttccagttattaacataagtgaaaacagttattcaaattggtcccaacttcttgaaaacagtgcattgctaactgacagataaccctcagagttgacattaaaacagtgctatccaatagaaatatatgaaatacatgcataattacaatttttctagcagccacattagaaagcagcagtgaaattagcagcatttcatttaacccaatatatacaaaatatttcaacataaaaatattaaaagatgattaatattcctttttggactaattcaatataggcaatgtgtggtgttctataattacagcacacctgaattcagcctagtcgcattctaaaaggcttcacaaccacatgtggtgagtggctaccattgtgagcagtgcgggtctagcacagccaccatctgtacaatcagcaaagacatctctgactgtaaatgggaatctgcagcaccttaactaaggttatctatacacatcccagtgtggctcaaattcagatagtggggggagacaggagtaagacttccattttcttatatgtcctgtgggttacctgattttaaaagatttg

SEQ ID NO: 8251 - DNA, 1522 bp, Homo sapiens
cacaaagtattcctaggtcttaaaaaaaatttaaaacttactatcccagctctagacttaaatttgtttctgtgtttcaaaccaggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaa

SEQ ID NO: 8252 - DNA, 1273 bp, Homo sapiens
ccagcagcacttacgtacaaatattggctattacttttattgctgttattctgataaaataactggtcagaatattctggtttatttttaatgacaatattaagctaatttttctattcttcgctatttgatagaaatcaggaagtcacttcagcatcttattgattgatttctttcttttctagatatacaagaagagatgtccttccactaggaaaatttacagttaacttgagtggttgcccacggaatagtaccttcacagaacacttgtatcgaattattcaacatcttgttccagcagtaagatgaatataaatatgtattataaacctaagcacacttaaaaaatccatctaactgtctttcattcacttcaaatatttaacttagagattttaatagatcttatttaaggggaaacaaagcctgccaaattacataatttaaaatgtacgttcccctaaacatttcacttttttttgtctttttgcctaagcacaaatttctgtaagtctaacaaaacaattgtagtaactcccttaaaattacactctcttgataccaatttgtccaatttggtatcctttttgtacactaaagtcttaaatctaaataaactctaaattgtaggagcataattcttttagttgaggtaataaagttctttatctccattgcctcaattttaattcctgtttggaaagttgagctcactttatttgccagggtatctggaatgcagtatttgcgtggtggtaggatcttgggaacaggggaattgcttctgattagttgtgtgactgaaaatactgatcacttctttggaaattgaagagggtgcactagatctttattgaaccgaatgtattcagtgtctcagtgctaacactcgtccaggccctcaagaagcagaagtggactggaatataccagcagttctcagtctccttagactcactttacactctgaaaaatgtgttcatactcaaagagctgtttttcacgttatgattatatttatcattaatttaccaaactagaagataaagtaaatacacctattaaaaataaaaaattacatataaatatttttataaaaacaacttttcccaagccaaaaatgattagtgataaaggtgacattgttttacattcttgcaaatctcttcaatgtctggattaataggagacaatggatgcttgtatctgcttctgccttcagtctattgtagtctcaggttttggttgaagtatatgaaggaaagctggc

SEQ ID NO: 8253 - DNA, 1048 bp, Homo sapiens
gaaaggtgagtctgtgtgctctttttttggtctcctttatttttatataatttcaagttttcaggagagttacaggatggttttaaagaactcccttttccctttctcccagatgtaccagttgtaaacacttgcaccccatgtgttttgtcattcatttgtgctctctatgcacacatttttctgaaacacttgaaagtatgttgcagaaatcaagcccttttacccctaactgcttgtcaacatttcctaagagtactgactttctcatatataattagagtacaggtatcaaaactaggaaatttgccacaaatatacaatacactaatccacaatctatacttaatttcactaattgtcttaatcatgttctttcttacacgtctcccttctgcatcccccagtccagggttcagaagctcgctcattctctatttctactgagttcatactgtatttctgattccagttcagcaccacaggtgtcgttctgcttgttctcctttctgtattagtgtaactctcttaaacttgattcccatttttcacaatcttatcatttgcacatttttacaacatagagaagggaatttcagaattgttaactcatacctttacaaaacataaacctaaataactagagttcaatctgaaacagtcctcagcctttgtctttcatggtcttgccactttttttttttccttaaacaacagaaatatatgtcttccagtagttctggaggctgggaagtccaaaatcaagttcccagcagatctggtttctagtgagggcccgcttcctggtttacagatggctgtcttctcacgtggtagagagcagacagccttgatgcttttgaagagtgtaagccagttaccagttacttgtttcctcatggttagactcaatgttttgcatttttggcaggaatattacagaattgatgtatcctcagtatgttacagcaggaggcatgcgatgtcagtttgtccctttactggtgaggttaattttcattagttggttaaggtggtgacttccaga

SEQ ID NO: 8254 - DNA, 1021 bp, Homo sapiens
actggtttgattcctggtacatactggatattaataagtatttggtaaattaatttattgctgtatggttttattctgcttaattaatagaaaaagtatgttctaccaaggagttttgctgtcggtagaccatgtattccttaaatcaaagatgtcaaagtaaccatattgcaaatcaacttttgaaactggttatacatgagatttgatgggaggaatttgttgatatcttacagtaagggaaaaaaaagtaaaatttttagatcttcatgtttatctttgtcctcttacagatcaaacaaaagactttgttagtatgtgctgtttccttaaaaactgtaacaacttgaactttgcaagctcagaagcatcacgtatatcaaacttgaaaggcacttatggaatgttctttttctccaggaggccttagaaatgactaagtgcaatgctatcctttgaatttagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtaataaaacctttcgtagatccaacactgaaatgttatgtgtctcagaaagtagcttagtgtctgagcatttgcatttgttcccttgtgctgggctagctatagcaaatcactgcaaatttaatagcctaaagcagcaaaagtttatcatcttacaggctttaggtcagaaatccaacatggtctcactggggtaaactcgaggtgccagcagggctacattcctttctcggagcccctaagggagaatttccttggccttgtggctccttcttccatattcatagccagcaacattgcatttgtctgaccatttttttcatgttgacatctcatctgaccacaaccaagaaagtttccccaattttaagaatccgtgtgattacatggggcccagccagtta

SEQ ID NO: 8255 - DNA, 1028 bp, Homo sapiens
ttaatttttgaagaacattttcattggatatagaatttttattttttattttaataatttattttaaaaaaacagaccaggcacagtggctcatgcctataatcccagcactttgggaggcagaggcaggaggatcacttgaggccaggagtttgagaccaacctggccaacatggcaatactctgtctctacaaaaaatacaaaaactagccgggcttggtggtgggcacctgtggttccagctactcccatggcttgagacgggaggatcacctgaacccagaaggctgaggctgcagtgagctgaaattgtaccactgcactccaacctaggcaacagaacgagactgtctcaaaaaaaaaaaaaaagaaaaggaaaaaagagatgagttctcactgtgttgcccaggctactctcaacttcctgggctgagtggtcctcccacctgagcctcccaaagtgttggatttacagatgttagccactgcatccacctgggatttgttaggggtggtgtagaacagcccttgttgaacagtagatcatccttattcatgaggtctgctatttctgggtcttacccaaatgcctaggatgactagtagggtccattatagtattatactacttccagagtctccatttaactctctgccaactagcagctgttctctgctagtcctcagggagtcttgacttgtatatccacaatttagtgttttgtcagagatccaaatggaaccttcagggtcttttatccgtaactacttcctttctagtacttctctgcaaattccagttgcttcactagccctgaaccatgtgctctgtcttctccacccagtaagagagggcctctactgctctttgttgcagtttggagaacgtctccaggagagagctgggagaatttggagtttacctgctgtgtttctcctcattcaaggatcataaccttatgctccctgttgtccagtgactgaaaacagttgcttcacatattttgtccagttacattgttgttta

SEQ ID NO: 8256 - DNA, 1027 bp, Homo sapiens
tttatggtatacagtaatgtaatatattagcctaatgtgttaggactccttaaacaagggatactgtaatcattaatacagttgatccattaggcttggcacagtgtttattttatggaaacactctaaaagaaaaacagacctgaagttcatcatgtgtaaggttacacaaatctatctttcaaatgagttcattactctaaataattgtcagaagttacatttttgtttaatataatctttgcagtaaccttccaaattagggcaatttttctgtccagatctgcctactgaactagaatatttaatgagcaacaacttctgttgtgaattaacggactgatattggggtttgataaatcagtttcctaaggtttggataagccaagagttagactctaagaatataaaaaggcctagataacatcataaaagtaaggttctagatccacaaagcagagaactagacccagattataagtcactccagaggtcccatttttctggatttgagggaggaagtgtttgatgacagtatttgaagtgattttatatccattttcttttaaaaagtaatagtttggaattagttacttgttaattaatctgtaaaatatttgctgtggtgttataatgtgaaaatgtggttgctaattttaaaataaattttgggttttttaaagtaaatttttaaaaacactttttatgtatatcacagcctcaacaagaacttgatttaaactctccacgaaataccactttggaaagacagactttctattgtgttccggtgcctggggaatctacgtgggtaaaagaaatatcctttatctgaactttcttactgtgttgatggtttctaaaaacttagcctttaattattcttcctttgcaaagcttggctttattttaataaagtgtgtttcatttgttctaattgagaaaacccataaaacgggctaagtatttgtcactgagtaatgctaaaataacagtacattcctatagtgaaatactgttaaaatga

SEQ ID NO: 8257 - DNA, 1029 bp, Homo sapiens
ttttaaggaaaagctgaaggaaaataatgctcctaagtgggtaagcttattgctattttcgagggagagggttggacagactatacagtttctcttagtagagtaactaagtaacccacatgtaatttaaaaatatgtaaattaatgtacttctgcttcaagtacatttgtattaaaagattttggtcttttgctaattaagtttaagcatgtaaatacttatacattatgcctctaggtggcagtaactgactgttacttcctgagacaaatctttagttgcaagagtgtcagttacctttgttttattaccttcattttaaaagaattggcatgtgctagttttaagagaagagctcaacaaagtaaatgcctttttgatcattgaaaagtgttctgaatgaaaagcattttttagcattcttttacattgtggtcaaatgttatctaaaacttgaaagaaatggaagagaacttgggttccagcaattatattgaccattgagatcatttggctctctgatgtggcatgggtgtgtgtgtgtgtgtgtgtgtgtgtgtgtaacagtttgagtctggatataaagtttgtgtatatatgcttaatgttgtatagacaggatatttagttgactgacttgattattttcctttaaggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgtaagtattgctgttttcatgaatttgtggtattaattttgtccttttactgttggtggtagttttggttcagatatattgatataattctgtttttctatgtttggggtcataggttcttcattttggaaaatatagagatgtagcagagtgtggggtatgtatctttaatatatatgaaacatttttagtaagaattttttcctaaacagagaatttgtttagctaatc

SEQ ID NO: 8258 - DNA, 1068 bp, Homo sapiens
tgtcttgctctgttgcccagggtggagtgcagtggcgtgatctcggctcactgcaacctccgccttctgggttcaagccattctcatgcctcagcctctcgagtagctgggattaaaagtgtgcaccaccatgcctggctaatttttctatttttaatagagacagggttttgccatgttggccaggctggtcttgaactcctggcctcaagtgatctgcccccacttggcctcccagagtgctgagatctcaggtgtgagctgctgcgcccagcctctttagctgttttcccttcaactattggttagaccaagatcattattctcgttatatttaagcttctttggttgtatctaacagaactagactagctcatgcaaaaaagagcagggttgggtgaagaggggcagagcagactattttatcactagcattttagagaatttaaagcaataataaaatgaactaaaagttagttggtctgctttttattatcaccatgaatctaaacagacaatctgtgcccttattgtctgtacccagcttggacctcttctaccactctgtccttggtaggccactgaaaaaagttaatttatattaaggctataaaacccaagaacaggggaagtggttgggtattcgaagagactgagtggaatcaggaactggaaagctagcaggaatccaagcaactcagtatttcttctcttgggatacattaatctctgcacactttctctttctctactccatgtctcccaaatttacttgttctcggttccaacccacgctagctagcatctttattttcaggcatagaaaatctgattggcacaacatggagtcaggaatccattcactcagggatcagtcatctgtggccatggcacagagttaggtaggacaatcgtgactgttatccacacctcaacattgggggcgttctcaaagaagaagaatagctccggcagccatggcagatggcatacgtaggagtttttaagttataataacttacacatggttttaaaaaaaatcaacatgatggtatgaactgagtgaaa

SEQ ID NO: 8259 - DNA, 1050 bp, Homo sapiens
agccgcagacactaagggccttgtcgggggaaagcaaataactgctttggtctattccatgcatctatgttctctgggttgaccctgcagaaatctataaggctgaggtcctgccgtcaaggtaggaccagtactctgggcctggccccgctgggttttgtcatccacttctagacaactctgcagggcaaggctgttttctgccaggtaccattactggagggctctagacctcgagaaatgtgtaattaagaagctcatcctacctctcataatcatcctaccccttccttgctgctctcacccccaaagattcctgctgaggggtcagtaggtcactcagaagacaatggagagccactgacagggtttaaggcagggaaccacaagcctagacttgcattttgaaaagataattcagggaacatcatacatctatgcggtccttgggggcaaatgctagagctgagaatggattccatattagatcagcacaatgtttcctctcatcctgccaagaactgaactttgtctctccatgcatcaaactcttcgataggatgccccagtggtggacacacacagcatatttgctgttgttgagttagccacttagaggattgaatcagtaacatcattttctctttttagcaactcgttttcattgatgttaccttgcactctattcctccctaacccatgtagctctgtccaccctaattttccccaagatgtcctgaccaagtgggaacaaaagagatcaacagtagcgctttaattatatcctctcacaaaagtctgcacctgcagtcactttcaatctctcttggatgagagagagtagaaggtagtagagtggagtgggaagaactctgaacatgaagtccaaatacctgagttttcccctgttctgccccttacttttcatgtgacctggggtcatgcctccactcgcttacctgtaaaggaggaccaggtcaccttgcacatcctaaagcacggagtctatgattctgcagttggttcactgtgctacttggagggatatgg

SEQ ID NO: 8260 - DNA, 1066 bp, Homo sapiens
tatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaatactcgtgtcttaccaaatggtttcctgtgcttggaggtgctgactgagtgctgttgtgaatgcaggaagggcagggctgccaagggtcttatgtgctacacacgggggtgacttgccagaggggttgactgagaccagcagtacctgtgacaggttgaggttgatccagtggaaaatctgaatcagttggttggagccctggctcggttgcttactggcacctcaatggaatcatcgttcctttctgagccctaccagttccccagaggagcaaacaaagagccacatggtagagagctttgc

SEQ ID NO: 8261 - DNA, 1099 bp, Homo sapiens
ttctggaggcaacttgtaatttggcatagctaggccactgccccttaattatctcatcatctttttttctgcaactgttaaaatgcttttctttttacttaatatagaagggtaagatgcccttaaaatccccctgactcagccacagtcatcgtgttttctttccccagtgccagctggcttttcttcactgtccatctaagaatacagtttgagaaaaatagtatttggaaatatactgcttgtggatggatccttgaggactaagaagagggcagacattggaagttgacataagaatgttctaaattaagtaattatatgtatactcacatgcaataccatttatattttttctttaagagaattcagcctggccgggcgtggtggctcacgcctgtaatcccagcactttgggaggctgaggcgcgtggatcacccgaggtcaggagttcgagaccatccagcctgactaacatgttgaaacctcgtctctactaaaagtacaaaaattagctgggtgtggtggtgcatgcctgtagtcccagctgcttgggaggctgaggcaggagaatcacttgaacctgggaggtggaggttgcaatgagccaagatcacaccattgcgctccagcctgggcaacaagagtaaaactccgtctttaaaaaaaaagagagagaattcagcctaagttggtcctttttcctctcttccctgtgttaccagagggaacatcagagttccttcctctttttcttccctccttcctttatttattcatcataatttactaagtgcggggtataaatcaggttacatgtaagacacagcctgtcacattcaccagtggttccaaggttatttgatggtaaatgcctgtaatcctagctccacaggaggctgaagcgggaggatcctttgaacccaggagttcaagaccagcctgaccaacacagcgagactccaactcaaaaaacaaaacaaaacaaaacaaaacaaaaacccaaagtgggaaaaaaaagaaaatgtaattggcttgtgttcagtagggccgaggagtataacagaagcagaggaaagggggcaaataccagttccc

SEQ ID NO: 8262 - DNA, 1064 bp, Homo sapiens
tggtgaaactttttgaaggcagagagctcagagtgtcttaaacacttggggtgtaaataacacacagccctactcctgtaattcgcccaagaagacccaaattgatacccagctggtagaagccactcaaccccaagccaaataatacagcctgtaacattaattagggaaggtactaataatacagcctgtaacattaattagggaaggtactttgcctccacctgctttggtcttcccaggccctgagcccagccagcactttactctcttcttcacttcatcgagcaagcacaaaggcattagtggtgttttgcttctagcatttcacagggtgcagcctccataagtcactttgtgactttagtgctggagggaggacacttcatttttacccaaacaagtttgttccgcagacttcactctctctgcaaagagacgtgtgtgttttagaggaagtgggagccccagccgattctgcaagacttccgagagtcagatatccagacagaagatgcggacacctgggtgaccagacagcgaagaggaaagaacaaaacgagcatgtgccaagcctgtgagggagaaagggcaacaaaccagtgaccttccacagaaatgtgtttaaacaaaacaaaacaggtgattctgggtgcccagcatcccagcccactcatctattctaggaggtgacaagccaagatactggctgtgggcacctgggctctttctgaaggtggtcttcctggccgtcatagcgttccctttttctgctaatcatttttagttctgaccttcctttgtgctgatcttcagaagctggagaaagcttcgtatttctgggaaaacaaaacaaaactcagaacccaacgagatttagcctgtcaggcttgagtgcgttaggtggagtcttgacaaggcaatgaactcattctactaattgtaattagcgtggggcctttagcaagttctgggctcctcagacttcagagagctttgatcggcctcctcctcctcctaataaccatgcctcatgctaactggtttagtgcgtttttatgcaa

SEQ ID NO: 8263 - DNA, 1050 bp, Homo sapiens
tcagctggggtaagtgatttgctaagtaagggcttggagcaggcattctggagctggggcctccatctgggtgttctccacgcctatctgtatgaatgctccttgctctccaagcggacttcttcatttgatgttcactgtggtgtgtttcagtagtgactgccacagcccgactctaaggaggtgctgctgtcaccccaccctgctttcagttctttgctgcagaagacagaatgtgcgggagaaagatgggaccttaaaagactagttgctcttcctcactcatgtagacgatttggctttgaatcgtgaattattgcttcttttgggcattccagttctgcatttccagagaccctcaggtatgtcaagctttttgcctggcatttgatattttgggggcaaagtacagtggaagtggaaatggtgcctctggttttgtcaaggccagatatgtcttctctccactccttgtgttttttgagacagagtcttgctttgttgcccaggctggagtacagtggcatgatcttggctcattgaaacctctgcctcccaggttcaagtgattctcctgcctctgtctcctgaatagttgggattataggcatgtgccaccatgcccagctagtttttgtagtttttagtagagatggggtttcaccatgttggccaggctggtctcgaacacctggcctggagtgatccgcccgcctcggcctcccaaagtgccaagattacaggcatgagccaccgtgcccggtcttttatcagtttaactttccagaaatttgttccccctgcctgtccgcatcccttcaaatgaaagctgtaagcagcaggcagttgttgtttgggggcccatcagaggccgcatgtcacttctggatgggtcaggcatcactaccagccctgacttgatggcggcagatcagcatggcactgtcaactagcccttgacataaatctgttgtaactcagccccagacatgataggacacagcctgaaagcgcacaggaatccgtaccagagcgaagtcccccctcagg

SEQ ID NO: 8264 - DNA, 1029 bp, Homo sapiens
agggggttcttaaaaaccatcttttatgccacttcgaagtgcctgcatagaccaagagagatcgcaggacagagggctcattcaacgtgactgtgaaattggcacagaagccctcagcgttgggtattacaggggttcaggttcccctggagcccctcagcagagagtaaagcattattgagcatgaaccaagtatatttcagatctaagaaaagatgatttttaaaacttttgttataatcactactaaactggttgttttgaagcataggttaattagatttacattttctaggttagttacttagatgtcattttaaagactttttgatgaaatgttatgcttaatccacaagtatgtttagggggagaaatcatgactaatgtacttatcagcatgtttatactttatggagattttttttcagtgaagacatttcagctttaatcccacatcaagcagtctttgatgaggacacaggtatatgtttgtattagccaacgtttatggactgctcccctgcgtcgtgacttaccaggtgcctcccatggagcaagttgctcagtccttccacagcccaaagaggcagacactgttattttgcccttttacatttgagggcttgccctacccctacctcataggtggcacagctgccatttggacctacgtggttttgcaccagaatttatgctcttgctaaactgcttgcttcaaatgtagttccgtgttttgtaaaaacactgttgctgttgaatgagaaacataatgaaagtaatggctccccaaaagcatgcaaagatctagcccatggtatacagttgagagcaaagttggggatatgatgctgttctttcaacttccaagacctctgtgggttatttatttgtttgtttttgagacagagtccctctatattgcgcaggctggagtgcagtggtacgaacatggctcagtgcagtcttgacctcctgggttcaagtgatcctcctgcctcagcctcctgtgtagctaggaccacaggtgca

SEQ ID NO: 8265 - DNA, 1059 bp, Homo sapiens
agccaccgcgcctggcctgcagattcattttagataagattgttgagtaaacatccctgttaagcatctactatggacaaggctgatctctgcttcagtagatctttaatttggtacatgagttccttctccaaatgagagttgttaaagctgttcacgagccttggtataaaaggggcttccttaggtagaggagcccgttctaagtgcctggatggtgtttgtctccagctgttttgcagttcttgggaggccctggcatttccatgtgtgtcctttccaactgcaaaaacatacagaggacacaaggctgctgatgaaggaaacacagtagggctatcttatagtattattatttttctagatcttacagattcaaggttcacataaagctagtgtattttaggaagagctattgtaaaattataaaagagttccagccgggcgcggtagctcacgcctgtaatcccagcactttgggaggctgaggcaggtggatcatgaggtcaggagatccagaccatcctggctaaaacggtgaaaccctggctaaaacggtgaaaccctgtctctactaaaaatacaaaaaaaaaaaaaaaaaaattagccgggcatggtggcgggcacctgtagtcccagctactcgggaggctgaggcaggagaatggcgtgaacccgggaggcagagcttgcagtgagccaagatcgcgccactgcactccagcctgggcaacagagcaagacgctgtctcaaaaaaaggaaaaaaaaaaaaaagacttcctcccctcccgtatcaagttcattaaacatatttgtgagcttgatatttaaagagaggctgtgtgctggtgtgatgttagcagtcaccagggtggggctggtcacacatgggagcctgggtggagggttgtgcctggattttttatggtggcccccaaccttggatctctgagacctagatgagcagcactgcacccgtaccctgctgtatggctgtgtctgtgttttgcagaagcagattttataggtgtagctttgatgattgaaatatcacccga

SEQ ID NO: 8266 - DNA, 1060 bp, Homo sapiens
gtattacagtgcaagcacgctttggcaatcaatttaaacattttcttgtggaatattcttccatgctatggtttggtttgtttctaaagccccataggatgtggaaactaagtcaggacagattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacaggtgagttggcccgccagcactatgctctctcttctctgtagccattacatttttttggccaagtgaaaaggtagtgagatctctaattgtaattggatgccaggcatacagcttcatagtttttgaaattcttctttgggacctggtgcaccagaaaggccgatcattaagaatgatagaattcttgtgcacaaagtaacatttttcttaagatagtacgcttttatttaagtaaatacatgcttttttttttttttttttgtaccactgacatctctggcatttagaatatagggttgaaatttggatactcaagatttctgattcatttattagagtttgagtttctctccatgatttccttctatgcagtgagcgggacagaacaggccccctttgtggccgagtttaaagttctgctttcagaatgttagttgacgatgagaagggccacacagggactgag

SEQ ID NO: 8267 - DNA, 1058 bp, Homo sapiens
gagagaaaaccttccctctgtgcatctttttttggagaacactgtcatgaacagccgaaaacatcagatcaaaagcaagagggatactgacaaaacagggagtgcggatttccactgtgggtggggacattgggagacacggtgactcactcctcagtaagtgcattcttaggctctttactctgtgtgcatttttattttctcatgggcaacaatataatttctttcaaacatgaagagccatccagcatgtttctcaaaggcagacttaaatgatatgaggggtgtgcctaaatatataatttttaatggttaccatattggaaacattagccatgatcccatctgatgactaggaacatgagccagtctggagtttctggagaaatccagctaccgctgcagaggcggctgttagctgttgttaccggcatccttgttagcgaccagggaggtttcagtcccgacttgtgtctaccagacaccctgacaactggttagaaagagaggactgcaccctttcatcctgcgtacttatctgttgtttgttgctttgacttctttttgttctccgtttttatgttggcagtatttctcgaggtagagaactttcacctttatattgtgcggagtatttgtcccttcctcgcccccttaaagaacacgtagtacctatgccttataaggtctctgtttgatgtgaggaatttggtcttcttgcaagtcggctcttgcagaggggaggctttgaggatgtctgggctgcagcaggctgtcttcgttgctgtgtacacagccctcatggcagggcatgcaaaggtggttggttctgacttcaatggcgggactccattgcctttattttttaatttaattattattattattattatttttgagatggagtttagttctgtcacccaggctggagtgcagtggtgcgatctgggctcactgcaacccccgcctcccggattcaagcaattctcctgcctcagcttcccgtgtagctgggactacaggcacacaccaccatgcccatctaatttttgtgtttt

SEQ ID NO: 8268 - DNA, 1046 bp, Homo sapiens
tgaaagggttttccccagaacagtgtgtcccaagaagccctgaagggctggagatgtaccagctttctctgctatgtccagcaagtgtattttcagaaggtaggaggctcgggctgggctggccaggcagccaggcacacagactcctcattgtacatccaagccggggcgtgcaggacttcaacatagcttgtaacgtaagtatctatttcctgggcgctacatgatctaatggcctgtcgctttgggaaatgctttctgaacaaaagactcgatttatttatttatttattttttgagacggagtttcgctcttgttgcccaggttggagggcagtggcgtgatctcggctcacggcaacctccaccgcccaggttcaagcgattctcctgcctcaccctccttagtagctgggattacaggcgtgtgccaccacgcccggctaattttgtatttttagtagagacggggtttctccatgttggtcaggctggtcttgaactctcctgacctcaggtgatccaccctccttggcctcccaaagtgctgggattacagatgtgagccactgcgcccggccttttatttttttaaattattattatttttatttatttatttatttttttgagatgaagtctcgctctgtcacccggctggagtgcagtggcacgatctcggctcactgcaacctctgcctccctggtttaagcgattctcctgcctcagcctcccgagtagctgggattacaggggtgcaccaccatgcctggcttaatttttgtatttttagtagagatggggtttcaccatgttggccaggctgctcttgaactcctgacctcaggtgatccacccgcctcggcctgccaaagtgctgggattacaggcatgagccaccgcactcggccaggactcaattttgaagttcttatgcaagcaaagctgcccatatctaggagtttatgcacacagtactgattcaatacctgcgtcttagtggtccatcaggaatttttcactcatgaaatatgactttaataca

SEQ ID NO: 8269 - DNA, 1027 bp, Homo sapiens
cacattacagctattatgtgtgcacaagcaactttttaatttttaaatgagaaaaaatgaactagaagggatttgggatggggaaggtgtattagagtattcttgtcactggaaggacctatgtaaattactaactagacatctcatagcattggctagagacagttctttgctgaatgacagatagatgcatccaggctgtggacctgaaaggtgaggtcaaactacagaaggtgctgacccagccaagttactgtcctgtgtggccatatttgagtgaccagttactaccctagataccgtcagtggagggacccactttcttaatgctggcggtactaataaataaaatgccaactttgtacatggcttgcaatttgtgttttattcttattatgtatacacacatattagttgtgggtaagaaacatcacttgtaaataggtgagatgacagattggctcttttcctcctctcctcttctatagtagatttaaacttagaactgtagcacagatctttgtgttctttttttgttgttgttttttaactttaagttccgggatgtgcagatgtgcacattggttacatagttatacatgtgccaccgtggtttgctgcacctatcgacccttcaactaggttttaagccccacatgcattaggtatttgccctaatgctctccctccccttgccccccactctctgacaggctttatgttctcataaagggtttactatcagtagtaattaagattttaatattttgtatattttactggggtcaaattttgtagttttattggtcaactacatccaaagattatgtcctcaactagatagttaactgaaaactatccaaaactaaacaaaattctattctgtagtattatacaatattgtttatctgttttagcaaactgcacaactgtgtaccgtatgtttaaaataactctttgcttttgttttctttgcaatgtaactgtctgtctgccaagtgtctggtttctccacatgtgtctgcct

SEQ ID NO: 8270 - DNA, 1155 bp, Homo sapiens
atggaatcctgcattctgtcatgttcttagaatcgctcaaatcttagggatattggagttaatagccagttgaattttagatattgctcatgacgttttctgattattcatttacagcttccaaaattgttctattcacattaacattatttatacctaatacttgaccattgctgtataataccaggtaactggagcatgaacgctgaatattttagtgtttaaactagaaatctaaaggcaagttttctagtcccgccagtcattagctttgtgactaggcagaacacaacttctcagcctcagtttcactgtatgtgaagtgggaaattcagactacataagttaagatcctaatatgttttatgacctctgaatctttaagattcctttgtgagaatcaaactacttaaaagctagaatgcattacattacacaaatgtatgatgtatgattccagaacacccaagttagtgtgtacccacctgttttccataactgtgctcaatttcaccacactgccctttcatgcaccttctctcttcctcactgttgtgatcagaagacagaagttgcagttttaggtgaggtcatgcgtagaatagtgttttccaaactctcaactgtagtcccctgtaagacatgcattttatgttgacatataatactcactttcatgtatctgtgcacacgcgtgcatgcgtgcacacttacacagctgaaacaaaaatgtgctaaatagtactcaccctcactcgtgtggtacactctggtagttttgaatctgttctggtttttaattttttaaagaaatgctggtcacaacccattacatgaatttcatgcccaagaccactcacaatttgacaaacactagcctgggagaacttggtggggaggattgtcactccagttctgccatgaattctattttagtgatacggcagtggtagcagtgattgctgtgattaatatgtattggtcagagcattttgctaaagggttatcatgtatcatcttatttcatcttcatgatgaccctcttgctcttctctgtaaataaatattcatgaggccaatgactgattagagataggagggatttgggcaggatggtggggagggaagatgaagagggatggaaataaaaataca

SEQ ID NO: 8271 - DNA, 1034 bp, Homo sapiens
aggtatgacaagatgtggccatggtattgggaagctaatgtaggattaaagtgaaagtcattgaagaagactgaggcagccaagacaacatccacgttttttagcaaaagctggccatggctgggtgcagtggctcacgtgaacctgtaatcccagaactttgggaggcagaggcaggcggatcacttgaggtcaggagttcaagaccagcctgcccaacgtgatgaaaccccgtctctactaaaaaatacaaaaattagccgggcgtggtggtgtgcgtctgtaatcccatctgcttaggaggctgaggcaggagagtcgcttgaacccaggagctggaggctgcagtgagccgatgtcacgccactgcagaggaagcccagagagtgagatcaactccagcctgggcgacagagcaggacaatgtctcaaaaaaaaaaaaaaaaaaaaaaaaaaaaaagctggccacatctggaggtttttgtttcttggcgccatttaggtgtaagaacggtaatgtcctgaatgacgatccttttcatttaccaaatggttctaatgctgccaacccccaatgaacataaaggagcatgaagtgcctcgtttgtatcaatacattatggagaataaatagaatacagttctttagagaaagatactttcagattcatgtgatccttagggcattaaatacgatgcactccattgtttttttgttattctgtttcaaagaaaatgactgtcttgacccagtaagatgatttcataccccactaaaagatcacagcctacaatggaaagacactggttgtctcaacttttaaagctgtgtgttaggtttcccaatttgtgggtgtgcagttattagctgttaaacgtgaggttttcagtgcccatgagcatgattttcctttgcaggaaagatgattccaaggtttcctttaattttagaaattagcattcagctcattaaagtaacaatctattaaagtaacatctgtttcttctttaaaggtttaaatgcaaattacaga

SEQ ID NO: 8272 - DNA, 1033 bp, Homo sapiens
tggtagacattaattaactgagtgtggctactttagattgtgtagtcagagggtcctctctgaggacaaatgtttaggctaagatttgaatgtcacaaagtcagccaatgggaagttttagggtcatttcagaaagacactgaggaaacagctagtgtagcactgcctagcctttagttgctgcagtcgtcagttttgactggagtttatgacctggagaacattttcataagacctgtgcttaggccatatcttcagagattttaagtaattgaactctgggatcaaccatgggcatcagatttgtttaatgctcagaagattctgatatgaagtcagactagagaatcactgtaccagattattttttcacagctgagagcctcatgaggaactagaaagataattattccccattttaaagtttgctgttttctgtttattaaattcagaattactcctattgaagaagctcctatctttgccctgtcatctgtggcctagaacatggaacactgaccaactagagaattcccatttttacccccacttgagacctttatctgtactgtactgtcgttttttttccccttccctttgcccctcccccaagcttgcaaattccccatcttatcatttttcaactccagtaatctctactggactcttaagactagatttcatcattcacccacctaccccatagcagtttacatttcttcccagaactagtctatctcctgtgcatacattccatgagaatctaattgacatttaacttcttgtgtcccaggtggcaaacaatgtgcctgctacatagtaggtatttaatgcttaatatacatttgttgaactaatgaatgaaaatactaatgcagagagctgacgagtatgtaggatagtgagaaatgccttctttttttttttttaacaaagatttgttgagcatgaatgggatggcttcccctttacaaataggttataacttagtaacagatacgcagttctaacagaatgtgataggtattgtgac

SEQ ID NO: 8273 - DNA, 1020 bp, Homo sapiens
atatgactagttataagatttggaatttcactttggcaaatagtgacaccttactgatgttccttgggttaggaaaaaaaaatgttatttatctttgtaaaaaatgccttttggtgttgagtgtttcctttttctttaaaagataggaatttaaccacggttacttattaaacaaataaggcatttcaggagcaaagtggcttgaattatctgttgaatagtttatattacaaagagaaaataattatcatttttctggtaccttttttttttttttaacttaccaaaaaggaagtcattacatccaaattgctaggatcttttgacaaaattagcagtgtattttctttggtccttattccccctacccctatacttagaaaaagaacttactgattgtaactaataggaggtctaactacaattttgtgcacttggaaaatggtttagaaaattttggtaagcattaagtgcttctttggcgggaatgagaaaggattatgttatgagtcaggctaccgatgatgaatagaacaatggtaccaggcttggtaaatgagaatactttaagaaaagcaaggtcagtaagaagctgtggagcgtgagcactgtctgtgtgtatcctttttctttttagaggcctagaggattttgaaaatggtactgatgccttttatgcctggattctaaatatagaccataattcttcagttttttaaaaaaaattcaagacttgacagaataattggcatttagaatttttataaattttatcaagtgaatcaaattgacagtgttattaatattgttacaggtaacttagctgttaagtttaaaaagccaaatatcatgcaggttattcctttattgaactatgttaaatcaagatactcctagaagtaatctttaaaagtgggtacataggaagataaagaatatggctatgttaacctacgattgttattagaatgagaaaattatatgcccatctgcagaatcagatattttgtaaaacatatt

SEQ ID NO: 8274 - DNA, 1028 bp, Homo sapiens
attatatatgccaaataattttaagtaactgcctgtatgattaaaaagcagttgattttcatctagtcagtagtagttaattataaaagtaaaacatatattacatatggttatttatccagagtataattctgcccttaagaatatgtaaaaatagggaatatatttgtataggtctctaaatatttatatatatatacatatatatgtatatatatatttgtgggcttttatgtgacatttattccagaaatagctcaaaattttgtaatggctttcatattactttttcctggactgtggaagaatgtgattcttctattcaagcagtcatataatcatttaattcggggcatgttccactcactgtggtagatactagggatgcatagatgaataagacatgtttggttcttgtatgttttagcccacaaataaaatttaaaatataagtgtcatttcatagcattgcattgatgttaaaatgttaaagatcattagtaatacatgtacctgacaagatgtgggcgtattcaaacttgctttacattagttggtctggtaaattatgcaagcagtacctgtaaccattatcaatatgtttatgttaatatagtcatttattcttaataataatcaaatagctaataacatattccatttttattactttgaccagatggcattaaaaacaaatttgtctttattgtggtttcctgctaattttgatttcttggttttgtggtattttctatttatccctaatttatgttatttggatttttggaagacacccaattttttaaggttaatttgaaagattttgcctagcctagtgtaatttcagtgatacctagttttgtcctccatatttcttggtatgtattccttgctcctcacaaatggtatgtgctggaagtttttctgcaggaagctagtgcttggaggacatggatgttcccaagaaggtctaacaagaaggggacaggtttttacttcagcattactgggtcttccttactggtgac

SEQ ID NO: 8275 - DNA, 1064 bp, Homo sapiens
tcaagtgatccacccgccttggcctcccaaagtgctgggattccagtcgtgaaccaccgcaccccagtctgcagtgctttttatactagacatgatgttgccatttgtaaaagttaaagtgggcctcagtaaaatatggagtgattgacatcagtgagtgaagtgttcattgtaagcaaattttccaagcattggaaacgttttttattgctgagatattatgtactctaataatttaaaatgacaatgttcccaaaatgtcttgtgttcttcctcagcttctcaaacagaatgccgagcaggacttgcctgttgataatggctctcatattttcctaggaatattcttctgctcttgtcgtatttcagtgtgccatgggctactgcttttatctctaaagttactctgttgtcccctttatcctttctctttcttgctgacaattcttgtgttagtttgtctagtattagcatttgttccctttctaatttgtaatttcttaatatgctcgttaaaatatggagcacctaagtactgtcgaggcatttggtaactgtttaatcagtgagtaaatcagataaagatctcttgctcttgtggaacttgcattctgggggtgtggttgggggagaatggtcagagatagtcattaaacaataagcataatacatcagtaaattatacagaaggttagcagggggtgttgtgggaaaaatagagcaggtataaaggagggttggaagtatcgattattggcttggaaactagatcaccaagtttattgttagtaaagttacagtcaagaggaaagtgggaaaaggagcttgcaggactcttctgtaagttgggaatataagcattaggaggtgcctttttgagtcctcattttcacttctattgtttttttctggggttttgtatttgatttcaatgtctgaagttctggagtagcttgataattgacctctgcttaaggtttagctttatataacaataattattacaattaatttgaacatacattgttttctgaaagttgaggattaagaccatgaaatgggat

SEQ ID NO: 8276 - DNA, 1040 bp, Homo sapiens
aactagttgaatttatgccttccattttacttccatttccatttcctcgatatgtccatgtttttttttttcctctgttccttttttttttttttttgagatggagtttcgctcttgttgcccaggctggagtgcgatggcgcaatcttggctcactgcaacctccgcctcccgggttcaagtgattctcctgcctcagcctacctagtagctgggattacaggcgtgtgccaccacgcccggctaattttgtatttttagtcaagacggggtttcttcatattggtcaggctggtctcgaactcctgacctcaggtgatccgcctgcctcggcctcccaaagtgctgggattacaggcatgagccaccgcacccagccttcctctgttcctcttttactgcttgcttttgcattaaatattttctagtgtattaaacgaatattttctagtgtaacattttaattccttgaatgatttttttcactatatatttttaagatatcagtggctgctctagtatttaagatagagatcttaatttacacaattgacttcagatttatatgaacttaattccagagagatgtaaaaaaatgttacttctgtatcattttagtccctctttcccttttttgtgccattattgttatacatattacatgtatctatgttaaaaattcaataattataattattcctttatataattgtgtcttttataaagttgagaaaaggaataagaacaattagttatttataatttcttacgttaaccagtttatttactatttctggttctcatttgttctatggattcaaattaccttctagtatagctttgctcctctctacttaatgaaattactgtcaaatacattaattttctccatgttattgtcccaatggtacaattatctacataacgtttttacaattttgtttttttttttttttttgagactaagtctcactctgtcacccaggctagagtgcagtggcgtgatcttggctcactgcaacctctgcctcccggattta

SEQ ID NO: 8277 - DNA, 1024 bp, Homo sapiens
ctaggaagcttcctttgatattctcagggggtctttttgctttctgaactttcctccttcctagtgctctggagatgatgcctttctacctccctgcttagcaggtaggaatagttggacaaaatgtttctgtggcccggtgtatttattcaagacttccccaggagcttctcctagtaggcttcaggcctctgggaagtccctttatgcagacttagagcagcactaaaggcattcatagtctgaattggggtggtagacaggtatgcaattccagtgcctttagaattagccattggattagtagggacagccagcttagtgtgaaactggaggttagagaggtttttctgagggaagtgacatttgagccaagtctggaaagatgagtaggtgtttgccaggacaaaaagggagaaaggtgttctgggcagcaggactagcaaaatgcagaggtgtggagggtaaaattgtatgccattttgaggaactactattaatacttagtttagtatggccagaacatagagtacctgttaggaggtaataggggatgaggctttttttttttttttttttttttttttgagacaaagtcttgctctgtctcccaggctggagtgcagtggcgtgatcttggctcactgagcctgggctcactgcagcctttgcctcccgggttcaagcagttcttctgcctcagacccctgcgtctctgggattacaggtgtgtgccaccatgcccagctaatttttgtatttttagtagagacagggtttcaccatgttggccaggctggtcttgaactcctgacttcaggtgatccacccaccttggcctcccaaagtgctgggattacaggtgtggactactgtgcccgaccaagggatgaggctttttggaggtttaggtaggagccagatttttaaaaaaataatattttagaaatacttaaactgcgacatacctatcagcagtcttcaactagcctcaacatgctgccattcttgtttaatctatctc

SEQ ID NO: 8278 - DNA, 1051 bp, Homo sapiens
tttcaccatgtcagccaggctggtcacgaactcctgacctcaggtgatcacccgcctcggcctcccaaagtgctgggattagaggtgtgagctaccttgcctggccagattttagcttttataactccttggctactctgatttggatacagatttttttgtccttccaaaattgtaaacagagttgaatacactacttaaaatattttacaaggtgtcttttatctttgatcataaatagtaatgtattcaggaggccaagcacgcttaacataacagttctccagtggttacttgtactttttgaatgtaatgatactcaggatgtatagagatcttttaccactgggtgtcgctctttcttcatagaattacgtctcacggcacacatgtccagtttccagctgttttcattgcattgcatttgactgttttactgttctgttttgctaatacattttaagtggctagtaaataatgttaaagtaaatgttagccattactgcgtgcaattactgttttaaacttatccttattttacaaggttacttgaccaagatggtgacattgtaagatttgaacaaaggaaatgtgacttcagagtcatggttgttaactatgctatgaagtaggaaaactttatgaggtctttttaactcaaacagtcaagttttaagttgagggttagcaatgatgaatgagtggccaaaaaatgtattcatatttttagtctttcttagaattactggtagttgtgcacaactagagggtatttatttgtgtgtgtatgtgtcgtgtgtgtacgagtgctggaaatactctgccagtttacagtagaggcaggcttacataattcagtcatgaaagctgaggcttatagtttagaggggatcgtcctcttcttaatgagtctgtaagttacaaaaataacttttttctttatttactaactggttggtttttaatattaaaatatttaggtgctttaataattgttgaaacttggtttcttggatgggagttactcttaatgcatattccacagaatgaa

SEQ ID NO: 8279 - DNA, 2033 bp, Homo sapiens
tcggctatgctttcaagtctagtcagtttcttctcccagttcccactttgctatttcatgttttctcactgcttccctctggcatcaggggtagaggcgtcttttctgtggaagactctgggctccagtgcttcctgcctcctaggggagcctgctctctcagtcatccccttcacctgtatctggagttttcccttcaaccaagcccatctctgattttaaaaacattaccatgaccctcttcaagctgctatcctatcacctctttaatgagaatcacttgtctcccctcatgtcagtccgtggcagtgtggcacctcctttcccactcattgagtctgttgtatgccagctttcctaattcctttccaaattgttaactccagtggatatatggccgtgcatttgacacttggagatctatgccttgaaactgtgtatccttgatgtctgttgctttccctggttcccctttcacagtcactgtcatcatttatgctgacatttacaccatgaacagtctgacaactttgatgcctaaacttcttgaaaatgttacagatacatgcaatcagttgctcactggacagcttgtgggttattttagacatgtacaaaacagcccttcaaatctccctagaagacctatactggcacttttacgactttattttctcagatggaaaactaggattgcccccaccctccaagcccttaccttaaccagtcactaatccccatctgatctcttctctcagtttgcccaggttactaccacagactccaatctgttatcgcctacttctgtccttcaggtctcttctgcttcttcagaaccacttgtcatattactcagatttcccattgccttcaagattaaaaaaaatctgaactctttagtgatgttcaaagcctcgaatgctcaggtcctttccctacatttccaggcccgcttcctcaggactctaaactctagcatttatttttttgttaaacagctttagtgaaatataactcacaccggatgcggtggctcacgcctgtaatcccagcacgttgggaggccgaggcaggcggatcacctgaggttgggagttcaagaccagcctgtctctactaaaaatacaaaattagccgggcatgctggtgcatgcctgtaattccagtgactcgggaggctgaggcaggagactcgcttgaaccagggagacagaggttgtggtgagctgagattgtgccattgcactccagcctgggcaacaagaatgaaactgcctcaaaaaaaaaaaaaaaaaaatatatatatatatatatacacacacacacacacacacacacacatataatatatattatatatataattaacatacctacaatttctatgtaaactgtataaatcatttttcatctattcatagggcttagcaaccattaccacaatctaatttttgaacatttttgttcccctgaccctgaacccattagctgtcactctacctcacctaccattctgacctcttacccctaagcaaccactaatctactttctgtaaatttgcctgttctagacattgcacataaatggaattatataacatgtagtcttaacaccataactttctaagttcttgtctaaagttgcccccctttttatctgtcatttttctactttctacttgtttcaaactttcctaatttgagacacttaaaagtggttacattttgcaaaccaaggccatgttgcttttcattttgtacctttttgtaactattgaacttacttttttttttttgggaaggagtctcgctctgtcgcccaggctggagtgcagtggtgtgatcttgtcttactgcaagttccgcctcccaggttcatgccattcttctgcctcagtctcctgagtagctgggactacaggcgcccgccaccatgcctggctaatttttttgtatttttagtagagaacggggtttcaccgtgttggccaggatagtcttgatctcctgacctcgtgatctgcccgcctcgg

SEQ ID NO: 8280 - DNA, 1474 bp, Homo sapiens
agtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggtaaccttttcaatgggatggctacacagttctattaaagttcatttggcaatccaaagtatcccttttccccattccagtgaaatttgaatttttgcctccctgtagtgccccattcttagaactgtgtgtaacaggtgagaaagggatagtggttctgcgttcccttctctggattgattaaatttgtgctgttaagatttgcagctgaggccaggcgtggtggctcacgcctgtaatcccagcactttgggaggccaaggcaagcggatcatgaggtcaggagttcgagatcagcctgaccaacatggtaaaaccccatctctactaaaaatacaaaaattagctgggcgtggtggcatgcacctgtaatcccagctactcaggaggctgaggcaggagaattgcttgaacccgggaggtggaggttgcagtggctgagatcgtgccactgcactccagcctgggagacagagcaagactctgtctca

SEQ ID NO: 8281 - DNA, 1028 bp, Homo sapiens
gtgagccgagatcatgcaactgcactctagcctgggtggcaaagcaagaccctgtctcaaaaaaaaaaaagagttcgggtgtgcaagagagaagaaaaggagtttgggtgtgcaagagagaagaaaacgttaataggccagtaagtaggtctgtcagcttgataatgacttttttcagttaagaagaatggaagaatctcatcaagaagcaacagagaaagaagtagaaagaatcttgggattgttgcagacatattttcgagaagatcgtaagtgtaacaccattcaaagtggagcaatttgtatttatctgttcactgaggttacttgtatttaaaaggcaatttcagctgtatgtaatatttgaataaatacatatgcattttatgaggattcttctcccctttagaaatttcatgtgaaaactttgaagttaacgttttcatttttatctttaaaagatggggattttttttgttacaaaatgaaatatgccattcaagtgagaaatgtcaaaagtagctgttccacctcccctcattataaaatgtaatgtgtatattttcagattattttatcagttttatacacacctacctaaatagtttgttttggccgggcgtggtggctcacacctgtaatcccagcactttgggaggctgaggttgggagttcgatacccgcctgaccaacatggagaaacctcatctctactaaaaatacaaaattaaccgggtgtggtagtgcattcctgtaatcccagctacttgggaggctgaggcaggagaatcgcttgaacccgggagacagaggttgcggtgagccaagatcacgccattgcactctagcctgggcaacaagagcgaaactacatctgaaaaaaaaaagtttgtttttttctttttttccaagctaatcataatatgcacattcttctgctacgtgacttttccatgtggacattcttccacatcatttcatatagatctcccttgttttgttcactgattcccattatatggctgtac

SEQ ID NO: 8282 - DNA, 1025 bp, Homo sapiens
tggattggcattttgagctgggcatgtctttgttttgggggctgttactgtgcattatatgatattcaacagcctccatggcctctacccagtatatgccagcagcatatcagttgtgacacccacaaatgtctccaggtattgccagaagacccctgtgggcacgtatacccaggttgagaaccactggtctaaatcatttcactttctcacccaaaggttttaagtacattgaggaatgttttctgccaaaaagaaggtagctttggaagcaggactttaactgtaaagttatcttcacagtaagaaatttagccagcatgttaagacactgaaagctggctttgcgtctggcctcttaaaggttgagtgatgcggattattggatgtggaaaatgattgcatgtggcttaactgggttttttgttttccttcatttttgtagctcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgtaagattattttaaaaatccaacagaccagttatttgtgaaccttaaattgctttttcttgtagggacaaagattatttggtattgtagaggtgacagtcatgatgccgttgtttggagacttttgaaactttgatatgaaagttcataaacactaggccgggtgtggtggctcatgcctgtaatcccggcactttggcaggtggatgcaggtagatcatctgagctcaggaattcaagatcagcctgggcaacatggcgagaacccatctctaccaaaaatacaaaaaattagcccgctgtagtggcccatgcctgtggtcctggctacttgggaggctgaggtgggaggatcacttgagcctgggaggcagagattgcagtgagctgagattgcgccattgcactccggcctggctgacagtgag

SEQ ID NO: 8283 - DNA, 1047 bp, Homo sapiens
caaagaaaacatattcagttatttaggagttatactcttgcttttttctccttcaaaataaaaatgactttattatttaatttctttctgattattaaaggtgatacaaaaaaattaaaaagcaaaaaggtataggaaattcatactttcctaaatcctacaatatatttaaagataaactattattttttcagaaatctctattgtgtgtatacagaatatatgtagttatacatatacacatacacatatctttgtaagtatatggacacagttctctctaaatgctttcatactgcatatgttgctcaggaacatttttcacttgaaaggatatcaataaatacagctttctatggttttatgaatattatgcagttacctattcatggatatttaagtttcttcaaaatttttaatagcatgttaacagtggaggctcacataaagagaaataaaggattagctaccaggcacctgagatttcttcatttcctatagtggcatgtagacatatctgaatttcttgatatttattccaaagagaaaagatcatctaaagagctctcatctcagaaaatgtgaccttttttaaattgtggtaagaatacttaacatgagatctaccctcttaacaaatttttaaatgtacaatatggtgttgttaactatagacactgttgtacagaagatctctaaaacagattcatcttgtaaagctgtaactttatacctattgaatagcaattcatttctccttccccccatctcctagcaaccaccattctactctctgtttctgagtttaactattttagatatgtcatgttaatggaatcatccattatttattcttctgtgcctggcttatttcacttagcatgtcttccagattgatcatattgtcacatgacaaaatatccttcttctcaaaggctgaatggtatttcattgtatgatattcattcaatgatatttcatttcattttctttatcaatacatcagtcaatggacatttaggttgtttctgtatcttggcggttgtg

SEQ ID NO: 8284 - DNA, 1057 bp, Homo sapiens
gcagcagtgtgatagagtagcaagagaaacgatttgatgtcaggtaaagtgacttcaaactcttgtcctgcctcttcttagttctgcatcctatggcaagttaattaatatttttttcaatatgaattcctcatgtacaaaatctaaatgataacactgtaaggatcacagaattgatgtgaaaatttaaaataagtaatgcaagtaaagaactccttgtagatgttgtgtggttcacaaatattaatgtagtaccagtattataatatgggctgagttaagagaaccaggagagctgaagattatggaaaccacagaaagaagaatttcaaaaaagatggaaatgtatacttttcttcctcccacaccatgttctcacctggatacctcaggagattcctaactggcccacctgtcctgctacaatctgttttccacaatgtaccgagaatgacctcaaaggataattggatctcatccttctcctgtgcaaagccccctgactgcttgcctccctttgtacttagaattaatcctgattccttaccttaatctctaaaatgtaggccctgcttgccttctcaacctcatctcctgccatgtttccttgggcagcttgctccagacattctgatatgtgtattccgtaaatatctagatatgttcccacctccagacctttgcactcataactgttctctgtggccagaactccctccctgtgatacttctgtatctgcatttttcttattcagatctcattttaatgttacatctttaatgacacctttcttagccaaccagtgtaaagtagcatgtacctccaaatccgtatcagtttcatcagtgcccttttgaccactttgttgttgtttttgtattggttgcatgtttatctcactaaaagacaagcttcatgtaaacaagacttatctgtcttgtttatggctccaagtattatacacagtcatgcatcaattcacagtggggatatgttctgagaacaaaggtgattaggggatttcatggttatgaaaccatcatggtatgtacttgc

SEQ ID NO: 8285 - DNA, 1049 bp, Homo sapiens
caagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttctgccatatttcaaaatggtagaataaattacagaatttattactactcatttcagtgtttagtacagaaattgccttaaaaattgctattaattgaaatatcatttagttcacattccttaagttgaatcggtagtttcatttcaactgataatagtaaagctatttcagtttagtaaaaattttcttttttccacaagaggaaatgtaaaacagttaagacttgaaattgaaaattcttttaatatttaaaataacttgtttattcaatgtctaaacacatgtcagttttccactggatttttattttcacaggtaaatacactagagtgctagatgcctttttcccc

SEQ ID NO: 8286 - DNA, 1033 bp, Homo sapiens
ggacgctactggcatgacaatactttaggtataccctagccagtttctatatagatatccacctacaccccatggaattccatactatattcaacttaactttaatcagaataatcacaggaaggatttgggaattttgctatatcataaggaacaatcatcataaagtatggggatattgttctctttggttgatatgattagatatcttagttcaggttgctgtaacgaattaccatagactgagtggtttaaacaaacatttatttctcacagttctggaggctgggaaatcttaatatgaaggtgccagcagatcaggtatctggggagggcttgctttctgattgtatcctctcatggcaaagagcagagaggaagcaagatctctggatctcttcacaaggcactaatcccatttagaggacttcacctttacaacccaattatttctcaaaggccccactccagatgccatcaaattgggggttagaatttcaacatatcagcttttggggacataaacattcagtccatgacgataccagcagaaagagtacatctgagttgtaataacaccacccacatctgtaataatactggagaatacttaagtatatttcttgttcagatgacatgatatcatacattgaaattttgtgttaagtaagtaattttttggctaacaaacaccaaggtattgagttcatgtccagtataggaaagataccactaaaaaaattatagcttgtggattttctaaagtatattttgttatgtttgcaaaggttttaaaatttatcaatgccttagaggcatctctgggtatcagttaatttgtggagttcctagattaaactttgagacttgagactgatgataattacatcaaagacaggaaaatggctcagatagaaaacctttattttctttctataagaggaagtcttttgtagttccagaaattttttttttcttttaaaaattagagatgaggtctcgctctgttgcctggactggtcttgaactcctg

SEQ ID NO: 8287 - DNA, 1045 bp, Homo sapiens
aggcgggcaggtgatggcccgggacctctttagccggagggcagtggactgcggcgcctatggccgcgagaaccccgagggagcggggtctcctgctgtcattgccttcgagcaggagctcggaggctccggggcggggactgttgcttggctctgacaggtggttctgcgggaggcgtcccgaggtttgcgtcttcacggggtcccaggggctgggagtcagccgggcgcgggtctcctaggtgtttcgaatcctggcgaggatgtcgctccgaatcttggtgaggctgctgccccgacgccggtcccaggctgattgttgggagaaggacgtttaaagccttcgtattttatctaatgatcctgcccggatccgtctctactgcatgggcacccttattttaggaacatgtgagatttgagaaagacattgtagcaaataactattcaggttcattcggggtttagatctttggataaactgtgtggagcgcgagtagccaagcctagcatgctcgatgactggatctgaagctaaacaagttctagcaaacactaaccacgtggcctgcttagagtccccttgatgtgctggtcagaacccgaaagacgtgtgacaagcggaagaagacataaaggcgtcttaaattgtgtgatctgaggaaattcagttttgaaagaacagaatgtatttaaaacaacttttttttaaacgtaggaactaacaattttaaaaattcaatttaattttgatttatgtcgtgttgtcacaacagctaaaggttattattattgatgagagttcgttacagtgaattgaaatgtctggtgttattttcccctagcggtccaggatgtttcccagaaaaccgtagctgttttgtgttatgataggataagaaggatgggattcagatgtgcccttatcgggtgtgcatgttttttttgtttttgtatttaaagccctttcccatttccctacttaggactatgcgttgtttttatgcaactacagctgttcagcagtactaagcttgaccgtttt

SEQ ID NO: 8288 - DNA, 1050 bp, Homo sapiens
atgatattagcataaaaacaagacatatagactaatgtgagagaatggagaacccagaaataaatgcaagcagttatagccaactgattttttttgacaaaggtgtcaagaacacacactgggagacaggacagcctctttagtaaatggtgctgagaaaactagatattgacattcagaagaataaaactctaccactttctttcaccatattaaaaaaaatcaactcaaaatggattgaagagttaaatgtaagacctgaaactgtaaaactactagaagaaaacataggggaaatgttttaggacataggcctgggcaaggattttttgttgcctatgctcaaaagcataggcaacaaaagcaaaaatagacaaatggtattatagcaaactaaaaagcatttgtacaacaaaggaaacaatcaacagagtgaagagacaatctatagaataggagaaaatatttgcaaactatgcatctgacaagcggctgatatccagaatatataaagaactcaactcactagcaaaaaactaaataattgaattttaaaatgggcaaaagatctgaacagatatttatctaaagaatacataaacattgccaacaggagtgtaaaaaaatgctcaacatcactaatcatgagggaaatgcaaataaaaaccataatgagatattacctcaccccaagtagaatggttattaccaaaaagacaaaaaacaaaagaaatactggcaaagatgtgaagaaatgggaacccttatgtaatagtctgttctcacgtggctaataaagacatacctgagactgagtaatttatgaaggaaagaggtttaattgactcacagttccacatggctgcaggggccccacaatcacagtgaaaggtaaaagggaagcaagacatgtcttacatggcagcaggcatgaaggcttgtgcaggggaactgcccttttatacaatcatcagatctcacgagacttattcactgttatgagaatagcatgggaaaaacccactctcaagattcaattacctcccactg

SEQ ID NO: 8289 - DNA, 1084 bp, Homo sapiens
ctgagagcagcgtgtgcagaggcccagtggtcagcaccacctaccatacagaacgcagccagccgcctggtgtgggagatggggggcactgaggcagggggcttgggtgcgtggcacatggggccgcaccacctggtctagcctcagaagaagtctagacatcaccctgagagagatgggacccctcagagggttttaagcagaagatagtgtaggagtggaaaaggaatatctcactactgtgttcatggctgaggcacctataataaaagactaacgcgagaaagcacacatacttgtttaacgtaaatttcatgtaacccgggagggagccttcataaggaaacggagacccggagaaacgggaaacctgtgcgtgtttgtgcttgggtttgatgaagagagcagtcggggagagggccatgattgtcaaagggggaatgactcaatggctctgtggccaccgtcacaggggacacagggtctcggagaaactctatttgtgtgtggcttgaccagcacagcttgtcgacccggcttcgtgacccagaaccactctcagctgtgactcttggccctggacccctacggagtgagtctgagagagcaggcagggcagcccacccggtcctcaaggcagctccctgagggcggtctcagggctggggctggcaggaggaaaggggcgctggcatgacgcctcaaggtggggttgtggtttcttccagcactgatcatgatgctgagcagagaggggtgcccagtgtgctgacagacacgaatcaagttgcagctgtgactcaggccaggcccatttcgtgccacatctacactttcctggtgcaggtggctcttccatcctgcaggcctcgcatggaggaccttcagtcctggcataaacagtaatagcagcagctcagagccagggctattatgggtcaaatgccgaggttggcacacaaatcggggaacgtgctcgcggactgggtttccccatcatcctaccatgcctgattcaatccacccacgagtccttttccctctttttcccagtatttctagagagctccactgttctaccctc

SEQ ID NO: 8290 - DNA, 1032 bp, Homo sapiens
ctaggaaaggaagcaggcttttaatgaaatggattctgttataggcagtcactcatggggacacagaggaatagcagggctgaacatttgggcaggaatcctggtttcatcagtttcactctgtctgcagagtgtgtgagggggcctcagggtggtgcacagctttcacccgctgagtgtctgggaggtgtaccggggtcatggtggcaggaacacaggcattggaaccccagccctgtcacttactgctctgtaaactgggacaagaaacttaacctctctgtgccttattttctcatcggtaaaatgggggaagatagtcctacctccagggtagtgagagttaaatgacttaatatttgtagtaacgtgtttaaacagtgcttgacaaatggaaaatatgtaactattattattattaggtatcagttattactaataataacaataaactgatcactcatttactcactccccagagttgcaaaccacataaccaagttttggtcaacagtggaccccatatatgatggtggccccgtaaagttataatcccgtgttttcattgtgccttttctatgcttcaatacataaattctaactcttatgttacaactgctcacaggattcctgcggtacaggctgacagcataggagcagtaggctgtacctcgccacctaggtgtgtagggggctgtgccatctgggtttctgtgaacactctatgacattcacataatgacatcacctactgatgcatttctcagaacatatatatccctgctgttaagtgacgcctggctgtatttattgaacacccttgatgtgctagatgcaagctgtacataggagaggaaaatccatcccgtttgctctcatggagcctctgtctagttgagggagtagggccaggcttcatgtaaatgactgagctggggcagcccctcagagctatctctgggtgaggcttctcccatccacccatcattggacaggaccacctgtggaggcttaaccttggttgctgctggt

SEQ ID NO: 8291 - DNA, 1093 bp, Homo sapiens
gacttatgtgcctaagtcctgacttaactcttttttttcttttaaactcaaagaaattaagtcactgggagtcacctccagtatgatttggctgttatctagttttttgcaaacttgggagtccaaactccccaaatctcaagtctgacttacatttcattgtgactcctataccatatgcctctgggaaaatcacatgttcttatgaaagagatgaaaatatgtattctccggccaggaaacagagactaagataatgaatgaaaaaggaaagcctcagtttggtctcctaattttgcttgctccaagattttaaaaagaatgaaaaataaaatcactgtgctgatatttacttaaagcagagtttggtgagttctatggtagtcttgtggtgtgacaagtatctagccctgcttgggccagcggccagctctgtgccttgcggccgttcatttttcctgttcctggactctgtctgcacctctgcaaagtgggattgttggaccaggtcagttctagactccttccagctctgaaatgtgactcagctctgccccagcgcttcctctttgttagattcggggcagaaacagcaggatctttcatcatcttgggcccctaggtcagagaggacctttcttctgctgtctttttgacagctagagtcacacaagaggttcaggattcaagtggcctgaacgtgatggctgaacttgaggccggagctttagacatgttgaaagtctcctgcctctactcccaggtacccatcgtggtactctttgtttcttgaattgccatcgtcccccttatgtcttaaggtccgagagaggaggggccgtgctttcctcccctgatctgtccctggtgccaagcacaatgctgagcacggattagacactaagttaatgcttcctggatggacgaaggatggatggtggctggatggaaggaagacagtcaggtggatggacaaacgcctccatggctctaaaaccagttcatttttgagatctgacagaatttgtgccaatttagctagagagttcacttgtcctttatattcttattcattgtgagtagaattttcaag

SEQ ID NO: 8292 - DNA, 1052 bp, Homo sapiens
ctgcatctagaagccaacttgacaccaggcagacaaacaaaagggaagcaaacacactttgttagttttacctggacctaggaatcttcacgagagagtgaagtttgaaggagtggccaaagcaagatgtttttagaccttttagacaaagaacaatccatttcagaagagacagaacagaagggacctggtggagtaatatacatttctaggggagtctctgggagatctatgggatgtgtaacggcagtggaagagaagggttactttgtgaagtgtatttatcctgggtcattgcagccccaagttcccaggctgtgctgaggagggccattttcttggcctggcaggggaagggtactcctcccagaggagtctatggcttggagtatgcaggaagagacaggtcagctggccctttctgaaactataatttctccaatgttttcgactcaaaataatcaacatatcaatttggcatgttttgggatggctcatccttccacggtgtgcggggtactagactctgggttaagcattttgtgtatgtgacctcatttcttcctcacatccacagtaggagactgagatcattttattcccattttacagatgaggaaacctagtcacagaatggttaaattcgttgcctgagatcatagagcagttacagacttgattcgggttgaaatgcaggtctgcccaactcccaagcctggcataatgtcttattttcgactgcttggaaaccatttttcctacatcccatctttctaccaagttgagaatcagtgagctcaggacgcaggggaggcgctggctgcatattgtagagatctgatcttggggaaatgcctgtttattatggatatggcttatggactaaaacaatagcattgaatgtacgttgtatgcatgtaaggtagttgtgattaaccaaaaccaatgttgatgacgaacttaacagagagtcaagtgtgctttaaaaataagcttaaaaaactgcctgggttttgtatgcacagattttgggccagccaggaagatccctc

SEQ ID NO: 8293 - DNA, 1077 bp, Homo sapiens
attattgattgtgtcacaaagacctttagagtcttttgtgcacattgaaatcattgggggggagaactgcagcatgaacatatttgaagtctctggtccaccctgccccttcgctgagaaaacctgattattttgtgcatttcagagagactgggacatctgctgtgtttggcccatatctcgggtggttgcacaagggaggtggagctgattaccctattagagagcaagctatcacagaataggaaaaagaccccattctccctcctgcctgccacggccagaggccctggttcactgaatcactgctgttgttaccacgcttgtttggcttcctggagcagagctagttcttctgcagattctctggggctgggtgggcttcacggctgtccttgaaatgggatatacagtcccgaatgtgggcatttttctggagcctctggagtctttgttctggcgttagatgggatgttcccagaggacccaggctgttcatttatttgtctgtacgaacggacacgctgcagcccaggcctgtacgactggacacgctgcggtctttgtctttggagccccagcaaatgcaagccctgcacatagtaggtgtttaaataaagaggtgcaaaagtgcgtgggccactaatctggagaaaaccctgtgtctcttttggattaattatctggctaataaagcaagcgctgcgccggctagtcaacgctcactgcaaaatcactggcctctgagcagccctgaaagacataacagatgaagataatgagtttgtattaaggagaaattaacttcagatcatacacccatgagtgttatggccaaaaggggtagtcccaaatccatatcttatatacggagaaacagaggccctgagagatgaagtgatgctcagggtgaccagccaggttagtgatcaggacaccaagtagctccctgccttgctgggaaggtccctcctttgctgctctgaagttttaaaatgcaaattatcatggaagccaccacctgggccgcagcgtgtccggtcatacaggcaggcctgggtcaaagtgtgtccggtc

SEQ ID NO: 8294 - DNA, 1053 bp, Homo sapiens
tgaaaacctcagaaaaactaagtcaaccaaagactttccagcgatgtcatcgactgtgttgtcatccaaaggggaaaataatcccagcttatgaatatttagaaagaagataattgcaaattgctttgtgaccgtgtaaactcgtttttttttttctttcccccagccagttacataagaggaggtgtgggtcagtcccagaaatagatgcagaagcagtgacagaacacgtcttggcggtggtggagagagacagccctgggttcgagtcccagactcgcagtgtgttagctaaagaagtttgagaaacatccgtctctttctttccatttcagcctcctcccccttcccctagctggtcgacgctcaaagctctcctagcccaacactctgtaacttgaggaataatgttttaaacccccaaatctagtcctcccataaaacccagtgaatctctcaaattgattaaatggaggcactcattttattagataggtaactggtattttgccttttctgaagggtagaagaggggaaaaagtgactgaggggaccaaataagaaaaaaaagacaaaaagacagaagaattcgggtttttagttgattccgaatactcgatgcttttgaaacgtttccaagtttcctttacgggaaaggaatgcaaatgatccaaaagggaggagggatttttttcccccttcttttttgtcctgagctcagtacctgggattttgcggcatgtgctgaaaaattatatcttctgggtgcagaaatttgcctgaaagggttatacgaaactgagaatgggtcaaaacaaaacaaaacggaaaaaacaagacttctggccacaggtaagaatcatataatttactgagacatatcattttggcatgttttgttaagggtgaaagctaatttggaagaggcaggaaggggctcttgaggttggtgggaatgagctgccgtaatggggcccgcagaatcacccttgtgtctgctcccagcaggactggcgggggaggggcagggagtagctctctgtgggtgtcggg

SEQ ID NO: 8295 - DNA, 1058 bp, Homo sapiens
gtcatccaatgtactcttgcctgttttcctttcacccatctgtctgtccatccaatgtccatctgatgtccgaggcccagaacatctccccatccaccagcggccgaataagaacagcaccttgtggcgccagcatctttctagttctttctcccctgcggtgatgggcggcccggctgcttatccggggaataattaaattaggaaccaattcagagaatgaaattttatctgatttggccaagcccgtaataagcaaggggctgtaattgtgactccaggatacattaggaagttgttttttcaagggtacgctgggtgaaagcattgaaagaaatatgtggagaccaggccgggagatctccctgggccaggtttcttgcatggcctgggggtgtggtcccacagggcggctgtgtcctcaggctggtccttccagcgtttatgtttccaggcaccatttagctctgatgaggtagataaaagtgttttgtggctggagtgttctctgtgcttaggaaagttctgttaaaatccttatggatatctatctcattgttatcactgatattctaaagcacctttacaactgtaataagaagtaaacttggcagaaactctgtggctataaatcaggggtgccgctttgcaacccccacggagcttattgaaagaaatgcacatactttggtcctacatcagctgttacatcaagtctccggggatggatgctgggcatttgtgtgtgtgtgcacgcgtgtgtgtgtgcatgcgtgcatgtgtgtgcatgcgtgcatgtgtgtgcatgcatggacctggattcgttaagctctttagctaagaaacgctgagggaacttagcagtgattgtaatcattcttctaatgagaatttccagttctcctatggcaaagataagggacagataattagcacagtggtctcaggaatgagcctcatttgtcctcaatctgtgatgagactttgtgactgtctttgagtttcatgttcagattccctgattgtaactaacacacattgttcatcacttggtagca

SEQ ID NO: 8296 - DNA, 1027 bp, Homo sapiens
tctattgggaagggtgtcactgcatcagagagcagggcacaggagccacacccattgtgggcccagggactaagaactgatggctgcccatcatgcctgcggccaggtccctaggctggaggtgaggcgggcagagctccttcatgtactcgtgtgccatgtgttcattcagcagctgttgaatgaattgccatgatgtagaaagtcatctgcatgaaccttttcatataattcctttcaccaaatagatcctacagctgagcctctgggatgatttggcggggctaggacagacagggtcccagccctcatgggatggggacaagcggaattggctgtgtagacagacaaatggtccagaagctgccataagagcccagaagggtggtgatgcaaagcaaggcttgggagcaggggtcagggagtggagggtggactcgggggagtgtgaggagtctccttttcaggtgtggacattgaatttcagagcagtgggtgggaggcacccaccccctgaacaggggatgctcaggtatgatattaagttgggagtgacttgcccaaggtcacatagccagtaagtggaaagtcagggggtctctgatctccagctcttggccagctccttcatctccactgtactgggctgaggcctcttagaaactcccagaggtgtggacactccctgtaattggcagctgtcatttttcccatctacacgttcaggccctgtccccgttcctagggcctcagcaggcccaggattgcagagatgccatttggagcatatttgtatgaaagaagagtcgtctaaattctaaaagcagagactgtttttaaaagtggtagctgacttgggagtgtcattgatctgagcaatcagccagcggacttctctttagcagcttgtgatttggaagtgactcagtcactggtgagaatcacgcagcctccctccccttctggtctgtaaaggggatgctcaggtatgagattaagttacttcaaagggtcactctgttccagt

SEQ ID NO: 8297 - DNA, 1043 bp, Homo sapiens
ctgcctactttgatttgcagtagttgatactttaaaacttcagtcctggcttatctgcctgtcccagggattcctgggctcccaatagtgagccaggatggggaagagctagctccatcagcacacactacatgtggacagttggactggactgttttttaaaagcacaaactcaacatttttagatcttcgtctaggattctgacttgaaaacaattcttgttacaaacagactctttatggtggtgaacaagcagagattgtaagggcccatgaaagcaatacttgggtgtgaagagccgtcatattcctaatggattcacctccaggaatctgatacatggacatgcattttaactgctgcttttattacctcccttaaaaaattagttctgtgaaattcccttgccacttttgcttggaatacatttcctttagttttctacctaatataatcttgtagcccacgtctcagaaacccagaggtccccagttgtgtcatgtatgtttcattctcacttttgattacttgaggccagccgagatctgtgtggataccatattccttgctattttttggtagcctgtgctactaacaatcaaatttaatggtcaatggcttcaaagtaaagcaccctgtttggtattatggattacattccatgactatgatcttgaaatatctagttctgttatcaggaatgatagaaaatattccccatttctcctaaattaagtgaagacttcatggttcatgtgactctcataatatttgatagtatgtattatttaattacttaatatccactaattagactcttttccttctaaagaagaatgtcccccaaacaacacattgtaactttctaaaagacagttggtgccagatgagattaaaaatgcagttactctactagataatattcaccttacacttcggtaaacactcctttaataactatttgttggtttctcaaaagcaatatcccatattaaacagacaattcaaatgtgacaattcctctgtaacaaagaagctgaat

SEQ ID NO: 8298 - DNA, 1139 bp, Homo sapiens
ggggtgggtggtgcttttcccctaaggccatggtggttgctccctcgaggattttagaatcttatctctgagttccccgtgactctcggctcctgttttctagtgaacatgggcctcagtgatgacacatggttgtctggcagttcctttttgtggtagccacttgctgatagaaggagaggcacctccccagtgggttctgtgctttctctgaagcaccagatgttggtgccaggacagagttggctcatctcctaacttgggctgagccagtgatggtctcagccagaggctggggccctgtcctgaagctggtcttggggtagtgttctcactattccaccacagctcacacttcccatctgcactggaagggttactgggggctcagagttaaactggccccagcattattggtcactgtagaaactgcaacatgttgaagtgaatccaacatatcgaggaagaggtatgtgtgtgacgtgtgagcatttacctttaagggaaggaactggatgagagccagtcggggtccgttggaggctgcccgggactctggacagcccctgagggtgtctgctctgggcactgtgctggtttcttcctgttttgtcttactggttttgtcttctgggtgctttcagcctctcccacacacatcatttgtcacctaggcggggtatgctccagaggaaagtaaaatacccacagcctttgtcccttcctcccatctggctgagggctcttcctagtgtggggtcagcggggcgtgccctctgcggcctttgccgggctgttgcctcactctgctctgccgcagcgggggctgtctttttcctcctcctctcttcctgcgctcggggctgtattgcatggtggtcagcgcctgatcccggattcagactgctggcacctagatcctccccactcactccctgtgtggcctcaccaaacctctgatgacagtagcgccccctcccaaggttgaggtgagggtttagtggggcgatcccatggagctcagggtaaattcttagtaaacattagctctgccatcattcgaggctctgcagctgctaggacaccagaacgaacctccagaaatgccctgcctttgttcccaggacaagacaagattc

SEQ ID NO: 8299 - DNA, 1046 bp, Homo sapiens
ttcgcatggctgggcgcagcgtttcattcacaacatgcatttttctcacaatgcttcctaattatttcctttggcaaggataggagcctctttctttaggatagcacctgagttcccagagccacagtttttccaaataaggaggcatgtggctggtgtccagcagatcccttaatggctctgaatgcccctcctccctgcgtcctcagcaacctggcagacttcagcccaggaagggtgctgattggagctgcctggtcggcttccagaaggttaccaggtgggaccgggctcctggggctttctagctgagtttctgcacagcactggtcagtataaagaagctggagaatccagctggcatcaaccctgaactgggcagcaggtgttccagacctggccacacatggactcccccatctgtccagcaccttggaggtcccaaagtgcgttcttgcatcctgttcatttcttcctcacaggatccctctgagataggctctgcgtgggccatgtggacaaggaaagcgaggctgagactgggagggtcctggccaaggttaccctgagaagatagtggttaagagagggctttgacccaagtctggctcatgagtctgaccccactgtgccagcgagacccagctgggcctctttgccctacagatgagtgccgtcagctgggccagtgtcctggcaggggcccgcagcccatcttgttcttgcaagacctcttgaaagtgtaacacggagagtgaggcctggccatccgggaccctggcagtgcctgggtattttcagctctgtgagatgcccctgttgagtccatcagggtccccacgccagagcccttctggcaagcccctgctttactccaaccctcctggcataaaggaagctggttgtcccagcctcaggcacagctcttctggaaatctggaggacattacctcctggctggccttgagcttggggctgcatctgagaaacatatccaagcctatgggcttctccccattcactgagcagggataaaaatcctatca

SEQ ID NO: 8300 - DNA, 1058 bp, Homo sapiens
gaagcccctcccagcccgaggttagcatggtgcctgcgggctgttgagagcccagtgagggccagagcaggaagcacaaataggtgcatcacggagatgggtgtgggatggagacggagctgtgcccagagcccagcacggctggtgcctgaccgggccttttcccgacaccatgcaggctgctgccctttgtgggtccatcagtgtgaagcctttactttagcccacttcgcctttggcagcatgagcctctgtcgccccaggcactgcatcagtagagaatttctcctgctgacaggagcccatttatgtaccatttttgtggtatcagccatccggaattaccactctttcttgcaacttcaagccacagtcaagaaatcagaaagcaaatgccacacgaagaacaaaccctttgctgcagtccccatgctggcgggaacttggtttgactagactcagagtgggtgttaattgcctatttatggccaaaagattaacaatgcctcctttgaaagttagacatagtagagctcttggataattcctttttgggagggggaggagtggcttaaaaaaaaaaactcttggaaaacaaaagcaacagttggttgcaaaatataatgcaaccaccagaggcttagtttgtgagcagtaacgcgagctcacatcagtaatgtgtcaccagaggtcatcaggcaccccaccctctccctgaagggccacagactgcatttactcctcatggagtagtggtggcggtatggaggcccccgctgtttccctgctggagctctgtgggtggagtgggtgaggcaggcctcctggatcagccagggcctgttggggacagaaaccagcccgttagatccaggtgaattcactgtgagcaatggttagctaggtttctgaaaatctgaaaagccaagaagagaaaacgaagtattaatatcatgcagaagcagctacaggaagctgctccccaccttgggctaggggaccccagggcagagactgcacttctgaaagcttggcagcgtggagtccattggccgcac

SEQ ID NO: 8301 - DNA, 1049 bp, Homo sapiens
acgaggagacagagggctggtgggagagcagggcctcagcctggagccctgcccatggagtgagccccatcctcatcctggacaactgatggaacctcttcatggttcattttccccatcctcgaggaagggtggcgacaccctctctcactgtgttaaatgtctcattaaatgaattcatttgtatgaagcgcttggagcttagttctgtgtgcccaggacacgtgctcagtaaaagttggctgccatattgggagtcacactttaggagtaaggggagaaatttggcaaaaggaggggcctgctgctcatccagtgtgaactgtcctcccctcaggaattctttgtctctgcagcgctgaggtgctctgccgcatccctgctccccagaagaaggcctcacctgagggcgcagctgagttgttgagcggtgctgctggggtatgagtcccgggctctgtaactctgagggcagggttttgccttattgccacgtggtagaggcctctcatatcctaagggaaagagaggtgcactgtcgttggaacacagctgctgttggagtcagaagagctgggtttgagaggcactctgccacctggctgtgtggtgactgtgagcccgttgccctgcttctctgagccttgggtttctgaccatgcatgcatctgcccaggtgtagccatgggcgtcaggttatctgggaagccaacacactgcaggttcctagacgttgtccaagagagtctgaattagcaggtctggggcagagccccagtacctcggggtcccagaagctccctaggtgagtctggggcttgtgggggcagcagagatgggcacattcctagcccagtgactccacagatgcccagggactagttttgtgtcatatggagatggcattgagagttcaggtccctcagtcaggaggtaccagctcagcctggattaggaagggcctgacctggaggagggatccaggtcctagggcgagtgcccactgagctgctgtacccagcagagcaatggtgtccccgcctgccaat

SEQ ID NO: 8302 - DNA, 1370 bp, Homo sapiens
aagaaagattatttccagttggtttttaaaaagcgtttatttctatttacaagcaaatattccctttcactgtgagctcagtgctaggggtacaagggcaggtggatggtgagaggcggggtgttggtgggcagactcactggaccaaacactggtaatcccctccggcccttcactggagccgtctctcccaggaagccacccctgcagctgctgcaagagatatacacacacactggggttcagtgtcccttggattatgctgatcctgagatcagggttgtgggtaatggtttccaagagctagcgattggggggacttattcctttgattatactgttgaaacatgaggccatcaggatgttgtgatcaatatcctctgagctgcctctgcaatcatccttgcccttcactgtagaagaagtatctggccacacgcccctgtcacttggactttatcctctttgtcttggagctctgccttgtgctaacactgatcttggatattgatttgaatgagatgaacttggagttaatactctgtcatcaggagcgtctctgagcccgagagttggctgcatctggttctggctggggatgaggaagtggtgctggcccttgtgacctctgactcaaggatgggcggatgtgatgggacacaacactgttggttctgtgttcatccaggaggccatcggttgcttaatgccacggtctgaccatcatcttttctggacttatttatataaacattggtctcgctgggtttcaaggggtaaagatcttcttgttgacgaagatggtttcagaggggttggttggaggggatggccttggtcactcagcattatggccagatccacggcaggcaggcttatcacgctcgctgcgtttcaggtgggcatagctgacttccttccaagcccagtgttgttctctcagttgggtcttctttccttttacaaagaacatgcagtttctcttcatggggttttgctcttctctcctttagttcctactcccaacatagaggtctacccagaaaagaagaggtgcaggtgtcttaagtctaaagcatacctggccccagagtccaaactttctggccacctttgttcaagagcctgggcactggctggggcattatgggagggcaagatggtggtatgcttgtgcctcccctgtgtcagtgggatccgcttgggggagagcctgaaggggtgtggggcagagctcttgcctcttctcagctagtttccatttcttccattgtggctctaggcgtgtgccaatctttttgctgtgtagtggaacgtttttgactttactagctggacagggattgaacacatttattggacaccaagag

SEQ ID NO: 8303 - DNA, 1036 bp, Homo sapiens
tctgaactgagtctccttctggtcatacaggcaaagagactctccagggagccagaggctctaaagtccatttaaaaacagatgagacgattgtgggggagctcatgtcattgccctgcttgtgtcccccccacccccatgttcttttcgtaagatcagtttagcaaaaccgccttcagaaagacacctcggctctcttgattttcccattgatgggttggtgagcttctccccaaaccaagcatagaatctttgtggccctgaggccaagttagcacaacccaacctacagggcaggggagagatactcattgtcagcacaagtagataggtgtgaaatgtaagaatgagtcagctggttgtgatctgacagcaggcttgctaatcggggcatttcgtatcttggtctgtacttgaggtgcttaaccttttctggaaaccacattctgtacttatgtgaccataaggcaccatcgaaaacatagcacagagctctctagggctataaagctcctctatcttttgaaaatatgaaggtttatagtcccccaagaatctggagccctgggaattttccttcaaatttaagggtaggaatggaaataagaacatttgaggtcaaatgccattcgtattcctctgagtgtttttcttgcttcaagctctaggatctgtgcacacagcagtcttctgcccttcttagtcaaacggtggcaggaccagagccttgtgagtgcgaatttgggaatttgagtccttgtctctgcatatgtaggcaactcattctcctgttctttgtggcatagtcaaaagtcagaaactgcaagctcagtcatcaaacctcagctttggaagagaccttgcttacctagtctgtccaagactgtgagagaactgggcccagggatgcttgtgtgttcaccctcccatctgcaggcaaaggctcttgtgtgtttacgctacacacaaatgcacacgctctcgtgtgtatcatttcagacttgtgaagataatgctcagtggggacgtggagaag

SEQ ID NO: 8304 - DNA, 1028 bp, Homo sapiens
gcccagcccgtggcaggtgctcagtggatgtttgtggatggatgagcttgcaggttcctgtcacctggcctcttctcattcaccattgtcttactctctctctggctgctgctccagttcacgactgagtgggtgcgactagagtagctctgaccaaaaagaagggacctcaagggtgaggagccatctggaggtcccgagggaggagccctacccgggtccagctgtgcagttggctgcagtggccgcctctgtgcttggtcccttctcagggtgggactgcctggtgttggcttcagagttggttccaggacatgtgggcccaaggtcagctgagctgctcttccaagaggtgtggcctgagcccctgccaggaggagcacggcctcccagccctggccagggaaggaaaactcatctcagaaagggaaagcagtcaggggagagcaggcggctttgctggaagggattctaccatgtgttctcttgtggccacacagattagaatctgtgctttcttcctgaactctccttgctttgttggaaagtatccttctttctgctgctttttgttactggcctgtccgggcccagaaccacccagtgtgcagtgctttgggtccatctgtggtcttcctcctcctcttctctccccttggctccagatgagaggtctgttgtggggagcagccctgttggagatgggctttctcattgctcagtttgcttatgcgcccagaacacattgactgggcgtcagtgcctggcccggcctggctcagcgctgcctgcgctatagcgtgggccagcaggaaggtgttggaggtgcagctacactgagggtcttgggaagtgtgttagttcatatcatgttgctatgaggaatacctgaggctgggtaatttataaagaaaagagatttacttggcttatggttctgcaggctgtataagaagtatggcaccggccaggcatggtggctcacgccggtaatcccagcactttgggaggctgaagagggcggatca

SEQ ID NO: 8305 - DNA, 1018 bp, Homo sapiens
cctcagacatgatttgtttgtctcatatgatgctttacaagtttttaaatttcttgggaacataaaaaggagattgtgcaaagaagtcctgactttcagtttctcttaacaagtcaggaggtaaattttaatagtagcctggatcttctttcccaaacagcccaccacagttagctgtagccagagccgtccacggtgggccaggcatgttctctgcacatcatctcggttcctatgcagcatgcttctctcatttgtgtttcctgcttggccctggaaggcatttgagtttgagatccctggagtggataagacattgggaaggcagattcagattttctggctctccaggttattggcacagggagaacgatggtgaatggcagtgactagtagaaatgcccaggatgtttgcagtgctcaaggtcattgccatcataatcctgctacctcgtgttccacctgctagtaaacttgcaaagataagccagtactccgggcactaataaaaactctgaaagtacaaatatgtcccttaaatcttggaagctagtctcaggccaggggcccttctaccctgtgaatggccctgtgatactgggtgacctggggattcattttgtacccccgcaccccccccccccccacaatcactcaggtgcttcacctagtgtaatcttcttatctacaagtgccttcctgaggctgaggcaggcagatcgcttgagcccaggagtttgagaccagcctagtcaacgtagagaaaacccatctctactaaaaatacaaaaattagccgggtgttatggcatgcacctgtggtcccagcaactgggaggctgagacgggaggatcgcttgagcctgggaggcggacgttgcagtgagccaagatcgtgccactgcactccagcctgggtgacagagtgagaccctgtctccaaatataaataagtaactaaataaataaaaagtgccttctggattttaatagatattgcaagggaatttttacaaat

SEQ ID NO: 8306 - DNA, 1071 bp, Homo sapiens
tggatcaaagagtaattttgtcctcagcaaccaaatacctctttaaaaaggtgtgtgtgtatatatatgtatcattcatgtatgtatgtatgtatgtatatacacacatgcatgattccagccagagctataattcatttcttattttcatcagtggataaaaagaacagacaggaaagaacagagggattaatgtgtcatgtgatccctacatgctaatgtaggtagggttactagttgtagctggacaaagatgtgggaaaatttacagaacttttttttctgagtaagacgtgaaaattgcccccatgataggttcagattttttatttccatctgtaaccagaaacttcttatattttccaaagaagtatattttgctaacatatttccagtcacctatctttttgaaaatacttaaggtggacttggtgatgtctgtcttctcataatttattataagcaattttaaaaaggttctgcttttaaaaagatcttttcaaatgtagaaagaacagtgtgaaatgtgaatgactggcttttaatacaagggttgtgacaaagaggcagtggcttttggaagccaaataaaggggtgaatacacgtgcatctgcatactgctgttggatccagtgtataacgtttggcgtttgtttagttcacttgttagtctaaaaaggatagtatgttattctctcaaaccagtttataattttttagtggtaagctctttttacaaccatacctacagatagatttgatgggaaaaactgaacatttgctggtacttgttcaagcctcaaagctcagctctttgtttgaacgtcacatttatctggttctaaaggcataaaaataaaacacccactaactacctaagacactccttagtgcatatcaaaacccaacctttaccctcgtctgcacaaatgtgcttaggtgaatacttttattagcttgttgatacaagttatagtaggttacacccttaataaaacacacccttattgtcatcctgttgcttaagagctttaaacttgtaataggggagctctctaatatagaatgat

SEQ ID NO: 8307 - DNA, 1045 bp, Homo sapiens
ggtcaagtgaagcagtgataatagagaaggaaggaataaatttgtaactggttttgatcgattagttgtaaacaccactgcactcagaccagccaaggcccaagaacttttgatctaccgtgtttattttaggttacacactaggaatataagttaaaaatcttattcccatagctgagtgctgtggccacatctacttaggaaggctgagatgggaggattgcttagctcaggttttcaagtctatcccgggcaacatagcaagactcctgtcttcaagaaatcttatttccagtgaacttagttccaaataaattgtcatttttaagaatatgtcaaattttctactttttgacagaaacaggtttttcataaactaggcttgtgagctccataatgtgctggtattattagggaatatggctagctttgatttgtttccaaatttgtagagatttggaatgttcaggaaataccagtctctcttattaatcttggctttaatgatcttggactgaagctcataaaagttagctataaagttgaaaatatgtttattatatgtaaaatgccattataattaatgggtccttttattaataaccttttacaggttgtcacttacattctgtaaggattttgttttaattgttctcacatagacattgacttttaatataggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggtaagtgactatatggtgtttaaatgtgtgcttacctcaggtttcatgtacttaaataggttttctccccgttttgtgttatagtgttttacttttctatttgtgggaattgcctgcttttttctctgttaattaccttgacaataa

SEQ ID NO: 8308 - DNA, 1047 bp, Homo sapiens
atcatcaatactcggtcacattggcttttcttctgttcctgaaacatgtcaagcttgttttgagtctgtatacttgctgccctctgcctagagtattcttgccccagatcttagcatgtttggttcattctcataattcagatctttgctcaaataacaccttagagaaaactttatttatttatttgtttttattttttgagatggagtttcactcttgttgcccaggctggagtgcaatggcgtgatctcggctcaccgcaacctccgtttcctgggttcaaacgattctcctgcctcagcctcccgattagctgggattactggcatgcgccaccacgcccagctaatttttgtatttttagtagaggcggggtttgtccatgttggtcaggctggtctcgaactcctgacctcaggtgatctacccgtctcggcctcccaaagtgttgggattataggtgtgagccactatgcctggccaagaaaagtttctactcttttccaaactgtttctcttccaagtcacttaatgtcttatttctctggctttattttcttcatggcactttatctgaagttacttatttagcttatttatcttttatctttctctttgtagaatataaggtatattttctttcttttcttttcttttcttttttttttttttttgaggcagtgtctcgccctgtcgcctagacagtagtgcagtggtgcgatctctgctcactgcaacctctgcttcccagttcaagcaattctcctgcctcagcctcccaagtagctgggactacaggcacatgccaccacgcccggctaattttttgtatttttagtagagacagggtttcaccgtgttagccaggatggtcttgatctcctgacctcatgatccgtctgccttggcctccctaagtgttgggattacaggcgtgagccactgcgcccggccaatataaggtatgttttcatacagggaccttttctattttgtttactgtttttttttttttttttttttttaagatggagtctagctttgtt

SEQ ID NO: 8309 - DNA, 1066 bp, Homo sapiens
ttttaatttcattgagttctgttctttttttttttcttcctgattttactttgttcctttttttactttcttaaggtggaagcttaggttattgatttgagacttttctaatgaaattatttaatgctatgaatgctatgaatttatcagtaagcactgctgcatcccacaaattttgatatgttatattttaaaaaattgttctacacctcacttgaatttttttttaaattgttgatttgttgtatttttattcagtccaaaatattttctaatttttctaattttttttaatccacgagttatttagaaatttgtttaatttccatgtttttgggatttttctgttatgtttctggtacagatttatagtctaattcagttatagtcagataacatgccttatatgatttgtatgatttcaatccttttaaatttgttaaggtttgttttaagacccaagatacagtgtgtcttggggaatttttcatgtgaacttgaaaaatgtatgtattgccaggtgtggtggcttacacctgtaatcccagcattttgggagactgaggtgggcagatcacctgaggtcaggagtttaagaccagcctgaccaacatggagaaaccttgtctctactaaaaatataaaattggttgggcgtggtggtgcatgcctgtaatcccagctactcgggaggctgaagcaggagaatcacctgaacctgggaggcggaggttgcggtgagccgagattgcaccgttgcactccagcctgggcaactagagtgaaactctgtctcaaaataaaataaaataaaataatttagccaggtttggttggtggcaagtgcacctgtagtcccagctacttgggaggctgaagtgggaggatcacctgagcctgaggaggtcgaggctgcagtgagccatgattatgccaccgcactccagcctgggtgacagagtgagaccttatctccaaaaacaaaggaaaattcatatgtaagtttttgtgtgtacatatgttttcacttctcttgggtatttacttaggagtgaaattgctgggt

SEQ ID NO: 8310 - DNA, 1543 bp, Homo sapiens
tgagacaccaacacatacaactgttaatgctgatatagagaaatgttagtaaataacatactgaccttgtctattctgttgtattcctggaggtggtttctcctaaattacagtagagacaaagctgaagcagtcacagatgttttcactttcaaataagagtttgagcatatggtataaatagcttaaatggaatatagtggtgacttttgctctgtatccctcagttatttgactgattctctctaacaggtttggagaagagagtatgaatcgactaataaggtggatgcagaaacacaagattccactggatgcttcagtgcttgatattggaactggaaatggtgttttcctggttgaacttgttggtacttttagtatttgtttgttaaagacaaattttaaaaggaaaatttttaaaggccctgcaattgaggatattaaccatctaaatataaaatagtaaagcagtcatacttggagaagtcagatagtacaaaagggaggctacatggattgtgagagaacctaggcaatctgagtcctagtcttgactcttttggctatagtcttaaccttgagtaagccacttaatttttctaggcttctgttctttcctaagggttgtgactaggtgattgctattggtttcttgtagctcaaaactctagaaatgcatatatatatatatatataaagatgaccttttgcaattccagtaggacatacgtatcttatcttataggtaagcatatggtttgaaaagtgcattttgtccatggaactgtgtttcggtaaacattccactgctagctaaaccatcactgttgtatgcctgcagtgtgctcttgctatgctgtgtgctgtggaggaattataagacttaggcttcatcctagataattttacagtcttaattagtacagaaataaacataagagtgaaatttgttaagtaaccaccacatgccaagcctcatgtttggcattggcaacaggaaaatttagactttgtgcttgaattgtttacattacaatagagtatggactgacatatggacagttgtgccatcacttgatgcatgcagtaatacactgaatatagaaaagagggtgattaattttggagtggaggggtagggaagcatcttggaggagtaaatatccaagttgggtggaaatttcagggacagtttggtgacctagtggcgtgtaaagagggagaagatttcaactaatggaaatattatctaaaggcctgaaggctgaagcagtattttatgttctgggcctgtaaataatttgataaattgaaatacaaagtatacgtggggatggacagacatgaggattaagttaaagataggaaccatattatgctttgccatgcttaagaccttcgattttgcatttaggctatggggaattgttaaaatgtttttagtagtggaatatgattagaagaacttgaaataacccttcttgaaacattgagatatagtgtgtgtacattaaagtgcacaaatcagaagtatacagct

SEQ ID NO: 8311 - DNA, 1048 bp, Homo sapiens
cctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagc

SEQ ID NO: 8312 - DNA, 1087 bp, Homo sapiens
gtttttggtgatgtcccttcacggatctttcaggcccagtgagtcagcagtgtctgcattcacacaggctgggtggggttgttggatctgccccgggtggatggcacctgctccctcagggcaaaaattcaccccagaacatgagctgcacccggggttaggtgaaggtgacggagcctgaacactcaacaccagaggcagccaacaggacggtgtctgggcttccaaaaagccaccagtgcctaaaaacactttcaagcacctaacatcactcttggttttgtttttattttaaactccattacaaaccgggaaatagctgtcactttcctgtgttctgggcccgctgtgctcctccgttccgcatagcgcggacactgcagggtgcgggctgcagcttccccaggggctctgaggaacccgttgaagtgactgcacgtgcttgtctttctagggttgcagatgagcttcgttttcaggggggtttgtattttgtgttttttctgaacttgatggtgtgggtctggacatctctttccaaccctggaagataccacacatgctcttcgttattaacatgatcacccagaaagcttttgggggcctgagaacatggcccaggctctggggagcatcagactgcacctgactggctggataaagacaggggtacctggagcctcctgcctcgccagctctgtgtccagctgtcacctgagctacaagggagattacctgggagcctctcatgtgtcacatcgtgactcattcagatacatgttttatttaagaagcaaatctatttatcagggtgttcctgtggccatttcttcaccaaacctccagctgactttgcagagaatgccaaactcagaagccgaggagtagcttaaaactaggttccccatggggcacatccagccttctggggagcccacttggtgtggggcaccccaaacagcacagcccctgggtgctcagaggccttggtgaagctagatttcccaacactcgattttttccctccttacagaaaagcagggggaacttgagggataattcacatgaaacctttgccataaaccct

SEQ ID NO: 8313 - DNA, 1047 bp, Homo sapiens
cctccagtgggagggaggaactgctgaaggaacaggaaggtacactgtagttaaatttagcccaacagcagctttcagcatgtgaataaaacaacttttgccaaattgttaggagagcaaaaaatccaacctagaaacacccgtccccactgacagagtgggcggccccctgggacatgttctcctgagagccatggagaaattcatcccaggagggtttgcaaatgtcaatgggacatggggcagcctgtggctgagttagcaccctgggtgtgcttcaccagaaggggcaagagtaggaaccctgattcctggtcccccaatgcagttgtgtgggatgccagtggcgttggcggggagcgcgtcctgcaataccagctagatatgaacacggtgcctccgcagggctggtggggtgcacctaccccaggtggcccatggaatgtgcctcttgcccctttgccagggccgaggtaggggaaaccagccttgagagaatctagggccctgactgagttcagtaaatattagtaattgtcactattgtggagtttgtttgtttgtttgtttgtttgtttgtttgttggttggtttggtttggtctggtgctttttttggtttttggtttttggtttgtttttgtttttttgagacagagtcttgctctgtcacccaggctggagtgcagtggaacaatctcggctcactgcaacctctgcttcccaagaagctgagaccacaggtgcccactaccatacctggttaatttttgtattagtagagatgggatttctccatgttggccaggctggtctcaaactcctgacctcaggtgatccccccgcctcagcctcccaaagtgttgggattacaggcgtgagccactgcacctggcctattgtggagcatttgacaaggatgatcccccatctgaaatcccaggaagactctggacatttttcctctgacagactcagagaggttcaccccctaccctgagtcccacagcagggggtggcccatgccatgatgatcctcaggcacggt

SEQ ID NO: 8314 - DNA, 1032 bp, Homo sapiens
tgaaatctttaaaagctgttgatcttggccaaggtatggttcctattttcctggaaggtttgcggagccaagggcataagtacctgagcagattccacagaccaggtgagtggccccatgttcacctggccataaaaacaaccaatgggcccctacgctattttgctttaactctactttcaaatgtggcctttgctcttgagtgtccagtgtccatcctggggctccacaagtcacatttcagctctgtcaacctcagtgcttgagttgagggtcttcctgggtcatggggcccaggctttttggtgtcaggcacacagtttggaaatagttctcccccattctgtggttgttttttcaatttcttgatagtgtccttgaagcatgaaagttttaatttggagtcttacgtatttgcttatgccgttggtgtgacatctaagaaaccattgcttaatcgagggtcatgaagatatattcttatgttgtcctccaggaatgttagttttagctctgacattgaggtcttgatctgctttgagtaaagttctgcatatggtgtgaggtaggggtcccattcagccagttgtcccagtgtttgctttgtgctttgcagaagctgagctgtggagagctgggctgggtagagcaaaattagagcttcacgccagacttcttgcatttggaaactaacattctaaggaagaaagacgtggtttttttttttaagtgagaaagccaacatatattaacaggaaagcttttcaggtgtttggcacaaatttatttacccccaagaacatacgaagccagaattctaaagctttttcacagattccttgctcatacgtgggagaggtttttttggtaagtttatgaaagagaaatagtacttgtaatccataactaattagcccacgttagcgatgtagaaacgagtgtgattaaacgtgcagttgtcaggtgtgtgtttcccactctgaggctggcttcaacaaagggctttctagttgttttttacataaaggataa

SEQ ID NO: 8315 - DNA, 1040 bp, Homo sapiens
gcgcagtggctcatgcctgtaatcccagcaccttgggaggctgaggtgggtggatcacctgaggtcaggagtttgagaccagtctggccaacatggtgaagtagatagagtagagacatggtaggctctactaaaaatataaaaattagctgggtgtggtggtgcacacctgtaatcccagctacttgtgaggctgaggcaggagaattgcttgaacccaggaggcggagactgcagtgagccgagatcgcgccattgcactccagcctgagaaacgagcaaaactcggtctcaaaaaaaaaaaaaaactgtgtctcaaaaaaaaaaaatttaaagactggtatttctctttagaagattctagtagagtgctagattgagagagatgtgagtgaggaacagcactcgggtttaatgcttgcaggtatgcatgttgtctcattttaaagtgctttcaatgtatacagcctttgtagcttcctaatcaccggcttttatttttgctatgaattctttgtcatgggaatcctgcagttgcagggcaggaacctaccgtgttagtctgggatgttgcttctctggtactgttccatatgtttaaggaaatgtcttaatacttcggggcactcctttatctaaataactgctgttctttgcattattgcgcctgaagtcctttgtggactctgaaagcttaatccatgtgaatatggaaaagcatctgcaggatctaagcctgctggaattaggcttttcatcctgacatacctaaaggaagatgagatattcagatgcagccgcttcccagttctgctttgcagtgtaaggtttagtcacccatcctcctgttcctgtgacctctgttgcagtcactttaaatcccagattacacacgcccttccctggcactccccggccccccggcagcatgagcccatctgtgtttcacagtaataaggtaaagaatgcatttgggcttgagctcggaaacctgtttgattcacaaccaaagagtcgtctcaaagccagatctcagtatt

SEQ ID NO: 8316 - DNA, 1032 bp, Homo sapiens
atcaccttcagagctgccctggccctttgtgttggtggaggcaggatcagggaatggaagcccaggcaggtgcaggacccccctggggaagctgttccttaagttccttcagttgggaacttaagttgcctcctgagaatgagctattccctgagaaggccttgagacaaacctggcagcccaccaagtgggcgggtgacaacacagttaagagggacacaccattgagccaaatggccctcatgttactgcaaccttcagactcactgatcccacctgttcttctttttctataaaagtgagaattagaccccagagtcatgttttctctctcatttcaagcagtttcctgcatgattattccaatgggaacatgaaatgcttgttggcagtttgtccaaagactgctccgtcggagggtacccactgatcatccccatcctggcctctcttcccagctcttctggaactgtctggatccatctctggaattgtctggatctctgtaggtctctgttgttaattgacaccttgtgtcgcacagggacttcagaattggctttgggtggacatcgcctctctccccgacacagctatgttacacaatcatcttatttttacttgacataatttctatagtgagggttttggcagaattaaaaaattaagcccgtgagatgtattactctaatgggtcccatctcacttttagtcaacatgagaatttttaagaaaagcagtcctttctaaaagactggagtgtggtgtgtgtgtgtgtgtgtgtgtggtgtttgtgtaaccagagtgtttggaaaagtgagtccagttacaggtgtttttacctagcgcaggaaaacatctgtcataatatttgtcaaatctcagagccaaggctgtgcgagtttgggtggtttccaagcagaacaggttgaaagttgatagaaatggaagctgggcctcctggttcaatgggaggctgatgctgccccaaagcgcatctgcccacatctgccctgctcctgcgatcacccc

SEQ ID NO: 8317 - DNA, 1057 bp, Homo sapiens
gttcatcaccgtcttctagtttggttctgcagctgcggttttcagctcctgcccctaccacagtgaatcgcgctgtttcccaccgcctggttggtggtgccctgtctccatcgatgattgagttgaaacctcccacagtgtggcccggagcccctgggcccagctgcccagggctttactctcagtgcctgtcctcttggtcccggcacctttgggaaaagagcatctctagtttcaggccaagtcagtgccttgaggggagcagtgcttggggtgggcagggggaaggagtgccgcggggggaacagtgcatccgtagtctccgtgtttggaggaggccccagggtagccagacagcagcagacagcagcccgcacgaatgcggagaaccttctgcgcgcttcacacagctcaacctaattgacaggtatttggggtgactgtgaaccagaaccccaagatacattttgctgccggcttcttgccctctctccttttccagaacgtacagtgttaaagctgtgaaatgagactcctctctgattggtttctaccacttggctcgcttgctactaaagctcaggcaccttggcgtgcgcgctcgagggcgttcctctgtctctgtctcatctccatctacagagtgacctcacgtgcctttctcagcccttccacatccagcaggagcctggctgagcaccccagctgggctgtgaagatgccgagaggggagagcattctgggtgtccagcgctggggcacagtgggatcccacactccctgtccctccagcctgtttctcatcacctgagggttttgttttccgtgttccggttgaagagatgtctgtgccaggagggttcctcccttcccatttgcaacctgggatgggtgacgcagatttatccgagacttgggagtgaggctgagagtcagttctttcgtatcctaagaaaggctgaccgtcccatcaaggcccgtgtgctgaaactgtccgtgtgcaggctcaggtggagcaggtctctgtcaggcagccatttgtatttgggcggtgggt

SEQ ID NO: 8318 - DNA, 2150 bp, Homo sapiens
ataggaaattttcagccaattttttataacagaagtttgcattaccttgtctatgcatggtgttccagatacatttgcagttatatattttaaatttctcaataactatcaacgcagacaggccaaaatgcagttactccagtgtgggtcaccatctatatgtcagctccctaggcatctcattaagtactcacagttggtcccaagtgctttgttggtgctcctcctatgtataagctgacttagtccttgtggcacctgttatgggtcaggacaggtggcacccatctcacaggtgctgccagagaggcgttgagcagtaggcagtttgcacccaggaacccgggcagtctgtttttttctgtttggccttctctcataccagcttgttggattcagctctttcttccacctgaaggccttgaacatctaacacacacaaacacacacacacacacacacacacacacacacacacacacacacacaccccctctagctttgaattctcaccatgtttctattctatcaactacttgtagaatgttctgtattgatatgcagagagcctgtcaaactgtttttttctccctccccactgcctacacctgacacagggacttctgcgtcccttaggtttgttttttttttctttctaaatgattaaaagcatgaagctgccatgttctgctgtgcttacccggtctgctcccaggcttgtaggaactttgtcttcctgctcttggtgtctggatacaccagctccttaaaattcgtcccctcccgcctgctacacaatgccaacatcaagccctggtcgtgggtccctaggctggaatcaggcaggcctctccagggtcccactccaggtactccgctggaatctgagcatcacccctgcacagatacttgtacaacctttccctgttttctaaggcctgtccagccccttcctctttgaaacttttcaaagcaagaaaaagtggcatggagcttgatccttctgtgtgcccagaatctgccgtggggattcactccgccaggctgtgtctctactcggagagcaggacacagacagtctttgggactccagccaaatgagctggaataatggtctttctagccaatgtaaaagccacattttaatttttttaatgtaactctttgagtttgctatttataattgttccttttttttctgatgcctgctatcaagcaatcctataataccatgtaagaattattacgaaggagccctctcgtaacacaggctgatcagaacaagattgtggtctcctcattctcaagtataatggagatcttcctatctgtttagtctgctgacataattgacattgtgaactgcaccagctggagggttttagtacctactttatcgcattatgccagagctcctttggtttgccccaaacatctattggttggaaatgagggctagctaacaatcactcagcattgcaaagggaacccagaagagcatcttgcagagccctgggtttgtagaacttaataaaccacaatggctgttgttggtggtaactttttgttagagctgcttcttgtggattatgatagaatcagtctgtaaacactgctcccctttcctgcggctgttgcgattgcaacttgaaaaaagtatgtgtttcgttttactgcgttttgttcgaatgtgttagagacgtggaaaatggtcccccgaggatggtatcagctgagttgtgagtagtccccttgtaacatgactcagggagggtgcttctccatttcctctgcaaaaataaaagggacctcctcttaaataaacaagctcatgaaacattccgcacctctggaatgttctcacgaccacagaggataaaaggaatgagaacgttgagctggttgggtggatatgaggaaaaaggagacaagctggtttctgtgaaacacatagatagttagaaagtctgggaatctcattctgcatcacctttgtcgcaggaggatgagaagtctgagaagatgctgccggggatgaggtggaagggagtttccccagtgggtctcttctgtgtcgcgggctcttctgctcttctcagtgggttgaacttgccatggtggaagcacatgtcagtgggatgtacccccaa

SEQ ID NO: 8319 - DNA, 1046 bp, Homo sapiens
gcacactgtatgtaacaaaagatgagttttctggtggaaccacttctgtctgcctaaaatttgagatcactaattttttttatctgttcaaccagtcttctcggctacagatcaaaattttcatgccagagtaggaaagagaaaactagaaaaggaaaaattgatctgcattcctgattcctcaagtctaaacagacaggaataagaggtgtcatttagtttgtttgcttatttgcttttatccctttttttttgcttaacctttattattaaataacactattaaaactaatatacagtttatttttaaggcatatttggaagacaagttcttttaaactgtgtgaaaatcctaaacacaagaatggctcattttctttagcaacaaagaccaacacttaatttccattatgacacaaatcaaacaaccaattaggaaaatcacaaattctttctgctcaagtcttctgttcttgattatagcttttagcaagtgaaaatatttagaattttggagtcttgcatttaacacgaggaaatgtattttcgtgtgctaacaacccttaaccaaaacgggaggatttactcagctttgttggccaagggaaagcctggtttttagatttgctcacctccttctgtgtggcagcccagagcctcatagtgtgccctctcctagcactgactccatgtgctcagagacttgctgtgtacatttctttgatgtttcttactctgtgtaacttacaggggcttcacttttaattttttggtcatttcaaagcccctaagaatgttttggtgggagttagatggacagaacagaatcacagatccacattccttagcctcatatccaaattcttttttttttttttttttgagatagagtctcactctgtcactcaggctggagtgcagtggcgggatctcagctgactacaacctacacttcctgggttcaagcgattctcatgcctcagcctccccagtagctgggattacaggcgtgcaccaccatgcctggctaattttttgtattttta

SEQ ID NO: 8320 - DNA, 1333 bp, Homo sapiens
tgtctggggtggggacataaacttgggatccaggtatcctgagtcctcggaccttttttcccatttatttgtctggcttgggctctaacatgcacaatatccccataaaatgtctcagagcagatttttaaatggccattaccttgtcaagaattctccagtgggatttcatgtaaaattaggatccctgatggtagctcacgatgagctgtaattctccacataggtgactgtattcatgggcaccatccaccctcctcatccagatgtctccctctccagaggactttggtgcaggaggcctgtgaggaccccagttcattatgacaaggttgcagttctctagaagattctcatcaggagccttgtctactcctccccagcaacctctttccactaacttatattttagctatagcctggaacattctgagctatgatgagtgttaaaatggggtggtgtactcgtcagagacctggagaccgggactggaagccactgtgaaacaggtgaaatgattcaagaagacagctgaaccccagcgacaccccataacagaaacaaaagaactcttgtgagccgcacccccacccttccttttcccggcatttgataggcaaagatgaatttgtgtgacacgggagtgtcccaccctcctcctccccatcagactctgcgagacgcccgctctccctttgggtgcagtcatggataccaaacaaagccttcatccctctgggtttccgttacgtagccgtcttccacgtgaaaaccgtgttaagcaaaatgaatagctgcaagctattttatttcatgttaaataactgtggataagactaagatttttctctttatgactcaggttgaaaagataaggtctgggaagcggtgtctttgaatctagagattttctggagttagggatgtctgatttctacatatcatttccacgacctgtcgcaggagacagggtaccggtgccccatgatgctgcagagcggcttttggtgatagagacgcattatggaatgtgtatacttgtaaggacccaggcatagagtatctgccctcataaagcaaacataatcctccactcctgaggtctgagttggctctcctggatgccagcctttgcatgatgagtgatgccttagttgaaatgaaggatgggccaccccaggtgcctggagcacttttatcccagtgcatgcccaaactactggtgtcctaaacagttggccccacagacgtggggtttggggagctgagctgtgcactggggcggtggctacactggcctggtcacgtcaggctgggcagaagagttggagc

SEQ ID NO: 8321 - DNA, 1045 bp, Homo sapiens
tcccgccacccagctcgttgatggcatgaaagcaccaggcctcattcctgccacggccctgagcctggcttcccgtgagaccctcttgggggcctgtggacaggaagtgggacggccaggacccagacctgtgacctgcgtcagagtgtaacgaagtccaggccagtctgttgcccgaagcactgggatgctttttactgaaggagtgtttaaaaggtaagctggatctcagacaaagctcctccaagaggcttccagaggctggagttttgtcaacaaatgaaacaggccctattttaagccacgctgtgtaccaggacttcctgtttttccagagaaacttcttgttttggtttttgtgatgatggatttattgaaacatttgctattcaagtgaccctctttgtgttccaaggaaaaagtcaagctggagattctgtggcctggaaaagggatacgcactcacagcaaaaacgtcatccccaaaagactcagtcggggggagtctgggcctcagtggccgatcagtgaatggacaaagagctaattgccagtcaggggcccagacggatttcatagctcggggtttggcctgttgtttagagggaggcgggggctggtcacaggacaattgaaaggggtttttgttgttcctctcaggctaagttaagccatgtgtgtgtctctctttcgaggagtgctggtctggccaatcccagccacgtaaatcccactcacttcctgctgaccttttgacaccaacagatgttttttcttacaagtgtcattagggcctctctactcgctgacctcatcagattgtgttgaagtcgttttcatcggttttgtctctaacaatccgtttaacccttcctgggtgcctctctgggaataagattgcactgccttctggccttgctgtctccctcctgcccccaggacctggcatggggaacggagcccaacccagagggcagagaggcatgcttccccggctgggggctgccctgtgtaccccggggacagagggacccttgtgtcttcc

SEQ ID NO: 8322 - DNA, 1056 bp, Homo sapiens
attcctcgactgtgagaaacttctttatccatctgcaatctctcctcttggcttcccctctctcctggtcatggttctgcccacgcagaatacacccaatccctcttccgcatgactgccctgcacataatcacaggcagagatggaaactcgggaacgttccctgctggggatgagcattgccattctcttccacaacacatttgcaagtttttcacttgctcagaaccagtgttgcaggtaagccgcaacagacacacacatgtacacacacacacacacacacacacacacacacacacacgtggggggaatggaatatcatgaccagtagttaaggaaaaatgcatttctgtttaaaagccatgttttaagaaaaagtacttgaactcaaataatgacgagtgacttatttcatgacatttgtctctgagacaaggtggcaaatagtatgctatgatcatttgtcgtgtgaagagtgaagtcagagtaacccgctcagctccagagctttgttttcctctgcggattcccttggcagcatttctgtggaggataaaaatagcacacggtgccttaaaataaatggctgtggggaatgcttgtgtacatcagctgcgtggccacatatgttcacattctccatattgttcactcttcaaaagagtgactgggatagacggttcgaatctgcccgccatatgataactaaagtgacatggaagagcctttggcccccgggaaggatgactccagggatgggcagtggggcaggctcaggtgtgtcagactcgtggctaacccgcgaggtcctgcaggtgagccttttctgtcctttaccccatttcatcctaagtgtctccccacaaaagatcagcaaagccagacccaacacaagctcccaaacaggccccttcctgactcccagtgaatccagacaaacgctgacaagctgacagattccgcctcctggagctggtgggggtgggcgggcaggaaattggcggggcgagaggggcagcacactgagctgcccactgatgcagtgtcagtggc

SEQ ID NO: 8323 - DNA, 1008 bp, Homo sapiens
gacaggggacaaatgatgaagaaaacagaaatagcccataaaatgatagggatgtcccggctcccaggcaaactctggtgaaaaccgaggagactatggtgttccctgaggtattcaccatctaactgtcttccacaccatatatataagctgtttataaattctttgtcctggccaaaaatacaaaacctactggcagtgatttatttttttaatgcattttaaataactggattcctatgtggaattggagttggataattaaattacgatggcctctaaagttggggtgcggggggttgagggcttcagcagagagcacccctggaaggtggcactgcagcctgggggtgggggaaaaccgtgcctgatggagttgctgcaggggtccctacacggggtgtccacccttcttgcccagacaccctgtggctttgagaatcgctgtgacatagccacgggagagctgtgtctgcttaatgcttttgtttactttggaagtttgtcctacatgaatgaattcgcaaaacttacattccccgtaaagctgtcactgagagaaaacacagcaataactcaggtgatgtagttaaaccaccattgagtttgcgccatccatgagctgataaatcgtacagcttcatttggtaggaatcagcaattttatgtggcaattaatttttactactgtaggggagccagaggatgagcattttacttcggttttgtgtgtgttgagagaaacttaacggttttgccacagcaagaaaggatcgtgcatgaggcctttcgcacgagtcgacgtgtttgggtgttatcctggggtgtccttgccagcttttgttggttcctcacgtgggcagaagagtgaatgctcagtccccatcggggtgccacaggcctcatgacgtgtggggtaaaacacgtatgtggcttgcggagaaataaattctccgtatttcttaagtatgatgtttttccccaccagaccgattcgcccatgctgtt

SEQ ID NO: 8324 - DNA, 1032 bp, Homo sapiens
aattaatgaaccaattatcaatacattaatattaactgaagtctacattgtattctgatgatctgatatcctttttccatcccagaatcctgtccagtttttcaccttgtatgtcactgtctttctccttaggccccacatggcggtggcagtttcacagtctttccttatttttgatgaccttgacagttttgattatgatagtatattttgtggattgtccctctactgcagtttgtgtgatgtttttctcattcctgggctgggttatgggtttcacagaagactttttttgtgtaatctctaaataaaaaaattcttgaaagaaaaaagtgtaagcctttgccggccaataatgaatcgccccacatagcaggtggacgtggggggtgtctggttgtccatcagtaggagtcgcccttcccttatacctgggcctggtggtcaggcggggacttcaggaattcagcagccttgcctgcgttcagctgaccaaagacttttccatggagctgggaagactgcccaggggagataggaagaggcacgtcgcacacactgggcttccctggagacttctggattctcgagttcaccctgaggcatttactgatcgacacatgggctagttccttttttgttacattttaaaattctggtgaggtcgttccatttatggataagaaacccccaggtgtgaagggctcaggtgatgtacccagagtcacacagctcacgagtcagtggcaggactggagattacactgaaggttggtgcactgtgctccctggcttctgtgcaggtgtcaccctcctccaccaggcagactttgagtcgtgcaaacagaaaagatgctgcccacacttcagggccatgcttccagtccccgtgagctacccccagcaggctcctgtacgaaacatgacagcactttctagggtgcttggccgtgcctgcttcccccgttacatctgcgcaccctgcttgccttccgttcctgccctgcactcacctagcatggtgcatgcacc

SEQ ID NO: 8325 - DNA, 1050 bp, Homo sapiens
gcagttctcctgcctcagcctcctgagtagctgggattacaggtgtgcaccacaacgcccagctaatttttgtattttcagtagagatggggtttcaccatgttggccaggctggtcttgaactcccaacctcagttgatccacgcacctcggcctcccaaagtgctgggataacgggtgtgagccaccgcacttggccataggcagtatttttgtgtgtttgaaactcatcattgtgggcgtttacaagttggactaattccaatactgattttggaatttaaagctttataaaatcataacgcaatttgtagtgttgtcaatagaaggtcctgatttgtaggagctggctggcaggcagctattaggggaggtggtcactcagccaagacaggcagggaacaggaaacccttggtcctgagaaaggcccctggaagaggccagccccgagactgtttggctagtggtgggggtgggcaccagctctaccccagccctgtgagtgcatcgttcccttctgttcctgtagctgatctccctgccccagcctgcgatgggaggatcagcagtaaaataagttgtctaaggtcgcgtgtcaggatccaaaggagaacccggtgctccagctggctgaggggagagtggggcctcggagacagcaggggcagattcccccagcagggcaaagcaaccctgacctccaagttgcaagggaataggtgactcagggagtacctcctgcagccctgctggtctcaagactcccaccttccagggcctggtcctgtgctcagaaacccctctgcatagggtgctgatgagtcctctgcagctccctcacccaagggaccacactgggaaacccagtagttgtctcggccatggcactaagacctttgcaccctggccatcttgttccgggacagccagcatctgtggtgtggtatagagacaaagctgccacctccaggacacttgctccttcctggccttcctgctgccctgaaacctgtggcctgtgtgttagtggaaacattctcagtttcatt

SEQ ID NO: 8326 - DNA, 1030 bp, Homo sapiens
agagcagggagcctgcccctcgctgcctctgtttcccctctcagcaggcggtggttgcatgggtgagtggggcacagatacgaggtcgtggcagccctggcacacggctcgggagcatctggatgtgcctggaatatgcttccatgcaacagagagcagcatctgctcagaattggggagggaagcaatcaccgcatacggggcattttgtctttgcaggaatgcagtgtgagggaagtgggtgattttctttttttctttggttaaaaagtttttattttagaaaaattttaggccaagcatggtggctcgcacccgtaatcctggcactttgggagactgagagcagcctggccaacgtgaaatcctgcctctactaaaaatacaaaattagccgggcgtggcggcagatgcctgtaatcccagcaacttgggaggctgaggcaggagaatcacttgaactccagaagcggaggctgcagtgagctgagatcacaccactgcactccagcctgggcaacagaacgagactccctctcaaaaaatagaaaaaattttagatttacataaaaattgtgatgataatacagatttcatatacctcacacccagttttccgtattaaaattggtaatcattattattattattatcattatcattttttagaaattgagtctcactgtcacccaggctggaatgtagtggccccatcatagctcgctgaagtctgtagtttctggactcaagctatcctgccggctcagcctcccaaagctctgggattacaggcatgagccaccccacctggcctttccctataattaacatcttacattagtacgatacatttgttttttgtttgtttgtttgagacagagtctctctctgtcactcaggctggagtgcagtggcacgatctcggctcactgcaacatctgcctccccagttcaagggattctcctgcctcagcctcccaagtatctgggcctgcaggcacgtgccaccacacctggctaattttttgta

SEQ ID NO: 8327 - DNA, 1026 bp, Homo sapiens
attgggaggagttttccctctcatatgtcgccatgtccggaccctttccggggggcagcacgcagagatgctggccattttatgtgtccagtcctggtgaacttcactatgttctaagagaaatttacttgtatctttctttttggtgaaacttagctgctatagccataacaatttgtataaatgcctatatgaatcaaggcagttgactttccacctaaaaattgtttgccacgtacaaatcggtttccaattttattaacatgtttatcttactttaaaaaataaatcccatttgaaagaggtgcagaaaccagccatgcatgatggctcacgcctgtaatcccagcactttggggggccaaggcgggcggatcacttgaggtcaagagttgaccagcctggccaacatggtgaagccctgtctctactaaaaatacaaaatatagctgggtgtggtggtgcacgcttgtaattccagttactcaggagcctgaggcaggagaatcgcttgaacctggtcaattgaactcgggaggctgcggtgagccaagatggcgtcactgcactccagcctggcgacagagggagactccatctcaaaaaaaagagagatgcagaagccattgaagaaatctcatcgtgtttttgagcttctaagtggacatcatcaacattgagattaagaaagaaagatgatgtaaaatgtaagagagtggcccttgccattgcagacactgatttattgggcagggccacatctgaagacttgggcgagccggcgtggaactgctgtggctgttagctttctctgacactgtgttcttgggctctggaggtgggatctcagctgtttgccattctgtcatctctatttattgcatccaaccgttagtaatgacttaaatgatgattgccaaaactgtagtcaacagttttgttagtgatttggggccttgtaaaataattagtcctgagacatgtatcaaggggaacatactgaatatctgagactagcttttactt

SEQ ID NO: 8328 - DNA, 1044 bp, Homo sapiens
aggcaggagtgcagtggcatgatcttgactcactgcaacctttgcctcctgggttcaagcaattctcgttccttagcctcccgagtagctggcattacaggcactcgtcaccatgcccggctcgtttttttttttttgtatttttagtagagacagggtttcaccatgttggccaggctggtcttgaactcctgaccccaaaatgatctgcccgcctcagcctcccagaatgctgggattacaagcacgagccaccgtgccaggcctggttattccaaattttttgattggtctaaaatttgtaatgaatggtaggaaaacacagcaggaaaaagaaagaacattattattggtaagggtcagattaagccctgggtgagagtcatgagtccctagaggtatctgaagaagtcctcctggctttggccatctctacaggatccggtgattgctccgcctccagagctgtccccaaccatcgcagcttggcttgtctgtgacctcgtgtcaactcaaaacagcactttccccccgacactttgaagtcaaccctggtagaatttgtgaggaaatggccagtgtgtgttgggtttaaaaaaaaaaaaaggctgtggaagtagaacaatcttggggttgccacagaacaggcagtttgaggtgacgaagtggctttgtaatcaataataattgataagaccttgtttctagcaggctgtagacaaaaataatcttcttggacctatcttcgcctaggaaatatgtcctagaacctccctcctctgttgatctcaacgcccaagcccatcctcccatgagaaaggtttttttttttttttttttttgagacggagtctcgctctgtcgcccaggctggagtgcagaggcgcgatctcggctcactacaagctccgcctgccaggttcatgccattctcctgcctcagcctccagagtaactgggactacaggcgcctgccaccatgcctggctaattttttgtatttttagtagagacggggtttcaccgtgttagccaggatggtgt

SEQ ID NO: 8329 - DNA, 1022 bp, Homo sapiens
gccatcagggagggcacgccaagctttgtgactttcaggtctgttcccttgcccacgggctggttctggctggtttctggactgtactgtggccgtgtggaattctctggcacacagcagcaggtacagagcctgcccctgggcagcgctgaccatgctggcctggggtttggatacttgagcctgggtagagacagggtgggttctcggtggccacttcctctgcagcagccaacagcagagacagaaggaggcctgggaccttgccctgcctgacccgcctgtctttccatctgaagcgcccctgacatgctgtgactcttactttatttttggtagtttaccttaaagagtaatgaaatcacattgcaaaaatttgggttctctgggaaaatatcagtcaatcttgattctaaaacttgaacacaatcactgtggccattcatgtctattttttttttccctttaactttttcttttgacataattacagacttacagaagagttgtaagaatggaacaaagaatttctaattaccctttacctagcctctccaaatgacattttaccacatttgcttgtgtttctctcatatacagaaacacacgcacagagtatataatcttcagatccctctgagatatttgcaaatatataaggctaaagtatttagggatggaggagttaatttttcctaaacacagtgcccattctttcacataagacaagtatcaaggtcaggaaattaacattgataatcatatctaatattcagatcttactgattttgccagtagtcccaataagatcctttatagcaaaagaaacttcggattctgcgttgcctctggtttccttgtctctttagtcatctttaatctggaaccgtttcttgtcctcctttgtaccatgacattgatgtttttgaagagagcagatgagtcattttgtagaatggccctcagttcagtttgtcctgtgttttttcctgattggagttgggcactttgggcgggaatgc

SEQ ID NO: 8330 - DNA, 1412 bp, Homo sapiens
gcattagccaccgagccttggccaaaagagctctttcatcaggcactaatcccgttcatgagtgctccaccctcatcatctaattaccactcaaaggcctcaccctctaataccaccaccttggggatgaggctttcagcataggaatttgcagggggacacaaacattaagaccagagagatactttggactgaggggaccctttggtgagaacacagggagtggttctctgtggggaggctgagattggcgtggcaggaggaggccagccatggggcatctggggaaaggtctggaggccgaggggctgtacccagggcaggagccagtgcggttgtggccctgtgagggcagacccggatcttgaccacgaaggcactgggcgttgctggagagcttccagacactgggctaggatcacatttcagtttccagtgagaatcctcctgggtgtctctggaaaatggcttggaaggcataagagcagaaacaaggggatcatttgagtgaactcatatagtagcagagctgtgcattgagattacccacaccccagctgcgagagtccctgttaatgcaaggtggccagtttaaagctgacaggactagatttccccatggagtgatttgctgaaggctttgggctggaagttccagcgcccgcagaaaacttactgttggaggttcttcgccctcgtttctgaaggaaagctcccagctctgcctggagcctgggatggaaattgtctctggttaataggatctttaagacagctaaatcctgcactaaagacttgatgcaactgctgttgcacacggaggtggctcccctgccatatgcccgcagagctttctttcattgtcattacagagagtcaggcgtgtgtacaggaaggagacgggatcctgccgtaatgactttgtcttcaccatcttttctcagctgcttaaattgctgtcagggcagcgtaggaatcttaaaggagggagttttctctcatataattatgctgttggtaaaaatgttggcggcttttctctacttttccccttagccaccaaaataaaactctttatcttggaactcggcagctgtttgcaatccgcctcatttctcctgctgatgtattggtgtcgcagcttgggtgatgggtggtgacgtgagggttgaaggtaatttctgtcgcagtcccatggtcatgagccaagacctggagtgctggaggtgcgccaggtcgggtcatctttgggttttgcccagtgagctgttgctaaggagagggctttgtttgcctagagctgggggaaatgttcaagggcaggcacacattggcagagatctgctgacgtggcgacggcggaactcatggctgtgtgtcaagcctgggcagtaacaggtggcgaaggccaa

SEQ ID NO: 8331 - DNA, 3255 bp, Homo sapiens
ttctgtggtgagatgaggctcctcctgccctccttgctgggtggtctttctgttttgaccacatcccttggaagcgtggctgggctgcgtaactccagagcagcctggtggtagctggggctgccttctgagtttgggctggtggatgctgagtatttgcattcagagccttaggcattgaccttggctttctgggaccctacgcccctctgtttgcctttgtcagtagagaccttctcacatttagggattcattttttccaagatctgtttgctaggtgtgtgtcaaacttcctcccagagcagtgacatggatgggaattgtgagtgtgttgagagacctaccctaaaagatggggctgcagtcatcctcaggggacctcctgttctcagctccacctcagccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggttaaaaaaaaaaaaaaaattgccggtaatcagccccagccatttctcagcatttctagtttggaacttcagagacttcaacttacgattcctttaaggcaggagtttctactttggcactgttgacattttgggtctggtggttcttcattgtggggggctgtcctgtgcatcatacaatgttcaacagcatccctggcctctccccacccgatgccagtgttgcctccctccccaccccggcatgaccagagatgtcgccagatagggcccagtgtcccctgcttgagagcccctggtgaaggggtagaagttgattccatggcccttgtcacactgtacttgagccataccgtgcttggcacggaaaccaccctgtagccgttgtcagaggtggagcgtcctccctgaggtgcgtaacccccacatcatcgttgcttccttgggctgtgttctagcgattgcgtccgtccctttttctccttgattgcagatggaagggccctgctctgagccgtcgccacatgcctggtgcttggctccatgatgctcacatgggtgttcatgacagtgcatttgacagacagatttatttgtcaccttgtcagggtgacatgttgggatggctccaccacttgtgtgccattgacacttggctgtctgaaatcaggacaaagcatccctgagactgatccgaatgaggcttatcagcaccaggcgtaacttaccgcctgctttcctctgtttctttaacttttaattgaaaccatttagttaccacccctgctgctaggaatctggggacaattaggaaagtcccatctgtcctttgaaccacattatattgcgtttctcctcgcaatctcaagaagacggcacattctagcagcagtgtctttgccttgccgtctcgcctcccactggatggtttttatctcacttgaatgagttatagcaactctttaattcaattattttctccagtgcaggctttgagatgatttagttgaatcaaacacccgggttttccaatgcagagcagtgactcccagcgaggccgtgggagggtttttacattttcacttccagccacggttgcgcgcgttctgtgctgccccctgagcgtcctggcacaagcccctacttaccattccgaggagtagattggaaatggcagatgccgtgggctttgccagtctttccccaaggcaaggaattatctgtccagtgatattaggtcactgcattcccacccagctgtgtcgaaagaagggagggggtggggcagcctgggtgatgggcaggaaggccatttataaattcaagtgtggtaaacagtcgactctcctgctttggtatttgagtttgaattaaacaaagtgtcgtgggtgggaggtgtatcatacgatcattttaaccattgtgccttttaatgtggaaaatctgcccaaaataggacctgctgcagtggttttcacatatacaaagaagtggctagaatgttctctcagaacagcacacaggattagaaaggacatttggccgctggaattcttcagtgagaattcagtgattaagcctgccttctgttttccttgtgggccgcagggttcctgtggatgtccccaccctcagattgctggagtagaaaacttaactttccaaaacactgagttgttttcagcccagcattagaggttaaagatgctcatgtagaaagcacgcaggatggatctgacgaaggaaacagcttctgatacttgagcaggctttggacagtgcagatgaagggggctgagatactgaggcagtaaagagaacggtcagcttggggtctggagtcgctgggcactgagtgcgcgttctgagtgccattcaagcaccacgtaacggttggggctggtgttgggtcctgagatgggccatgggccaccgttaaactcaggaagcacgtgctgcccccccccactctagaaggcgggctgttttcctggcgctgtgtgtgccatgctttgtgtgaacatctcactgggtgtcgctctcatgtggtaactgggcatgttgtagaagtcgttgctcctaaacgtaagccagtgcccacattgggtacgttctggaagaaacagtgtggcccaacatgggcttatccagagacaggacacctgctgcctggtgacgtcaccacctcccgatggcaccactctgttctactccactgcccccggggcctgacttgctactatggaactaaccctgtaggatgaggccgccatgcccgtgtgtgtgtctgtccagatctgtccccacatacttgctggtggcgggtgggaagaaggttagataagttactgtcatagattgtgactatgaagtaatccattagaatcttcagacaaggaatgctgggagtggtggctcatgcctgtaatcccagcactttgggaggtggaggcaggatggatcacttgaggtcaggagttcgagaccaacgtggtgaaacccatctctactaaaaatacaaaaatgagctgggtgtgatggcacgtgactgcagtcccagctactagggaggctgaggcaggagaatctcttgaccccagaaggcagaggttgcagtgagcagagatcatagagatcatgccactgtactccagcctgggcaacaa

SEQ ID NO: 8332 - DNA, 1033 bp, Homo sapiens
ccctttggcaaaaagtaggaactacagagggcctgtcattgagacttcaagttgccaatgcccctcacctattcatctgaactcaggcacatgtacatgctcacacgtgtgcatgctcacacgtgtgcacacatacatctgacatggacacactgatatgcacacgtgtacaaattgtgaatggtatggaccccacgtgaggcatgcacctaaggcgcgcctgtagcagcgggacagagaacaggcttccttgtaccctgtactcatcacgggggttgcgctggcttccttgggttggctttgaggagtgcggcttgtgacttctccacggtagagaactgaggccttagacaaatagtcatccattgtaactgttccctgcagtgttgatagaaatggtgttgggataattagactgtgctgctgctttctccttttctcccaggttgatgagtaggagcagtttaatttgagactagtaaattttgtaattggatttaaaagactgaaatgagcggacctggtttccatattacctttataccccagcgaggggaaatgcttgagtcaggtgtggatcagattattttattgtgccaacattaatattgggagcacacacataatctggagtcagcaggttcatccactactatctcattaaattttcaggcaaaagctgcaaaaattaattggaggcatgtaatagtttagaatgtgtgccagcttatggtaatataaattatgtgaagagaagacagttttatatactgagagagggaaaactggtttactttaatgagaagagatagaaatgtagagctattttttcattacagatacactctaaaatgtttggacttagttgatgaatagagttaattcgctgctacagttccaataattcatgttgcacagtttaatgacttctagataaaaacaggattgaaatgttaatttctcggaagaaattggggcactcttgtatatcagacatctcccccccacccccccattaaaccactagttaatt

SEQ ID NO: 8333 - DNA, 1052 bp, Homo sapiens
catcaaataccatttttttcactgttgtctgcatttaatacagcatcttctgccatacgcacttgtcaattcaaacatgagcgttacattttggtctttatgatctgtcaagggaaaatggaagtaaattctttataatatgctaattgatgtatttgggaatttttagatgtagacaacatctgtgcatgccgttaacacagttaatagctcccgttcttcaatatgagaaggttttcagagtctatgtgtgatctagatgagaccttctgtgtccgcccccccaggacttggcagtgtcaaatttaaggctgttttttctggtgccttaggactgaatctgagcctgcgcaaagtcctgttttgaggatgcttctggccacagtgtgctgggattgtgttggttctgggaagagcctggctggccagacctggtcttatctatcacccccatccctactccgtcctagcctggaccagactggctggagtgatgggtccagagaaagagaccgtggacctgaacagtccttgggacccttctgccactcttggaggtgccacctcccctggtagcttggcaccatttgggttctcctttagccatgggtttttgacaactcaagagcttattttccatacaaacttgttgatggttttctaaggcaggaagcattgctttattgagagtgaggaattgtaccctttgaaagctgccccctgaaaagggagtggagagagatggctccagttggagttcaggatgggggtatctttcagtgaacttggggggagggctgagtggtggagcttggggctcatgtcccaggccttctctggtcaggaaagcagagttgaaaagggcccttttaatctggagggcccagaatggtccagccagttgccccggaaaggaagcctcatgtggcatgcgtgccagacgctgcacagcttgagttggtcctatgtgtgtggcacagccttacaaggttgaggtatttacctttattcctataaattgatggataaggggggttaattgatttctcttg

SEQ ID NO: 8334 - DNA, 1051 bp, Homo sapiens
ccaaccctggtggagacccccttgtgccctagacaggcctggccactgaactgagggatggcagccctgttgtgtgggacagccagagacacgggtcagcggctgatttctctgaggcttggagcgtgtgtttgttaaaggcaagaagagtgggaaggagtggatggagtgagcggcagggccagagcctcacttgttgaagggagtggtggtgcattgtgtttactgtcaagtttcaggctggggcgtagatgccgatgtgcaaatgagtaggcagggaagtgagctttctcttattaaaatgttggcttactaatcaagtgttgctgggtgtgattagtggcagaggaaaaggttatttctttctgtaaatatttttgcttaacatttatgcgttaccattgctgattgtattaatactcttagaatgcattagaccaataacttgtttttttttaaaaaaatgtcttggttttaagcagtttcagttggtctttatggaaggacacacagcatttcactgaagcttgagggatctgccaggttcaagtgtaaaggggcattagtttcaacttagagcagctcccccagctacaaatgctgataaaatagctcagaagtgcaagagcctggttactttcagtaattttaggatttagtatctggatctgaattttgaccattgttgaaggagcagataattggatgcattttctaaagtaatgatttaggccaaggagggcagatcctttgagcccaggagtttgagaccagcctgggcaacatagcaagaccccatctctataaaaaaatttttttaaaaaatcagccaggtggtggtgtgtatctgtggtcctcaggttccagagtagctgggtgggaggattgtgtgagcctgggaggtcaaggctgcagtaagccatgattgcaccactgcactcagccttgggtgacagagggagaccccatctccagaaaatgtttttaaaactcggccaggtggcggcgcctgcctatgcctgggtggccagattgtgtgagcctgggagct

SEQ ID NO: 8335 - DNA, 1049 bp, Homo sapiens
tttcacttggcttaattccctttgagattcattcaagttgttgtatgtatggctggttggtttctgtgtattgactggaagatttttgacccagccttagaccagaacactgcggaagaggaaatccatcatggaaacccgagagtgacaggacccttgcttggtgacaagtagagctggtcatgtcgacagccccctcttacctcgtcgcgtctcagcagatgtccatggggtcgtattgggagtgacttttgtaccagttggcttggctgattttggaaagagtggaagaacccccttcaccttgtgagttttgttcatctgtgttgcatgtgtttgcacagtgtacattgactgaaacatgaagaaacagcccttgggcttttgagtctcggttttctttcttggcgctcatgctctcagaataataatacgtgtggtgcaggcccggtgcaccaggcaagtgagggctgtgctggcatggtttctttaggaggaaggcctgttgcacctatgtggctttggcatgcttcagtgaaaactgtaaaattacaagtcccaagaatctaatctcacagtgaaaatgttgagttgttcattcagaaagcacgcttgccctgcattttgaacatacatacttgtgtgtatttatatgttcatcatgtgagaacagcatttgtgaattgctaccctcatgaacatccatgctgaaaggttgtccattctttccaaactgcagaaatgcggctgagcagttacatacgtgtgtaagttagttcaggattcccagtgttagtgacttgatgcgcatgaatcaatagataatatttctatgtcctttaggggctctgcagttattttttttcctgaatcaagactaaagccagccctgctgctgattgtaggcaagtgccctttgctttttggggagccaggactggaaggtctcttggttcacaggcctgggttagggtgggccgcaggttggtctggagtttggcttttctctcccatcccagattcccctggtaagaggctgcgtcacctgc

SEQ ID NO: 8336 - DNA, 1046 bp, Homo sapiens
aagttgagaagagggctgaaatataaggcttatatctgtctctctgagcattttagaagaaagatatatctaagctctgtgtttaaatatagcatggtgtttgctactcggatggcaaataagcaattgaatatgtaggtcattgacttatgagaatgagtttggaggtttttttgcatgtgattaacgctgtcttacgattgggctgttgatgctccgccaacattgggttacacagagttcagcaagccatctgggaagaaaactggaagaatcatgagaggatacctctgtccccttaaggtgttaggagtgtgacttggtgttgagccctgtggctacagccagtggcagtggcaccaaccgctcccaagttacactggggagaaacacatctgagtgccgtgcgtctgtacatatctatcaggagggagggggcagagggcgatacttcatcgagataaatgccagcggtgtattttaatacattcttgattcagaaggcactgtttggaattgcatatttaaaaggaaactgccatccccttttgaaggtatgtgacatttaaaagatctgtagcagaagattggtttgacagctttgaattataattgaaagagtttttgttttaaaaaagaaaatgattacttctattttaaatgtcatcacaaagacataaatatgtttaatcaaattatatatttaatgtatgtagaatataatttttgtttgtgtggaagagtcactggtttgtgtgtgttttaagcagctttaaagctaagcaatgttgatgatttgaaagtgattcagcttttttggtaaatgactgtttaagggtttatagaatttcaaaaaatagtattattaaaatctgcttattttttatctatacacgtgtacctagtggcacattttgggagatggaggtacttttattgttgctgacagatagtaaattgtcgaatgaactgaaaaaacgtggaaccttgaagataataaaggcggaaacagcaaagacgctcctgcagttttcttttggattctt

SEQ ID NO: 8337 - DNA, 1050 bp, Homo sapiens
ttctggtgcttcctatccatacgctaggaacggagttcagcacccaaggaagagaattctagcctgaacccaaagagagaagccccttaactcttgatgtcttttaagtcccagtgacttttgagtttggctttggtcgttaagtttcatgactgcctatttttaagtggaattagaacttaagttaccgagaatcacagcgtcttgctaggtagcattcctctcgaccctgccaggtgagcttctgagaggctaagtgacttgcctgaggtcacatagttggacaaggcaggaaagcaccagcagctgaactggcccattgcgaagtgtgtccagcgggcctctcccaggccaccgctgcactgcggtctagtggtacaggccagagccctgggctcctccttgccttcccgcaacctcagtccactcctgcttcttaggtggacggcactggctttggcttgagactgggttaggcatgtcatctatttggtttctcgaatgctcagccctgacacttcttccgatgttcttagcatcacccttgaacaaacgttggttggggatccggggaccgacttgtttacacttcttctgatttgagtgaaataccaagaggctggcagagggacagcccctgagctatggctccctttcttagcccagatctcaagagctttctgctgtttttgctgtcatctctgctggatgtcgtctctgctaccgaggtacagcagttaggaaacattcgcgtccccatcactctggtcactctgctgactggtttttggacactgagtgtcccattcactctatcactgttgactggttttgggacagtgagtatgtgacatgcatatgacccatgcttaactcactcggagccattatctgagcactatttgtcaggtgctaagaaggcaagcttcaattgacttaagttccagcggggatgtttgctttttatgaaaatgatgcttagtacctccttactaagacaatggcagaatagaccagactgttgtcttcagagattcccaaacaccggat

SEQ ID NO: 8338 - DNA, 1050 bp, Homo sapiens
gggaagtggggattggtggggaaggggcatgaggtcaaatgaaatgcatgaccttaagtgtgccatttggttagttctaacacacgcacatacctgcgtaccccccaaagccctaccaagagctacagtcactccggaaagtccccttggggccctgccaggctgtccccaccctcacctccctgatcatctcaggccaccactgttttggtttcttttccttcaacagaggtagttttgcctgttctagaatttcatgtaatactacataatacatgtatgtacattatacacagcatatacatgtatacatacaatttaatatgtatgtatattatgacacatgtacctttttgcatgaagcttttttcatgccacacacatgatgtatttgagatttttaagacattttgggccagattattctcttgttcctttttacttctgagtagtattccactgaatgactcgaccgcagtttctttacccgctcacccattaatggacacttgggctgtttccagcttttcgctattctgagcaagtagctatgaaccattctcatgcatgtctttttgtggacatatgatttcatttctcttgggtaagttcctagaaatggaattgctgggtcatggagtaggtgtatgtttagtcttacaaagtggttataacattttatgcttccactgatcatgtatggaagtcagctattttttaaaccaccctacagaacgttggctttctgcttgggtggtggagtgggatgggagggtgagtgggtagggccccctcctctcccttgacccccacctccctactagcaggatgggggcaggggtctgcaccgttggctctgctgggcgtgggctgtggagttcacatgctctggaagatgtagctgtgtcctctatattagggtggggcctgtttctcttgcttttcctggctattctgaacaattcttgttccttcattccttccccccgcctcccaatgtctctcccttcccctgcttcctcttgtccccaaaataccatgctctctgat

SEQ ID NO: 8339 - DNA, 1562 bp, Homo sapiens
atctcatctgcatctgctgtcagacttgcgtctccctctgcctccccgcctgtctgcctccccaagaagtctcttccagagctgatcgtgtcttggcttcggtttttggaagagccgagccaacacacatcgtatttgagatacagtgggtcggaggcgatacccagggattttctccagcttggacagcgagccctttgccctctctgggtggcagggtgcctccctctaaaatgagggggcgatgcttggcagtttctagaacctgttcagatcaaggcaacctgggagttagagttccgctagtcttgtctggcagtacagtcggtctctaaatatgcttttattgtaccttccccaccatctgggtgaagcatcagtaatgaaaatggagtggaggctgcattgaccttttccagtgtccacgcactatattttaactgggaagttgcatgtattttctatacttaatactttaaaagcttcttgggcctcttgagaggcttgtaagtgcagcccacgtgtgacttgagctgggaacgcaacttcagattgagaagtcccacttttataggacacagcatttaacagcagctgcgtccaagtcgtgtggcatttggcagcgtgtttccaagtggacctgtggtaatcactttgctcttggggaaccgtggccaagggctgccctgcctccaaagaggctcagcaagggaaggctagaagtcctgtgggctggccaggcatggtggctcacacctgtaatccctgcatttttgggtggcagaggtgcgtggatcacctgaggtcaggagttcgagaccagcctgaccaatatgatgaaaccccatctgtactaaaaatacaaaaattagctgggcatggtggtgtgcgtctgtaatcccacctacttgggagactgaggcaggagaatcacttgaacctgggaggcagaggttgcagtgagccgagatcatgctattacactccagcctgggcaacaagagtgaaactctgtctcaaaagaagaaaaaaaaaaaaaaagagagaaatcctgtgggctatacctgggggttctttgccctgcttccaagccctgtacagccagcatgttgcacatgtcattgtcctggggttttcttcccagagggcccttttcggtgcagggtcctctgtttcatcagcctgcgttagcacaaacaaccctgaccgtgtcctggacctccttgagctcacgggcagaggttgctgctctgtcgtgtgctgtttgcagacttggacttggagtagttattctccctgtgcctccagggccttggtcctcacaggtgtttctgtgctcctccttccagagacaggcctcctgtgaatcgctctgaataaaatgttcccagctgaggttttggagtctcctttggaaggttgtcttggtattgttttcagtctcttgttaggaaaaccggacaggtgggtctgatcatctacaatgaatgtgcacaccacccccgggttcggcaggacacactgtgcccccagccctggtcatcttctgtttgaccacattt

SEQ ID NO: 8340 - DNA, 1027 bp, Homo sapiens
agattatattttagtctcttctagaaatacaaaaattagccaggtatggtggttggcacctgtaattccagctaatcgggaggctgaggcaggagaatcacttgaacctgggaggcagaggttgcagtgagtcgagatcatcccattgcactccagcgtgggcaacaaaagcaaaactctgtctcaaattaaaaaaaaaaaaaaatctcacttggaaaagcaaaatggtccttgaaaatgcccttgggaaaccacccatgctggaatgcaagggcatctcagctggccagggaccaggggtctggggccagaatgtcatattcttcaattgcaaatcctggagagtgtgcacaatgaataagatgtgggaagtgctcccacgctagctgtttgttaccattattattattagggacggtggtgctggtggtggtggtggtgatagtagtaggattcatggcaatcccagtagttatggtggcgtgaatgtcattgagaaagacaaatcctcccgtcaactgtgccttcttcttcctagcagggagtggctgtttgtgccctgttttatcaggagggagcagataagtgctagcaaccttctctggccccctgccgtgccctgccctaccctgccccaagggacagcagatacctttaatactacgaagcttgggtgggcttggtggttttcacgagtgactcagtcagtccccagagaggccctggtacctggggttgggggtgctcaaaaggttggcttctggagcaggggcgtccccaaggcacccctggccaggagtctcctgagggccccacccttcgtcccgatggagaagccctaacatctgtatttttagccacctcctccagggggtgcctgatgcagccagcccgaaactgccaacagcagcacacagactggctttcttcaaaaacaaaccactcccccaacacacacccacacactcgagtctagttattgaacatttggcatgaaaaatggttgaaagaagattttatataactc

SEQ ID NO: 8341 - DNA, 2210 bp, Homo sapiens
aagttacagcactcctggaaagaagggaaaatgcaaggcttctcctccccacctcatcttttgaagttaattttcattcaagtctgtgtttgatggaatatgtatcaaagacttatgaaagagtttttttttttttaatcctatcttggggtttggaaaattatatttaataattgctaaaaacttaagaaccattttaaaggtgttcagtggcccttttgatcatgatttaatggagagtatccaaaagccatcagtgtgactctaatgatattcacaaattaatgtttgggcataatctggagtttgcttttagctatcattattaatgtttaaagcctaaattatggctgcacttgggcattcagaacttcgcctgtgaaaagaagggctttgcacattgtgtaaaaaaaaaaaggggggattcacaaatgaatacagaatgtacaatagggagagagccaggccattgtttgtgtggaatgttgaccatgggagccaagggctagtttcgccttcattcttctgactgctggagaacacagaaacttcaggagctgtggacgggatgggaaccaggggcacattcatccgtctttgccgggcatggagatttggcctgccccctttccagagtttttcttagaaggtggtcttttctggactgctaaggaacgtcgtgtgctttctcttctcagtaatctgcttttttgaggaacgattttaacggcagatagtaagagttcctcaaggaaagtaaacagaccttttctaccccctcgaaatgtgattttaggaaatgatattcaacttcagaaaggaggcatcttaagtcacaggaggaagttgtgtttatttttactcctctcctgactttaaagtagtttttaatctgttggtagcattagggagaatgcagctaaaataagtttttgctggatgttcatgttttgcgtagctgctgccatttcggaaaaagctcctcccccattcacaaagcccttctccttccacgtgggagccgaggtcccaaagtggaaccaactctgtagcttaagggaggtgcattcctggcccctcactttctaaccctcaccttaagtggaatatgtagataatatgtagatcattaaccattgttggtgtctgaagcctgttcagtttttttagcaacgacactcggtgagaaccagttgtagtttgcatgtgtatatgcctagtccctccctcagtgaatgttttagaaagtgatctgctttagctgtttacctaactaaatttaacagatggttgcctagagttggcttaatattcacaaaaattgtgatgaaatggttgggatcttatgaatgggacaagtgatgattttgtttctatagagaattgtgacttttgtcctaggtaataatagagacttcgtttttcccaaagatcggttggtgtttaaaggatgggaaccctgaatagctgctgttgtctgcccctgatcctggtggtggccagccttgcctttggttttgttgccttctgtgagtccagaaaagccctggaggcaggggtgaggggggagagggagggctgggcttttcatccgtggggttctaaaaatccttctcatttataaaatacaaaaatacttaccttccattgtattgctgatttgtgcttcctccaaagctctcctctgatcagcagaaatgtgcttcttgcattaaaacaaatccttaattatgactaaaagaaactgtcagctgccttaaagattgtctggaaatagtggcaatatttctgtgtctcattccagcccacgttgtggcagaagcctggaagggccacgttaaaggatgtgtcacagagacagtgtgtgtaggtcttcctgcagcacaagcaagctcagggcttgtaaagtccagcttatcgtggctgtgctccagccatgcctgaaatctggcctccagcaatctgtcccgtcccaggacaaacaaaaactttattatggagtcatggaacctgaggaagtttctctggaaggaaccgaagacctagaccgtggagggagatcaactcctctggcctaatggggcttttctttttccaagatggaatttaaaaatctcatctataaaatgaggctagcaaagaatcattttatggtgtaagtggccagaatctaacctggaagtgatagtattgtacctgccgcaggtgtg

SEQ ID NO: 8342 - DNA, 1050 bp, Homo sapiens
ttttttgagacagggtctcaccctgtcactcaggctggagtgcagtggcaatatcatggctcgttgcagcctcgacttctcaggctcaggtgatcctcccacctcagccacccacgtagttgagaccacaggtgtctaccaccacgccagactaatttttattttttaatttttttgtagagatggggtcttgccatgttgcctaggctggtctcaaattcctgggctcaagtgatttgcttgcctctgcctcccaaaatgctgggattaccagcataagccaccgcaccaggcctataattctacttatctgagatgtttaaaatagtcaaattcataaaatcaaagactggaatggaggtgacctggggcctgggggaggggaaaattgggagttattaatcaatgggtataagggttcatttaagtataatgaataagctttagaaatctactctaccacattgcacctccagtcaacagtaacgtattatacacttaacatcgaaaaggacgcatctcacgctgagtgttcttagctcacccacacacaagtacagcggcagggaactgagagtgagagagacgtgactggagaaagtgagaactggcctgagtgggttcggggaccggccactgatacgatggtgggtcacagtgtgtgggcagatttacagaactggaacacgggtttagaaagttcgtatttgtgaactcatttggaacttttatgaaggtatcaaaattgaatctcatttggttattcatgtaatgagtcaaccatataaaatagttcagcaaggctgggcgtggtggctcacgcccgtaatcctagcactttgggaggccgaggcaggtggatcacgaggtcaggagatcgagaccatcctggctaacacggtgaaaccccgcctctactaaaaatatataaaaaaaaaaaaattagccgggtgtggtagcgggcgcctgtagtcccagctactcgggaggctgaggcaggagaatggcgtgaacccgggaggcggagcttgcagtgagccaagaccacac

SEQ ID NO: 8343 - DNA, 1050 bp, Homo sapiens
gaaatggaagaacattccatgctcatgggtaggaagaatcaatatcgtgaaaatggccatactgcccaaggtaatttacagattcaatgccatccccatcaagctaccaatgactttcttcacagaattggaaaaaactactttgaagttcatatggaaccaaaaaagagcccgcattgccaagtcaatcctaagccaaaagaacaaagccggaggcatcacacttcctgacttcaaactatattacaaggttacagtaaccaaaacagcatggtggtaccaaaatagagatatagatcaatggaacagaacagagccctcagaaataacgccgcatatctacagctatctgatctttgacaaacctgagaaaaacaagcaatgggtaaaggattccctatttaataaatggtgctgggaaaactggctagccatatgtagaaagctgaaactggatccctgccttacaccttatacaaaaatcaattcaagatggattaaagacttaaaacgttagacctaaaaccataaaaaccctaggagaaaacctaggcattaccattcaggacataggcatgggcaaggacttcatgtctaaaacaccaaaagcaatggcagcaaaagccaaaattgacaaatgggatctaattaagctaaagagcttctgcacagcaaaagaaactaccatcagagggaacaggcaacctacaaaatgggagaaaattttcgcaacctactcatctgacaaaggactaatatccagaatctacaatgaactcaaacaaatttacaagaaaaaaacaaccccatcaaaaagtgggcgaaggacatgaacagacatttctcaaaagaagacatttatgcagccagaaaacacatgaaaaaatgctcaccatcactggccatcagagaaatgcaaatcaaaaccacaatgagataccatctcacaccagttagaatggcaatcattaaaaagtcaggaaacaacaggtgttggagaggatgtggagaaattggaacacttttacactgttggtgggacagtaaact

SEQ ID NO: 8344 - DNA, 1030 bp, Homo sapiens
ccctccacagtccctgtcagaatgacatttctctaaacacagtgtacaaaaggttttcatgtgtatttctctcttgatcttcacaactctgtcagcgtggcaggatggatactactgtacacatttccagtcatattagccaaagttcatctgtttgtatcctgccaaaagtcaaacccagtggtagctctgggtcctcatctccaaatcccagcccagggccctctgcacttcctctgtgtcactgtggtggtctcgggccctgcagtgagttgcaccctcttgtttgaacacacaggcctgcaacccaaatggccctgaacagaacagctttcctggttcactataattcatttagtgttctctcctaccactttacatgacagtttacttaggttctaaagaccagactaccaaaaggagactcttgaagctagctggataattttatttctccaatatcagttatatctaggataggcattatatccctttaactcttacataatatggctattaactcttaacccaaacaaaaacccaatgtcatttgtaatgatgtgaacaaaatctgaaattaactgaaatggattcagtagcctcaatgatcaggccacaaataccaaatttcttcttctaaaggaatagctaaaacacaggtacttcaggaaattttaagttaaaaacagcaagttacaaatgtattttataaggatctttattcccccctgtaggaactttcatgttattgctttgacaaaggaagataactagaatttattcttacttgcttcagaacaaattttcctcgtgactgaaaggttgtttcaaccaaggagaggggctgggaggaaagataagcatctctcatacccctaatcccagctcattcctacctaagtaggaacatccttttgaattcattaacccaaaagatactatatcatctttcattataatcaacagaagtgtctaggtttatctagcagggcaaagacagttttatgatgtgtgtacacttgctacaagg

SEQ ID NO: 8345 - DNA, 1028 bp, Homo sapiens
cgcctggcctctgaatacatttttttttttttttgagatggagttttgctctcgttgcccaggttggagtgcagtggcacgatctcagctcactgcaacctccgcctcccgggttcaagcaattctcctgcctcagcctcccaagtagctgggattactatatgcatttttagtacagagggggtttcaccatgttggccaggctggtctcgaactcctgacctcaggtgatctgcccacctcggcctcccaaagtactgggattacaggcatgagctaccatgcctggcctctaaatacaaactttttatcagacatacgatttgtaaaaattttctcccattctgcgagttgtctttttacttttttgataaagttcaatttattgtttttttcttttgtttcttgtgcttcgggtgttgtatccaagaaaccattaatttagtgttgctttaattcagtgttttgaagatttactcctatgtttccttctacgagttgtgtagttttagctctgaacttaggtatttgatctgttttgaattgatttttgtgtgttgtgtgaggtaggggtccaactttattttttcctcagggagtttcctaagcaatgggtgcttagcaaggcagtactgtgggcggggtgggagcggggcctctgcaggacagtggcctccctcccctcgttctgactcagccggaggaaggagcctcagtcccgcagcatccgaggttatgcagaggtacaggtggcttgttacctccactaccacctggcctgctgctcacttgctgggagggaggatgaagcggagtgctgggcaggggctgccaatgttggatgctcacttgctcccaaacaggtttggggtccacagtctcaatgcagaggagagtgggggatgaggaccttctctcatttaacccccacactagccctctgaggccagggtaactgtgccccttttataggtgaggatcagagaggctaagggacttgcactaataacagctagcagggggcagag

SEQ ID NO: 8346 - DNA, 2026 bp, Homo sapiens
cacatttggggaagattctggcatttgacaacttatcagcttttttggacagtattgttgcaaattggcattcaaatcctatgctgtcctcactattctgcaaagagttaagggctgaaaatgcccttaagtcttcccagagtggagatgctgggagcagaggttgtggtgaaaggagaggcaggccgttcttagcaggcttctctctctaaggcctgtgcattcgccttttggcacttggcctagtggctgttggtgtggctagaagaggagtgggcagtgagcttgtctttgttgggggtggctgcagagccactcctggctgccggttaccggctgcctcctgagcatgagccctggctcatctggagcctctttaaaggtagaaaatgtttgccccagtgccagtcagcaccaggcctgatcttcaccttcctgacttagttaaggtgcaaagtctgccttctaaatagtgactgcaggctagggagtcacttcaggatcagaaggagttaaaagaatgtggctaacttgtttgtgtggatgttcattttctgagcacctccacacacattacctcttatgatcttcatataacaacccttcaagttcggcaaggtagcaggtgctcttcctgtttacagatgctgaaactgagtcctagaagcagagccaggcctggagcccagggctgcttcccccttcccaaagctgcccctccccattcccctgtgcacaggcactggccctgagttttcacaaagcctggttatttattcacaggggagtcctcagcactgcctcttctatttccctgtggaaacctcaaaagagaaatcctgccaaaagcgctcaaggacaaaggcgagtagaatgctttgactgcatcccttaccactttgggatccaccaggagcctttgcagtgatagaagtgggtggccctgcagagagcacacaagggagagcagggctgggttggataagccaggccaggagacacagagaccatgctcatgggaagagtggacgtgcagtctgcactttcctttctttggatccactcttcccagcttgttagctcaagctaggagcacacagtgtgtctccagtccttcaccaagaggacaggagatcgagatgtggaggtggcccctgggcagataactgaggtgacaaaccatagaattggttccacatgtagaagaaagtctacaaatgtagccgatcttataatagcatgcagcaccctccagccgagccacacaagctccacctgcccctccagctccacctgccgtggctcccaagactgtcagcacctagaaaccagttcttgcctctgaagcatgctgccgtcctcgatgcagatgtcttagctgtcacctgcgcaccttttgctgtcacatagttagtctgggagcaaagtctatcagtggtttggagtaccagctttcggatgagataaaaacagatttgaattctccctcttgctgtttattagctatgtgaatgaaggtaagtgatgtaatctctctgtgcatcagtatccttatctgtgaaatatggttatctgtacataaccatggtacctgcctcatagaggtgttcagagatcatgtagcatgacaccttgttctccaaaggcaagctctccatggaactatgactgttactgtctctcccagggttttgaagctctaatagtccacatgagcagtgtgacccaggatgaccttagaccttgtaactttccccccgtattaaaatggagctagatcgtatcccttctacccatatcatctgtcttctaaagctaccaggaataaaggcagaggacattaggtaataagatcagcaaaatcattagcttttcgggaacaagaaaataccaggataaaataagagaaagcttggtctcagttacccttaaagaaataatatataaatcagaggtttgatacttcagtttatttctttagttttcagggatatgaaatggcaataggttgctgttttatgctgaa

SEQ ID NO: 8347 - DNA, 1071 bp, Homo sapiens
tggcaggggcagtgggtggcaagctggggagcactgagtagcctctgagagttgaccggagccctgaggcacggggccttacatcagcccctgcgggtcagactcaggctggattggtcctccccaggcctagacgggaacacaacactgcctgctccctcttagcgggcatcactaggtacagccaggattgggcccaaaaggcagtcactggattaggacccagttctcttgttcctgggactttttaggagtgtctctgaaatttatcccttaagtaaaaagagcattctttaaaacctacagagccatcgcagtctaagagcagggcctggggtgctgtggcaggtcttgccttgaaggagccgtcttcccacagctcagtgtgctccagggcttgctggcaggcagcttccacggggtcctggaggctctgggggcataacagaaatgctatcagggagtttgagggcccgttatgagtctgacatacattggcattttgtgcatgcctttaattgtctgacatattgtggtactgagctgtgacatgggaacgattactagacctgcttttgctcatgaagaaactgagctcagagagggaaaacttgtccataaggaacagagctaatagtggtaggctggggctcaagcctaggactggctgactccaaagctcttcctgtctcccttgctctgtgtgcttctaaaagatacttagtccaagtccaaaatatgctcatttctcttccctcaggtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggcttt

SEQ ID NO: 8348 - DNA, 1027 bp, Homo sapiens
acagattagaacccaggagaaatattttctctgtttacaatgggtagattgatttttctttggggtgtttgcataactaaactaagcactttgtactacagtgatactttatatttttatacctctatttttcccaaacattttcgtattcaaagtgtatgtgaggcataatatagcgtagggggttaaaagcacagactttggagccagactggttgggtgtgaatcccagctctgccacgtagcaattctgagactttggatgagtgtcatcctctgtacacctcagcttcttcctaagcctcgtaggtggacttaatgcatgtgaagctcttagaatagtgcctgggaggcagtaagttcaatagatctgttcgctgtttttatcttctttgagtcactcagcaaccctaaggcttggtagggcagaggttattcccatttaacatgggaaaaaacaagatcacaccatggttaagtcataaagctgagaccagagctcaggtccgttggcccttagtcctgtgcttattctgtgacaccatacttccttccttatattatcaccttagagaagggagaaggtaaaagggcaagcagaaatgaggaaaagagaggagaaatacatctataaggctgggtgcagtggctcactcctgtaatcccagcattttgggaggccgaggcaggtagatcacctgagctcaggagttcgagactagcctgggcaacatggtgaaaccctgcctctaaaaaaaaaaaaaaaaaaaaaaaaaatacatctataaacaagaagcttcccgttgctattaagataagagccacattccctaatatgacccaacgagacccaaaagaattctagtgtgagcatctttatgttaatctttggacacatttatcagtattgctttagtattcttagaagtgaaattacaggaagaaagaagatgaagtatataaagcttttgatgtcaacaaatcgttttccatgttgttagactctcttatgatacttgacgtttag

SEQ ID NO: 8349 - DNA, 1116 bp, Homo sapiens
ctagtttccactaaaggttagtggtagacagcacttccactgtgtggcataacactagagaggccaacttattctagaaatgcaacaggattggctgcataaaaaacagaaagtatttattttacaaagtcggactgagatactatctgagttcaaattaaataccggttctacaggtagattctccagggatgggaagtgcccagacataatgtttggtgtctctcaccaccttccccactcataatctcatctttttgtcttaaataaacagatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaatctccactgagttttctggtaattttacaaaaacaagcccatcactgtccattggaaatgggttagacagatagatattctttcagtttatccatgatttcgttcatcttgtcgcctggaattaacatcacagttcgcaagggcgtcattggtacgtcatcaaaagaccatttgcctcccagacaagtgtcgctctcctcctgcactgagtagttgaacttgagaattgccttctaaaccaaataagtaaccatgaattaaaaatcgggacaacccaaagacaaaacccatttgatctacggcaaagaatattacgtttggca

SEQ ID NO: 8350 - DNA, 1050 bp, Homo sapiens
taggtcctgtgtcagcaccactgttccttctaatcttctcacatggctctttctctggcctgaggtggttccttacacacatgcgctgatcagtagggctgtgctgcctagttgagggagctccctctggcccccgacttagatctgtgtgtctctctccagtactgtgaccgcgagttccggccaccttagtctccctggatccctggcattgttttcctactgcagggaggctggcaggctccacctgggttccccccgcatgcacactgcagctgggaccctcctcggagcatgagctggacaatcacagggctcccctcctgagtttgccctctcaagaatcactatccttcactccctggtatttggtggcttgcaaaccgttgtttcacatattttgtccattgtttgcttgtttcatgcaggagggaaaagtccagtacctgtttctccatcttagccatatgagactcttaaattattatttttttcctttcctagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacaggtatccttaatgactattccttttctttttttgcaaatctgcactaggtatagatttagatcggatccatttgaaattatattttgaggagcacagagcagagatagtgatcaactcatttaaccttttgaaatgatagtgaggtattttaataggttagaaaaggaaaattttcttaatatgaaaaattatcttaagaaaactaactcaaagttcagcaaatttatacatcagatgtatgaaaacatactagatttcttttgctgaaataatcagtgcagatgaagaaaatgtgtcactagaggtgtttttccccaaataatgttgtgtgcctgttttttatttcctattggc

SEQ ID NO: 8351 - DNA, 1098 bp, Homo sapiens
gacgttttctcatttaggtgcatctttacttatttaaagatacatgtaggcagcaacacagggatttctttccctgtatctgttacgtagtattgcctaaaattttttgtaattcagacatttttttaatagtgatgttgtttgcattgtattttattttcatgggtttttttttctttaggatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtaattattattgagtaggctaaacagactgctgatcgttgtcaagcactagtttctcagtttcctaccattttactgatcaggaagtgaggatgaactatgtgacctggggattcgttgaatttggtcatgagtgcaaagaagaattattgcagccagtaacaaaagtcttgattccattagcatgttggaggtttggaaatgaattaaattgattgagctgccaaaggagaaagttttgagggaagactcaactactagagcataaaggtgatagtcatctttaatagtattttttctttagctaaggtactagcaaagcaaattgtttgactcttaaactgatctcttcttatgaacaatttactggatttttttgatagcccctttatcagagtaattagtatcttaccccagagaacttactagaaacttgtttcaagtatactgactttaattttagcaaattttggcttataattgacgataaaattttcatcctaatcattacaaaatattctttattacttttaaattaaaaattagaaaaaatgaaaacaaggtatctcaaactctgaaagacactgagacttcagaaaatcctaacatttgagatctcaaacgaaactaacaaatattgactaatttaccattactaggtgccgagatgtttt

SEQ ID NO: 8352 - DNA, 1004 bp, Homo sapiens
atatgactgcatatttatcattttttgtatgtatatgatatacattctcttgaatagcaaatctgcctattacagtgatttattctgttatcatctcatcctgcatgattcaagatattcaagaaagtcctgaggaaaataataaaatgattacggagacataggatttatgaaaacagttggaggttctcagtgtaaacagatgaagcctaaggaagggaagaatggcaaatctaatatatttgagagtcagaattgccaggtgaaaaacaggacgtaggccgggcactgtggctcacacctgtaatgacagcactttgggaggctgaggcgggaggatcacgtgaggccaggaggttgagaccagccttgacaacatagcaggaccctatctcaacaaaaaaattaaaaaattagccaggcatggtggctcaggcctgtagtcccacctactcaggaagctgaggtgggaggattgcttgaactaaggagtttgaggctgcagtgagctatgattgcaccactgcactccagcctgggtgacagagcaagaccctgtctctagaaaaaaaaaaaaaatgaaaaattaaaaaaaaaaaaccaggatatacatttctgcaagaaaaaaatgcaattaagactgataggatgggtgtaatccttcaagtcagggtaagcaaaaattcctaaatggatttggaaatggattttggatcttggaaaataaagctcataacagaactgaggtgcagatggtcttagagtacatgattcttataagtttaatataaactataattaattgtagagtgacttttgaactgtcaactttagaacatgcatcattatccaggctggtagtagaaactgtaaatgccacaggacttggagaggtatgtaatttcccctgaaggcaggctggaaaggcattcctattaagaaaccatcagtcttgcagtcttaaagtgagagtgccatgaaagctaccagaggattttgtaatt

SEQ ID NO: 8353 - DNA, 1041 bp, Homo sapiens
cattcctttcttaacagggacagttgcttcaggtgtggtgggctgaggtacaaaggcacccatggagacaggtggagagtagcttcctgctttgacaggttttgcaggttgtttctttctgcccttgctgggctgccttattcttcattgctttcatatcttcacttcacagttactcttgcttctgaacattgtactttcttttccactgtgacatgcccccagaaccagcgcagagtcagaagatactctgatgcattgtggtaaacagtgtttgagtcacaggaaagaggccagagctattgaaaagacccctatgataaaataaagcaacacctgttttcttcctggtattccatgctctggagaggaggcaacatggctgtcaaagggtgtctccaccacttactcacttgtaaccttatagaagtcacctaacctctttgacctttaagttgcctcatctgaaaaatgtggacgattaatatacttgctctgagggttgttgtgaggactattaaatttatgtaactgatgcatggtgtatgtatgtggtagctatgtttataattatatttttataattatgattagaacaagattgattttcctgaagaggtatgctagccataattttgaataagctcagattgaatagctatttaaatcagaggatttaacattgatcattgattggccgggcacggtggctcacgcctgtaatcccagcactttgggaagccaaggcgggcagatcccaaggtcaggagatcgggaccatcctggctaacatggtgaaaccccgtctctactaaaaatacaaaaaaaattagctgggagtggtggcaggtgcctatagtcccagctgctcaggaggctgaggcaggagaatggcgtgaacccaggaggcagagcttgcagtgagccgagatcatgccactgcactccagactgggcaacagagtgagactccatctcaaaaaaaaaaaaaaattgatcattgattatagaaggcagtagtctatatttgatactgtcttt

SEQ ID NO: 8354 - DNA, 2480 bp, Homo sapiens
gcatgcttctgtctacaggggttccttggtttaggagacccaaaagacttaatcctggttggattcactttttctgagtgacattttttagtttgtgaaaatgtgtgcatcgatgaagaaattttattatgaattagcttaaaaatgcattaggaacttctgtatgaaaagatcacattatttaagtgtaaaaaaactgcataataaaagcagttcaagtcaagaaaaacaatgttaatggaatatattttaaaacttatttccaacctcaaaattaattttctgcaactaaggacctgcataatacctagtaagcctttggggttttgcagaggaggtcgattctaaaaatgggtgtttaaattacttaagagttctattttttttcttcccacacaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagttt

SEQ ID NO: 8355 - DNA, 1091 bp, Homo sapiens
aatttgtctagtggctaatttctgactgcttatgatgtacctcatgatacaattgtaggtagatgtcttcagcctttctgtagttcaaaatcacctcttgaaacaggaaaattctttttccaaaaaaaactattgaaacagaaaaatttccaaggcattctttggaaaggcagaaggaacagaagttgggatgtccctgagacacatgctcactatgtgagagttcctggtcagtgggggatgcgtctgccctccaaccctcctccagccagagactatctaagctaatgaactttaagtgctactgaaatcacatcaagttgagccactcataattacaagcatgtggacaaatccataagaatgattagattccattagtgttcttctggggaatacttggtttagctaaaataaaaataggttgaattgctccctttttgtgagcaattcacaaaaatataatataaatttaattcttagcacacacaaaatttggacctaaaactaccatattctgagttcagcaaacgaaactcatgtagcaataacctcttcagatacagaattctggcaagtacagctgtccagacagaccctcttcggcacaaactaggaagcttcaactgccaagaaaaggaaagattcccaggtgtccccagtacctgctgcatagccaggcagccagtggagggggagggcttgtgtgtctggatggtgggcaggaagtcctagtggggagatgcccatagactgttccagagagggaagaggagaggctcaagaagggcactgatgcccacacaggtgtcctaagtcagagactgtacttctggggcaggctggaagcagaagacacccgacagtgccagacaaggtcctagaaaccacaggcacaccagggacgcaacagctgacgtgggtcagcacgttcacccgtcgagtcttacaataaaacgcaggctccaggcgcttaccgaattcacagtctggaaggtgctgcttcctcagaatgaaaccaaagaagggtgaaagcgaatcttttaactaggatgattcctaaacacagagcaaccaggcccaaggctgag

SEQ ID NO: 8356 - DNA, 1031 bp, Homo sapiens
cagaggataggtgggtggttcagttctatgttctggatactgtcaccaagaccaggactgggttaaaaatcctatctatgtcactattttaactatcagaacaatatcaataaggaatgtgtattcttgagaaggggaaactgtctggactgttagatagagaggctcccactgcatgcagagaagtttggggaaactccagaaatggcaatttcctgttctgccttagcagtgatggttaaaggaataggaattcatttactccctgtaaatgaatgaataacggaccttctttctataatgtaaactgtaaaaattagatttgatatatatcttattaggcattgttattgaaatttatcctgaattccttatttataatttgtcagcagagacagtcatttctccataggagcaaagtaccaaggcattaccttgactatcctagatgacaagtctcttagacaattcatcagtgtgtgattttcaaatgatttctccttttaggttactgttgattgtgctccctgttgaattttgaagtttgttttactaattattggaattttgtggatgtcttctcatttctttagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatcca

SEQ ID NO: 8357 - DNA, 1033 bp, Homo sapiens
aagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaa

SEQ ID NO: 8358 - DNA, 2443 bp, Homo sapiens
aagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacag

SEQ ID NO: 8359 - DNA, 2194 bp, Homo sapiens
ttaccatattttatgaggctgtaatactcgattgacatgagacactaatagaatgtttttattgtgtatgtttttatttcaggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccac

SEQ ID NO: 8360 - DNA, 1841 bp, Homo sapiens
ccaacttacaggagccagcacgtcgtgtctcaagatctagcttctcttctgaccctggtgagtagtggttgggttttgttccagaatcctgaaagatcaggtctttgcgaagcatattggcaaagaaggggcaacaagaatgcaagtgctaaatgtctagcctgtcagaaatggaggaggtgtcatttaacatgtcaacgacagacagatgcctaactttcccttggtgactgatggtatgctatgcttaggagagactctagatatgagaaaattgcctgttcagctgtcaactcagttctcagtagttagatagcatgtgctatttcatactggttattggagctgatatgatttatatatttgtatcataatactagtatcataagacttgcaagttttaggcattaaataatttgtaggccaagtaaaagctagcttataagacaacctgaaacaattaaaatattgaattccacaaatgttaatcattgagaaaatgctgaacttctgtttcttatttcataattcattgccaagatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattagtaagtttatttaattgtaaatttatttttctaaaagatgaacaccttctatgtagctgtgagaccttcattctttcagtagtgattagctttgtggaagagaatgtaagcacataaggcacagggataagacagacacgcacgctgttttcgctaatagatgaatactgaaggcctaggtaattgtaacaaggaatgacagaagagatggaagttgtcag

SEQ ID NO: 8361 - DNA, 1050 bp, Homo sapiens
gatgtcctctgtttttagtagtgctttcttttctgcttaatgtttcctttggatgatgagtatggttaaactaatttccttttgatgagtgcttgtgtagtataacttttccacccccttaattttaacttttcataattgttatggtttaagttgtctcttggaacctgttgtcaggtgacctcttgtgtttaactggaatatcttcttgctggattgatccttatataaaatgtcctttttctctatgaataacttttgtctgagatgattttgtctcatgttagtacagtactccagttcccctctgcttgctgtttgcatggtatatcttttcccatgcttttattttaaaagattgtgtctttgaatcaaaattgcgtctcttgtagacaacgtattagttgggtcatttaaaaatccattctgctaaatgaatctctgttattgtcttcatttgtattagctgttttttaatgcaccacttaaattccctagtcatttcttttactgtgcttctgggaagtttgccttcatttttaaagagtatttttattgaatacagacttctatgtaggaagtttttctttttttctttttctttttgtttgtttgtttgtttgtttttgagacagagtcttgctctgtcacccaggctggagtgcagtggtgtgatcttggctcactgcaacctccgcctcccgggttcaagtgattctcatgcctcagcctaccaagtagctgggattacaggcacgcgccacaacacccggctaatttttgcaatttttagtagagacggcgtttcaccatgatggccaggctggtcttgaactcttggtctcaagtgatccacctgcttcagcctcccaaaatgctgagattacaggcatgagccactgcgcccggcctataggtaggaagcttttgatgtttattggagggctgaactatttttcaaaacaagatattatccaaattgagataaattcagatgattaaagacatccaacaaagatttgaaagtgaatcttagaaagagagacttga

SEQ ID NO: 8362 - DNA, 1047 bp, Homo sapiens
gcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtg

SEQ ID NO: 8363 - DNA, 1089 bp, Homo sapiens
aattaatttttttgtcggacaaaatatgaaagcaaaaacccatctaaaacgtagccctcctctcagctgccctggccgcttttcatccatgtgaggagccatcagccgcctgaaactccagctacctctcatcatcatgcccggatcagttcaaagttcatgaaatttctatgagcattgatctcgccccattgattttttttgcagcagatctttgaaattttaatttcccgagcatctgaatttcttatagatgaaatgcacttggaggagacagttgatgataaagtgaagaacttagcatcattttaaagcctaaaaaagggagaaaaagcaggcatttgcagactttgtgtaatgtttttgaggtggaatgatgaaggcgctctggtgggggcaaggtattcaggggggagctaaatatcaattttgtcttccgtggccacacatttttaatgcaactttttatacagtcatttttgaaagaaaagctatctggagaaacagcaggacagaaaaacattcttcaccgcacaatcatttgctcacagcagtctttatcacctggtcaagttcacctagttacttatcagtgggacatttaataacctcaaggtgatataattgctattggcatttttcccccttggattcagctggttaatgtgtaaactacttgtcagcaaatagcactttgtcactgaaatcactaacaccctctagaggaatgtctttgtattgagcaatttaattttactttatttaatttttacacattacaacctgtgttcattcaggcacactgacggcttgcagtctgttggggtagggtctgggtctccctgttagtaaaatatactatatcttatttaacaatccccattgccttaattgaggcgcattcttgtccctcggaaaaggaactgcagatgttcttattatgtagttatgttgctaatgtgaaaaactgcctcattacgaggatctgtttgtagctagaaaattactgcgttatgacaaatgcatgattgggaagctacaggaagatgatcattattgaaatgaaactggaactcatttaatagctgc

SEQ ID NO: 8364 - DNA, 1063 bp, Homo sapiens
aggattctgtgggctgtttccgagtggaatggggctgggaaagccgcgcctggcgtgtagcagtttatctcgagctgctgtcttcccctctgcctgggagaaacaagtaaataaagcccatatttcaagcttgatttactctggtacctactgtgaaagatgatgactctttagggaaataaagacagggtcagggaattagtgcacataatggtcattttgatgacgggccaacagatgcaacgagagacacactgtacacaattaagcataatgtactaatgacaggttagaatttttatcgcctcttcgtgatggagcagcaaatccatgttttgcagtaataaagagtttattggtgctaaagccaaagattttctgacataggaaagatttttcctttcataacaagagtattaaattctttgtgtaccagactctagaagtgagatatgtaaagtggttgtcagatatttcttaggaaaaagccaattaaagggtaattgagtaaaggatgagaattaccttttgacttcacatgttgggcattcaattttctcaccccctccccaaacactgaaatcgtgtggctcactgagcacctcctcgtgaaagcatacatttgctccgtgtgtaactctgcacaatatcagagtcacacacctgctgtacggtgccagccaccttgcaaaggcttaattgaatccccaactcagacatgaccaaaactagggtaagaggtaagcgcagagctcttctttctctctgctgaggcttcccctctgtccgtccctgtagatgccccaagaacctggcatggagccacttgactgttgagcttactttatttgtgtcactgggacctgtgtgctcagaaaggatcctggtctctagggttgtgcacgacagctctttctcaagtacttgcactgctctttaggcagtttggatagaagcagaaactatcattgccacatagaaaataaagagagggagtgagcaagcaagaatgcatgtgtgtgtgtgcatatgtatgtgtgtgtgcatatgtatgtgcgtatgt

SEQ ID NO: 8365 - DNA, 1128 bp, Homo sapiens
ctgatttcccacattacccatcattgagggccgcaaaagggggttgtccttctaggaccgaggctggaacccaggcacgggaggctgtgctaagagccagagctctttccttgcagcgtggccacttaaccctgcgtgggggtaggcgcgcacctaggagtcacagctcggtttgatgaggcgtcttttcagggggccagtcagtgtcacaccttccagtgtacagtgactcacgttttcaagcgctggagaaaccaagccctggaacagtctgaaacttgatgattaaagaaaaaatcctgtacagggttcctgagatgctgagaagtaggtaatttcaaacaagtgatagccacatgcaaaaagcaagccattagaacagttcaaagtttcctttttctcttcaatcaccagggtgcgaccgccaagcccactgcatttctaaggagacaatctatttctcctttgaccagagggaaagaaatcatcattgcatgattagtggcttcagttaggtgagaacaacagcggcagggaaggcggtgaggatgggctgtattaattacccaacacttgctggcaagataattttatcagtggtttggccagtggtaagttgcagcttttgataaaagtggatacgttcttagctacatggaaacatgagggtagggatggtgtcagatgaagtgcatctcatcagcttttctctgacaaaccaaattcattccttatgtaattgataacggccttggccaattatttcacacattacaatacacagaggccccctttacaggttttgcagggctgtaattagctatgctaatatcccctttattggccctaatattgctcaacaccttttgccatcctggaacccactagagccccatggcctgtcaggaccgctgattattgagaaggatagctttaatcaaacataattgcagttaatttttctctcctgctctctgttgccagcatctaatgccacggactccttgatattccattaaattacaattaaacagcctcctttgtttctgattgtcctgaacaacaccacaaagttctgtagccgtttaaaggagagctgtttggtcctaattgcctgctagctcacaa

SEQ ID NO: 8366 - DNA, 1026 bp, Homo sapiens
attaagcaagctggtgtggatgggggaaatgtacatccgaggaggaaaggattaacaagatctttcccacttggagatgggaagcaaaaaaaaaaaaaaaaaaaaaaaaaaaattaaaaccaaaaacaacaccccctcacccacatttattttgagaatgacctccccagccatcaggaatcaggatggcgaaagaagcattcccgtgatcttcagatccctaaaaacacacacgcgtatggtgggagaggcttgaaaccctaagttgggataagcataggcacttaatctctgcataacctgtaaaagcctcccctggagctggcaacaagtcaggggggtgcgtctgttgtgagccaagtgatgctggcatttttcttaaataaggagcttcgtgatcagagctggcaaatagaacagtgtccagagggagagaggaagctgttttaatgagcccgcagcgaaagacaaaatacagactgattgacagggcgcgtgatctgctggggaaataatgtcagtgctgcattgcccattagaaatagagaaataggtaaaggggggaaagaaagataggcacttgaaacaagaaccctagtgtaaatatagtgcacttcacatttcttttgtgttgtgcagttgacttctttgaaacagataaccttatcaaaactatcatgaaatatccggagcagttgcagaaaatactaactagaacactgacagcgggcggagtggggtggctgacgaagcttgtagctctgggatgtacttgcctttagagtgtctacctggattttacttatctgaacacattaaaaccacccggaaaagtttaatgcgagtcatacaaatttctccaaacggaggacttggcggggatctgttctggaaggggatattgaactggccggcaaagccattaaatcccatcagatctctttggcatcattttaatgagaatcattgcaaaagtacaagatcatggtatctataagtgcctcttgacagccgctgctgaaattg

SEQ ID NO: 8367 - DNA, 1073 bp, Homo sapiens
catcaatcaagaggagagagaagcatcctggctatcagcgaagaggagaatgtagatgcagggccgggttccagcataggaacttgtcacctggactttcttggcttttttttcacgcacggtgctggcgtcctttccggttctgcgagtgtggcccctggtgtgtcctcacctgtggaggagttcaaccctgctgccattccccggcctggccttccctccggctggatctggccatttcaaagagcaactgggacatgtccgtttctcctcctgggcttccctcgcacagcaagtcgggaaggctgtatttatttacattttagccacatggctggctgttgttttggcctgtttgaaatgacccaggctggtccagggcgccggcctctgcctcaccgtcctccggcacagtccatggtgaggcggggcctggaggagaacaacttccttatgttcctcaccatccgacacacataatggggctttgtggcactctgctggcatcaagaaatgccagcggattgtttagaaaatttaagacgttttcattggcagttaaccacgctgcttttgattccatggtgccgtcaccttattgatgtcgactccgatttatgaatgatgaagtggaggacattcgctatcagaagctcacaatgtagctcttaataaaagattaaacgaggaagagaaggcagcgcggatttctgacactctgctgataagcagctccgattcaaggctgcgcggaggcaggaggagacagtgacagatgctgaacgggagccggcgcacacatgttgctgccgcgctccgacgtgtagccgtgtggaaaatctgtctcgagaactttttacagatcagacaccaaaaacgtcttctccttactcgaggctgcacgttatccgaggatgcaaaattaatagccgtgcagaggggacgccggccgcgggccgggcagccttgctgcgggaggcgcagcggggcctgggcgcgggaggaggggcagcggcgagctgtcactttgagaaatgaggggtctaagaggctgggaccagcttggcagatgt

SEQ ID NO: 8368 - DNA, 1030 bp, Homo sapiens
tgtacaattaaaacaaaattccagatattcctgaagtggtgtgtgcagttagggagagcaaaataaaattaagacaaatggtaggatcgcaccctggaccagctctggaagctaatcaggatcagaattctggagatattttatgatgggcaatttcactagaaatggcaatgaagtaagtgcctgtgagttaccatcaatatttgtaataaaaataaacaatcatgcattcctctggcctgcaaataaacagggtaagtttaggcgtcataattatgacattgccagagtggtggtaagtcatgtggagatgtcagctgagcactggcagcctctggcttcttcccagctaagagggccacagccacttggatgagacactccagatgtacttgactgtctgacctggaaggacccacttagatgtcaagagcatcctacagttgagaatggttcttatcagagggcgtgccagaaaaagacttaccagcccaaagaattatgcatggaacctgcctttgaacttggctctgatgggtgttgggtaatacctggttttattggctcccaagtccctgaacttggctctatgggtgttgggtgatgtgtgctttcaatggctcccaagacctttgggtttgcactgggaccttcatgaactcagtcaccctgctctgaggtgccctcccatggaagtctacccaggttgcctgtggctgatgggtgtcaaaggctgtgacggaaaaagccaagaaatctgtatgcagaagttcaggagcacccccgctacggtgctcctcatgagtgctctcacaggcaaagcctggctacagcaccatcaatgttgggggctgtttaggaaacaagatctctcatgaaagaggttcaagttaaatttcctcaaagtgaggagaactggaggccctttggcatcaggcagtgagtccaggaggtcagggcactgggggttgcccaggaggaccttgggccggtgctggccaggcctcctctgtccctggaggctgcacca

SEQ ID NO: 8369 - DNA, 1024 bp, Homo sapiens
ccatcttggatttcaagcagcccttctcccagaactcatggcttggtctgcgttgtgtttggtcacctgcgtactcgccctccccactgtccccaagcacctcggggacagagagagtctcagtcatggctgggtccccttcccactgtgcccaggctgggcttccatgggcgggtgcctgatgtacccttgcccttggtaagcccggctggggaagtcctctctagcctcctccagagcacagctcaagtgtttattgactgctgcagggggcaaggactctgctacatgccacgtttcagggattaaaaaataacactggactggagtttgagggctaagcagatgagcagatctcactatgagtaaaccaagagtctcccctgattccacccctgccgttgtagcctcaggtcccagattccagcaaggacagacatgaaatcacacctgcatgtgcacacagatgtgtaggcgcatctgggcttcactcctgatggctctgacctgtaggcccctggggcagggagctggggaggggggtagggcagggccctgatcatcgttaaacaaccatgcgaacacacagggttccgtctggcctaaaccgcaggttggtggtgcggaggagggcaggcctggtgatgctgagggaagcagaaatggcagctccaagctccattactttctcaacgctccccgatcctctttagtctggtggtccactttgatttctgatcttcctccagatctaatttttttcttagcttttctcctaagttacattaaacatgaggccttgtgaaaacttgacttcttgacttctcccctcagtttcttcttcagtgaaatgtgtggggcatggagaatgagacagaagtggggtcttggcccctggacccagctggacacctctgcccgcttaggtcattgaggaactaagctgtgacatgagtacgcaaagaacctatgcctgagctcttctcaaaaatgccaggctgggagccctcggcctcaggaatgc

SEQ ID NO: 8370 - DNA, 1061 bp, Homo sapiens
aaagaaacacagatacctctttaaaacctggcttgcaattctcttgtgtatacacggagatgtgggattgctgaatcatagggtagttctatttttaattatttcaggagctgccatactattttccacagggcccgcactgtttctcatccacacccacagtggggtgctcaagggttccagtttctccatcctcaccagtacctattttctgttttttgttttttgtttttttttttttttgttgttgttgttgtttgagacggagtctcactctgttgcccaggctggagtgaagtggcttgagcttggctccctgcaacctccacttcccgggttcaagtgattctcctgcctcagtctcctgaatagctgggattacaggtacgtaccatcacgcctggctaatgtttgtatttttagcagagatggggtttcaccatgttggccaggctgttctcgatctcttgacctcaggtgatccacctgccttggcctcccgaagtgctgagattacaggcatgagcctctgcgcctggcctgttttctgttttctgatagcagccatcctaatgggtgaggagctctatctcagtgtggcttggatttgcatttccctctttgagaggggctgagcatcttcccaagaagacatacatcggccatttgtatgtcttctttgggcaaacggctattccaggtcctttgtccatttttgaatcatttcgttggtgttgaggtttaggagttctctctatattctggataaaatcccttatagatacttggtttgcaagtagtttattccattctgtgacttgccatttcacttggttgatggaatcttttgatgtacaaaacttttgaattttcatgaagtccaaattgtctattttttttcttttgctgactttgtctttggtgccgtagccaagaaatcaaatccaatgttgcgacatctttgccctctgttttcttttaagagttttatggttttgggtctcacttttaggtctttgatccatttggagttaatttttgtatatgttgttatatatgtg

SEQ ID NO: 8371 - DNA, 1553 bp, Homo sapiens
tatgagagggggatttgttaatatagagatagatatagacaggtatagatataggtatatgagagggggatttgttaatatagagatagatatagacagatacagatatatgagagggggatttgttaatatagagatagatatagacaggtatagatatagatatatgagagggggatttgttaatatagagatagatatagacagatatagatatagatatatgagagggggatttgttaatatagagatagatatagacaggtatagatataggtatatgagagggggatttgttaatatagagatagatatagacagatatagatatatgagagggggatttgttaatatagagatagacatagacagatatagatacagatatatgagagggggatttgttagtatagagatagatatagacaggtatagatataggtatatgagagggggatttgttaatatagagatagatatagacagatatagatatagatatatgagagggggatttgttaagggaattggctcacaggattatgaggctgagaagtcccatgacagattgcctgcaagctggagaccctgggatgctggtatcacggctcaggccaagtctgaaggcctcagaactgtagaagttgatggtgtaatcctcaatctgagggcgaaggcctgagcacctacgggactgctggtgtgaatcccagagtgcaaaggcctggagcctgaagttctgatgtccagggacaggggaggaagagtcccagctccggcagacagagggagacactcacctttcctctgtttttgttctctccgggcccctaaccaatgatggcacccacccacattgagggtggaccttccctacccagtgtgctccgactcacaccccaagctcctctggaaacaccctcacagacacacccagaaatgatgtttgaccagttctctaagtattccttaatctagtcatgttgacacctaaaacaaacatcacaccatagttctgtggtctctaatttctgtggcaacttagtaactctcagagttgggtgcagaacaatcacttgtgtgtgcattttgaggatgccaccttgatggcaccatggtgctctgtggccctctctcgtggacaaagcatggggctccacgtctgacatgggggcctccttggactgggtctagggtctgcccatccagacgcattactgatttgaatgtccttgctccaaattctatttccatcttaatatctatcagcagtgtgtcaacaaggctttccaaggcattattaagaaggccatcctcctggccgggcatggtggctcacgtctgtaattctagcactttgggaggctgaggtgggcggattgcttgagctcaggagtttgaaaccaacctgggcaacatggtgaaaccctgtatctataaaaattacaaaaattacctgggtgtgggtggcaggtgcctgtagttccagctacttgggaggctgaggttggaggatggcttgagcccgggaggtgcaggttgcagtgaactga

SEQ ID NO: 8372 - DNA, 1026 bp, Homo sapiens
gaggcttggtcacctctgaaaacatctgcacatcttgggccaggagtgtgtatggagacatttgggtaccaggaccccagggcactccagatacccagctaggccctgtagggtccctcctgcctggtctactgggttgggaagaataggacacagggtcgctcagggagcttgaggtcagcaggcattgcttcatgatagcaacagtttaagttgaaataaccagtgggctcaaattggtgctgttaccaagaccaatagagaaagaatgagaagacttcgttttataaaattcagagcatacttctgattgttggcctgtgtcaggcatcagggcagacatcaagagcaagttagaatcagaccatggccttgccctcagggcgctcacagtcgcggccccagacagggaagtcaactgttggggctacttgctatatgtcatttaagggcccagttctcagagatgacctgagtgcattcatcacttctggggcatattgtgtgtaattctggagtccactttggccatcaggatcctcagcgtgcatggcagagtcttgttgccacactcaggctctcttcttgatcttgaggggatggtaccaagatgcacttggatcccagaaaaatgttagaccccttaaagggctgtgtctacaatgcacttacaccaaaaagtatccccaagacattgggttctcaattgcttttctgcttctctttaagtgctatcctgtccagggcaaaaaaaccacaaacccataggtattagtcagagttttccagaaagacagaaccaataggagatatagagatagatatagacagatacagatataggtatatgagagggggatttgttaatatagagatagatatagacagatatagatacagatatatggggggatttgttaatatagagatagatatagacagatataggtatatgagagggggatttgttaatgtagagatatagatatatgagagggggatttgttaatataaagatagatatag

SEQ ID NO: 8373 - DNA, 1024 bp, Homo sapiens
gcacgcacagagcccaggatgcctgtgcagggaagcagctggtttgtgtgtgtgacatggcagtgcagatgtgtgcctgggcaggggcttgagtctgacccacaggtgagctcacgccattgtgccctgtttgcctgttggacaccagtgggccctcggggttgtgtactcggaaaagaggctgatacatccccgtcagaggggaagctgccaggaatggtacctctagagggggacgtgggccacaggggcatgggggaccctctagcactagaggctctcacaggtcttagcataactcctcgtaagtcctcaggacgtggtatctagaaagattttgctcctaagtgcaaccgtaaggtcggttccattttcctgggctataaataacttaagacgaagtccggtattagcttgcgtgtgacagaagtttgccattgactctgggatctctggttccacgtgggaattctaactccattgatcgctgagaagcatgggaagagtgtccagtctgacgaagtctgcatagcagaggagcagaatgatggccccggggtggcattaggaggagacgcagacgttgtggcagagtgggcagctgtcgtttgaatttcccttgaactgtttcctcaccacgcttggcaaaacaaagaaaacagaaccaaaacaaaaaacaaaaacaaaaaccccaagtctttaaatgagatctgcatagtcagaacattgcccagaggaacggtcacgtgtttcagctgatggcagtgggaacttttaatgtgattgttggttggtttgatttttgatgaagtctggagtttcttatgtagactggcatgatcatgctgttttcagatttcaccctgtccttcgtatttgtcagtcccttgagaagtggcaggatacttttgacctgggagaggggagggtggagggcaggaaggagggccagggctgccagccagcactgacaccactgcccccagagtgtgctcgaacacagtttggctgccactgctctgct

SEQ ID NO: 8374 - DNA, 1049 bp, Homo sapiens
tgggaccgtatattaaaaagtccatcctgctgggcacagtggctcatacctataatcccagcactttgggaagccaagaagggaggattgcttgaggccaggagtgtgagaccagcctggtcaacatagtgagacctcatctctaaaaaaaaaaagaagatcatatatgtatgtataaaaagtccatccttatcacagtgatttgaagccaaactttcatatatattttgatttatatctggacttttaatgctaccacactggtctgtttgtctccttgtgtgccactgtgtttaattatggagtgtctatggtttgttttcgtgtccaggagttgttttattttttccttcagggttttcctggctcttcttgcatatttgtttttcattgtgaccgttagtatcaactagtataactctataaaatagtttactgggatttttactgggattatattgaatttacaaattaatttttagggagaactgtcatctttataatgttgggttatcctatccaagagttgaatttttctctgattactgctttaaatgtatttcatggattctgatatgtagtgttttcattgtaatttttttttaaattctttcctctcagttggtgacctaagaaataataagactcttaaatttccaggtggaagtgcctttctgtttttttgtttttgttaataattgatagtttattgcattataatcagaaagtattggctacatttctaccctatagaaatcattgttttttcctttaatgccatcagttgtaactgtgctgtgagttcttgagaggaatgtgtatactctattatcagggtacagagttcaatatatatgtccataaggtcaaccttggttgattatgttgtttaaatctatctccttacttgttttctgtgtacttgctctgccttgtactgagaatggtgtatgaaacctcctgttattagtatgtttctaaccgtgtttgctcacatctcctgtagtctttgtttgataaaggttatggttgtattattcggctcatag

SEQ ID NO: 8375 - DNA, 1049 bp, Homo sapiens
cgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctggggttgaaggaaacgggataaaagccactgagtttcctgggccgggacctgagcgctgcccgtgtctccacctcgccctcccgtgtgcgtggctttctcctagctcttgggcacattctcacgtcccccccataacccgtcaccttcatttctgctggtgcttttgggagtcagacctacagactgcatcagcatcaccaggcagtttgctttctggagccttttccagaactgtcaagcagactctgggggcaaggcctcgggatcctcattttaaatacaaggtttaagcccttcgtttcaggatggatttctgcagccactacttcccagctactgtccttcgtcctgcccgggttttcagagcctgatgctgccactggcgacccacaccccctcagctgcttttcagaaccacacgataaaatctgccccgaaagctgctgcagcactgtctgcgctcacagtgcccaccacaccaccgcccacaggccaggccagccaggcttccgattctgccctttcctggagacccatcctcctccctccgggagtgatgcccgctggtcagctggagcgagcctctctattgccgaaaagccttttctgacactcctgcatctttagtttgggacatctctcccactaccaaacttaaaccacatgagggcaggggcttcatttttaagcagttggctttggtgaggctggtggtgatgaactagcaacaccatcttgccctggtaggtgacttcccccagcactgagttggaacaaagcagaagctttctgtgtggaaacagcattcggtttggtgatcctt

SEQ ID NO: 8376 - DNA, 1049 bp, Homo sapiens
cctcatgttcacagccagcggacgctgacgtcgattggaagctgggtgtgctgggggttgcttatctgtgacgtgtgttcccatggcgagtgatgcgtccctgtcctcactgtccagaccctgctcctgagatgtccaggcctggatcctgggcttgggacctggggaacccgggcctatgtgccgtgagtgacccctcacatgacagccccctagtgtccgggaagcctggctgaaagggagccatcagtggccgctaaaagttgacgatgtccagcagcgtctgctggcctgctgccgggctcccggggcaggggctgctgcagtcactgcgggcggctgggcctgggtttctcccagatggcccccactttccagcagcacaggctctggtttcctcaccagcccactgcctggccaccccgctcagggcagcaggagccctctgcggcggccaagtgcgtggcatggagcgacccccatctggcagggagtgtgcggtgcccctggggactttggagcaatggcgtttctggactccattagttgggactaagatggtttgatacaggctttgtttgggtttttgctgactttgctgtgattctgtgattgtgtgtgtgagatgggctcccccagcttggggaggaccgtttgctggtgccgggtccagagaatgtttactgggttgagctgacctgctctcctgtggggaccaaaggaatctgccggctggaccgagggccccaggacaggctgtggggaggctcagtgcacacagtgctcttgtcctgagccctcacaccatctataaaatacccaccagcatcctgagggttccagcctgtggctctcaggattgtggagtgcagtactggccactgcagaccctgtctggctttggggtttaaatggttaagtgcagtgtgatcttcctcccttggacctctgatggggagtgcttggccctgcatgtccagcctggcccagggcgagggtttcaggagcactgaggacccgacagggctggacagtcaccccggcactgc

SEQ ID NO: 8377 - DNA, 1047 bp, Homo sapiens
ccctcccaacctcacctgccctcccaacctcacctgcccccccaacctcacctgcccctgcaacctcacctgcccccccaacctcacctgccccccccaacctcacctgttccccccaacctcacctgcccccccaacctcacctgcccccccaacctcacctgccccccccaacctcacctgcccctgttctccaccttgatgccacctcctactctgcccgtttcctgcggggcttcccatggggcccggcaagccgctgcggaccctgcagacctcaggcacgggtggatgcggggcttgtggtcggcgtctgctcttcaccaccatcctcctgtggtccacgtgccctttcagttggccagctctgctcatggttggtcagaggctgtgggatgcgcttaaaagcctcagcagcaagtcctggaatttggagagtctgtgacagagaagggcacattccgtggccagacaggttttgattctgtgccatctgtgtacttgcctctgaccatcaggtgggggctgcacccgtcttctcctttggttcccctggactttggatggggcggggctggactcagggaggcctcctgggcagtctggggtggctcttcccagcagagcgtggggagaagtggagccacagccagccatgggggcggaggaggaggcagcagctgtgtttctcagtctcaggcgcagcggagtcggacgtgtatggcaccacgtgttccctcctcttagtgctggggtcatctccatgacagcccgcggcctctccctcctcctctcttcagctctgcagatgctggaccctcaggtgttccccaaaaccgggcccagacctgctgcaacttgcaggtcacaaaccacccccttcactggccttctgtgccgaggaagatgggcggcctggagggaatctgcctttctagaggctggagccctccccactgcccatctgtctgggagcctggtccccatgacaccctcctcccagtgagtgcatccaggactctgcctccgctggtcgcacggtgaggg

SEQ ID NO: 8378 - DNA, 1050 bp, Homo sapiens
cctcacaatcatggcggaaggcaaggaggagcaagttgcgtcttacccggatggcagcaggcaagaacttgtgcagggaactcccccttttttttttttaagacggactcttgctctgtcacccaggctggagtgcagtggtgcgatctcggctcactggaagctccgcctcctgggttcacgccattctcctgcctcagcctcccgagtagctgggactacaggcacccgccaccacgcctggctaattttttgtattttttagtagagatggggtttcactgtgttagccaggacggtcttgatctcctgaccttgtgatccacccgtcttggcttctcaaagtgctgggattacaggtgtgagccaccgcgcccggccggggaactcctctttctaaaaccatcagatctcgtgagacttattcactatcatgagaacaacatgggaaagacttgtccccatgattcagttacctcccaccgggtccctcccacaacatgtgggaattcaacataagatttgggtggggacacagccaaaccacatcagaaacatcagaatttaccatcaattgtttctaacagtagccaccaatgagacttcatttaccactaagaacttgatctctacaaccccttatcttaacccagacactccttcctgttgattgattccaggtctttagataataattctttcaaccaattgtcaatcagaaaatctttgagtccacctatgacctgtaaggtcactctcctgcatctctccccatcccactttcagttgtccttcctttctagaccaaaccaatgtatacctcacaggcattgattgatgtcttatgttcccctaaaatgtataaaaccatcttgcaacccaaccaccttgggcacatctcaggatctcttgagactgccttgggccatggtcactcatatttagctcagaaataaacctctttaagtatttgacagagcttgactctttttgtcaacaacatcaaaagaaaggcagtctttttttaaaatgtaaaatatactttataga

SEQ ID NO: 8379 - DNA, 1052 bp, Homo sapiens
gtaatgggacacggggccgtacggcccatgtgcggggactgagccagggttcggcaggtgtgttgcatcctcactgcccgagcttctctgggcactcgccagtggctctgggaacgcaggcggccccactctctccagcccagtgcaggggccaggctgggcctggcttgggagcccttcccgctggtcccctgagggtcctgctgggggctgctgccaggcctccctccagctcagtgcccagcagccggcggctttcacccagcacgacgaaccaggtgtcacccagactgcagcctgtggagatggtggtcgggagtggagctgctgggtcatgtctcgggtctgagacgaggagatgggcagacgcagggtgggtcgcgccctgcaagggaaggttggcgactcttggagcgggaaggggctgccgccctgtcatccaccgccctcagatgctgccgcacctgtgctttcattttgccctaatgagtttgaggagcagctgcagatccaccagtaggacccagactcacctgttttgccttcctgactcctttcactcatgggcgtgtgctgctggctgcctgggggtcaggtgcatgtccactgctggctgtggggccgagacagcacctacacccagcaggaggtgctgcggggccctgcccaggggcagtgagggcggcacgggctccaggggaggatgccgttgagtggctcctgaaggtgaacccctgtgctggccgagagggtggacaccagccaggggaggcccagcccccggggtcgcccatgcacaggaggccccccagggtgtggagctgagttccgggtgctcgtgattatttgccaggaaaaggagcggtgattcggaacatctggcgtcatgcggataaacctgctgggacttggggtgctacgcaggggctgggtgggagctcgggagtctgaggccgggtgcctctgcttggagggcagctggacagcgcagccagcagagcagcaggagggtcttggcagactctgctccaaagttcctggagcctccccca

SEQ ID NO: 8380 - DNA, 1012 bp, Homo sapiens
ggcatgagccaccgtgcccagccgttttttaaaatatatatatgttttatctgttttttactatttttaatagagacgggggtctgtgttgcccaggctggttgaacccctgggctcaagcgatccttcacctgcgcctccccaggagggtgttgattctttggctgtttggcagggtttgcctgggagctcttgggccctgggtttgtctttgttggagacttttgagggggacttggccccttgctggccacaggtctgctcagtccctttcctcttggtcggctgtctgtctcgcatcttgtctggtgcacagttcatgggtttctagtatctgctttttatttctgtaagattagtagttatatcccttctttttctgattttagtaatttgaatcttctttcgtcttagctgatgtagctagaaatttgtcgatttcattatcttttcaaagaaccaactcttgggtttgttgactgtatttttctgttttctctcttctgtcatctttgttactcctgtctgctgcttaggggttcagtgtggtcttcttttttctagtttcttaatttgaaaagttagtttacagctgtaaacatccctccgagtgcagccttcgctgatcccctagcgtcataatttctgtttgtctggaggtgtttctgattccctctgatttcttgttggagccgtgggtggtttatgtttaacttccacatgtttgtgaagtttctggttttccttctgttgcttgtttctaactttatctccttgttagagaacagactttttgtgatttcagttttgtgaaatgtattgatttgtgtagtggccccacatccatcctggagagtgttccgtgcgcgcgggaggaggatgtgccctcggttccgtgcgcgcgggaggaggacgcgccctcggtgctgttggggtggtgttctgcaggtgggttgaggccgtgtctttcctcactgatcgtctgtccggcggttctctccgtggttagaag

SEQ ID NO: 8381 - DNA, 1062 bp, Homo sapiens
ggagtgggggctgcagagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggtgggcaccgggcgcggtccctgggagcctgcgctgttgtgggggaggggttaggtcccatcctgatgaccatggggacgtctgcatcgcttctaaagagagcgcccgccttggtgacaactccgtgcccaactcagttttggagggtctgtgagtcaccatccagggtcctgactcatctcctcctggggcaaaagttcccctctgggatgtggggttcaagtgagtcatttgcttcctgtttgggatgagactcagaatatcggacattgtatgtgcctgcagcttgcctttttgaggaagtctgacagcttttcttccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcggtgcgtgcccgcccggggggcatggggcagtggtgggtggcaggtgttgaacatggcacccagtgtgaggagagactctgcaggggccgtggagcagctgcccagggcaggggcgtgtggccaaagctcatgttgctccatgtgctattaacttgcaagaggaaagccctggaagctcttactggtcagctgaaatcagcaactacaaccttacagttaatacgtatcccaaagaagcagcaccgtcccaggaagaaggttggagaagcatgaggggccccagcagtgt

SEQ ID NO: 8382 - DNA, 1026 bp, Homo sapiens
aacccccaccccacggcacctccaccccaccgtgaggcttctccccacaagggcattggccgaggcttcgtggctgtggatgaatgaggccaacatggtggaaagtaagtgatgcagagtcagaggcagttcctggaagatgcactcgctgttcccaaaacgccaagccacacccactcctttagggatggtagacattggggtctcggttttattggtcatcctgagaaggccactggagtaatagaaagaaatggaatttgaagttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcaccactgccctccagactgggtgacagagtgagatttgtctcaaaaataaaaaaaggaaaaaaaaaaaacaaggacagtgtggatctgcatcaggattgaggctttcgctgaagggcttgcgttggtgacggattgtagtcttgaggcctgcagtcacaggacacttcccagcagatgtgtgaggctgacagagtgattttgtaaaccgaaagcctgttgtacggagccttcctgagctgccagggcctggtttgggtatggtctggctggcacggggccctgtcaggccctcgtggggacagtttcaacatcctgctttcgtctggtgctcctcccggccccccaggcatggcccgcctgaggctgtggactgagaacttggtcctgggacctgaggggtttggtgggtggcggcccgtggccgtcctcgtgaggaagcttagctgtgtgtcctgcagccgtctcatcctctctggatagaaattatcaagagtttcttaacgtttaagtgatagctttttaaagacaaggttttttgtcccagagtaactcagacttaccaagttgtacttaccaatgttgaaag

SEQ ID NO: 8383 - DNA, 1033 bp, Homo sapiens
atgtcaggagccatcctgtcacgctggggcccttctccggcagggtaaggatgcatgtctgttgctgaagcctgtcttcacccatcaagtggtgttcagacctagtcactgccagaaagaagcaattcagcttgttcacagggcgccctcctttgaaacagcggctctgtgcctaggtgcaccctctcccgtggttcccactgctggtgctcatgttttcccaggggggcccttgcaggacctgcactcctgagaagaggggctagggctccccatctgccctgttgtccccagcccctcacgttgtggcaggcagggatgtcgaggcgcatttcatttctatgtggttgaccctttgtgggtgttgaattgagtaatcatctttgccgtagatgctagcttctatgcatgtctttagttgagtgtttgcgctaaagtgtatctttctggttttgttttttaaaatgtccttgctagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggtacgtgatgcgttgatttccgggctctgccgataggtacgtgatgcgttgatttccgggctctgccgataggtatgtcatgtgtttatttctggcctctgggcaggacactttgcaggcccagccctcccccgggcctgcctttcctcaggttgtgaggctcaatgctgactggctgccgcctccatattcccatcccaggatggcagcagagaacggctcacccgggtccttgagggttcttctcctgtcccttctgccagagctgtggggcagcctgcagcaggcccctccccagccggcatcctggtgccctggtgcagacctgcaggcatcagaattgtgtgcagcacttatttctgaacagcgattcatgactcccatagattctgttac

SEQ ID NO: 8384 - DNA, 1030 bp, Homo sapiens
caaggcaacttggaagggtgtcgtgggcagctgtccccagctcagctgaagcacttccttcctcaggtgggcgtgacaaatcccccatccagccccagcccacctgcctgtcacacctgcccctgcccaccacctgcggcagggcgggaccagctcagctccaccaccgtggaaccctcacccccaacgccaccaccttccccaccccttccaggcgctccctcctgtccttccttactgggcacaccagcctgaggagtcttgcacgctgtgtggccagggcccgctccacggggcccagtgccctcattgccttttttattttattttttttgagacagtctcactctgtcacccaggctggagtgcagtggcgcgatctcagctcactgcaacctccgcctcctgggttccagtgattctcccgcctcagcctcctgagtagatgggactacaggtgtgcaccaacacgcccagctaatttttgtatatttaatagaaacgaggtttcgccatgttgcccaggctggtctcgaactcctgacctaagtgatccgcctgcctcgggctcccaaagtgctgggattacaggcatgagccactgcgcccggccctgaccaccttctttagccgtccctggcacaccctgtaaaacaaaaacacaattccaatctccgcctgaccccacccgactgatggaccctccctaagcccagggcattccacggttaacctgaaaactagttcaggccataatgggaagtgggggtcagacaggcctcattgtacccgcctccttttggaattcaggcaaaactgaccagcattaacattaaaacagagaccttaagactaatagaacagactctgacaagaaatagtcccttttattgattctatctgcatatacttggtctccacaacaccttatcttaaccctgactttcccttctattgattctaggtctttagataataacttaactcttttgaccaattgtcaattggaaaattactgaatccaccaatg

SEQ ID NO: 8385 - DNA, 1062 bp, Homo sapiens
cggggaccgaggggagccggggccgcggccgcgagtccacgtcccgcccccgggcccggcccagcgaccgcccccgccgcccagggaccgcccccgcctcccagcgaccgcccgggccctcggggcggggaccgcggaccttcctggtggcgcggcagccgggcggctcctccttcctcccggccctggcgtggagcagagggacacaggttcccacgctggcgcccggcgaccgggtggggctgcggtgagtcccagaggcccccgccccgcagctcccggccgccccggcccgtccccccagcccccggtcgccccatcctccctcccccacccgcgcctgccccagccgcctacacccccgagacccccacccgcccggcgccccggcagccccggactccctcccccatcccgcccagcgctccccccaccctccacacacgcccgcccccacgtgccaccaacagacgcaggtcccgaccacagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagacct

SEQ ID NO: 8386 - DNA, 1091 bp, Homo sapiens
acctgcgatgcaacgtttcggggaacctgcagctgccggaggcggaggccgtggacgtgaccgctcagtacatggagcggctgaacgcgcgccacggcgggtatgggggcggccgaacgcgcgccagggcggttttggaggcggggacagccggggagaggaggtcctggccttggcggactcctcagaccttccccagggcccagtggtgtaccggcctgggggctgaggcaccgcgccccaccccagggaagccccagcttctctccttccttcctggcgtcctgactgcccgggcacttgtccagcctcagggacctccctggagccccacccagggctggcgccccatccttgcacctgtgtaccccacttctgtcatcctggacctgggcccagggatgagtccaagctgcagagatcagcgtcagtcgcatccagttgctgcgcagacagccccattccgggggggccaggcagagacccttagggcaaagctcaagacccctgggcccctcctcctctcccctcgcagtgcccctgggcgttcccagactgtcaggacccgactgcagaggaaggtgcagggcttctgccccattggcccctctggtctccctgaggccccaggaatctagtgctgtctgccctccctgcaggctggtgggcaggagtggggagtctaatttggccttggggaggcctgtggagttctaagaagaggcagtgtctgctgtgcccagccttgaaggcgagttaggagttgcacagtgatgacaggcagaggcaggggcagaggatggaggcagaaccgggactgtttctcctgtgcgtgatggaaggttgcgagcagagcaaagccaggggcagaggatggagacagggccaggactgtttctcatgtgtgtgatggaaggttgcgagcagagcaaaggcaggggcagaggatggaggcacagctgcatgtgactgtttcttgtgtgcatgatggaaggttgcgagcagagcaggaattccaccggtttgggtgcagacaggtatgcctctgcctggaggggaagggaaggtggtggtggtgactgacagcctgg

SEQ ID NO: 8387 - DNA, 1033 bp, Homo sapiens
cgacgtcggaccacaaggcccagcatgccccgcgcggactacaagccccacaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggtgagggcagtgggcggccgcggggcggcgagggtgccctcgacctgggggttccggcaccgctggcctgggggtccccggcagcgccctctcgccgtcttggagtccaggactgtggccgggggtttgagggtgtggcagcaccgccccccgggtcccggggagcggccggaccgagctcccgacgccgggtcgggcggagggcggcgctgtaggtgggggagaccctgggcagaccctccctgcggccgctttgcgtctctctcgccgccctccccacccctgcccgccttggctctgaccgcgcggttctgcgatccagaccccttccccgccacccgcctccagcgtcaccccagaaacgctttctctgtcctgctgtcgaagcttcacctgtgtcccccgtcattctgcctgtggttgctcctcagtgcttgcggctgcacgaaatcatcttgtgtgtcgcgcccgaccccacgtggcgatcgtgttgattagcagagtgttgtgcgtgcttcaggaatgtagtcggtgttcgtcgaatccaggctctgtttctctcctcagttgcccctagcggggccagcgcctcctccctgcacaactcagccctagctacaccttg

SEQ ID NO: 8388 - DNA, 1040 bp, Homo sapiens
gaagatgcctttctccatcatcctggatcggggctttcccagctttgcctacacctgggaggcgcgagtagccagatgaagtctttctggtcttgctggtcagagccagaagggccagtgcccggtccaggagcctctcgcaggccttgggctgcccatccaggcgtggcctttccttggccctttggacgacgacgccgcgttttcctcttggtctcggcctccctgcccaccatgagagtggacatgagagtgaccatctccaaggaggcagctgggtcttttccactccccatggcagggagccagctgtcttcacgccctcaccctagtgaagtggctgaattgccaggattgatcacagctctgttctgtgtctgatcacaggacatacaccgtcctgcagagtctgcaggcgggtgggaggagccattgaacagacctggcgtcctgggagggacacggaattcttcccttgagagtctcatgctatcttgagcggcactctgtcacttccaagatgtgtagacgtcgtgctgcgtgtaggacaaggactggagctcactaatacggaccttactttccaggagcgttggatttgagcagctctgagatgtgtcctcctgcagggctgctgtgcctggtgccctttctctgggtcccttaccctctgcctcccttcctgttgggtcctcttcattcccatttctgcttccccagggccaggagggtgctgggcactcggtggccacctcaatgacagtgtgcacatttacctgaaggggcgaagggttacctttatatttcaggtaatctctgtgttttggggaaatggaaagatggtgttgggttagggttgatcaatgatcagcgtttccctgggctacacaaggagtgagtgttgggttggtggccactttagaaaccacaggaaggtctctgtcgtggaaagtcgtattaaaggagtcaagttttacgcctgtaatcccagcactttgggaggccgaggcaggtggatcacgaggtcaggagtttaagac

SEQ ID NO: 8389 - DNA, 1023 bp, Homo sapiens
ccatcccttgagctttgcgtttattcctgggattctgcatgtgaatgggagcctgtgctgtatctgggagatgctgactgggttgcaggcacgtccgagggtcagggtggggccgagtgcagcctcctcctccagtgggcctgtgtgtggagtggtggcattctgggtgtccctgaggcctggtcgtttccatcttcttcctgagcccacatggagatgacgaggggtttcctgctggtctcttgcagaacagggttgagtggtgtcctcacgttgatctagcttctgggtctcccattctgcatgtgagcaggttgatgggctgttgtctcttccacggttagcctcccttaggctggggctccttcacccctcttttcttagagacattactgcccagagtgagaacccctcacgtggggtggccgtgtggttccaagacagggtcctgtggaggccctgttagcttccccactggaggcctccctcacagcaggctcctgtcccggcatctgcactccagccaggcagagtcctgctcccgtgcacaccacaccctgtctgtctgtgctgtgggcccttggcggggttctgggtgtctggagccccttgaccttgttcctcctacaaggtgacctcgtcaggaagccccaggatgagactgtccctggctcctccaaaggtcacttcagacatgtgcaccctttggagaggtccctgctgtttctcagaactgctggggatggaggctgagcccgagagtgcttgctcctcgcgctcccttcttgctatggtctccggagatgcctcccaggccacgagccctcctggcgtggttttactgggacctggctttgcaacaaaaatagttgttttaacctccctaaccactcccatccctcttttgtttttctctataacgtgtagggtttcttagctctcctgtattggtctcactccactggaaggaaggctcaggaacgcaggctgtgtcttctcccgggtgtggctggggcgggggct

SEQ ID NO: 8390 - DNA, 1023 bp, Homo sapiens
agccaagcgagtaaactcgtcttctcaggtttatctccacaggcaggcaggctagaccttgggtgtgtcctctgcctgaattccatggattctgacgccagtctcagaagtgcgtgtggaagagaagctggttttagagcctgtgaatcagtcttgagttttctgtgcctgactctcctctcgcgttgctcttccgacgcgcgcacagggtgtgtctgcccagggctgcctcctgcccagcaaggctgctgacaccatcagggcctggccccacttgctccggcgggatggtgggaggaagccggagcagggtctgagaccagcagcaggatggggacagaggtggaaggaggcattggaggcctgttggtgtcggggccacaagttggctctggttggcgggagccctggggtttgtaggacttagctgtccctacagctcttgggccagcacttcattttgtaaagcaagagtctcgctatcttcgtgactgttgggtggggtgatgggtgggcatggtgtgaacgtcatcacgcttgcacgggcgttggtggccctgtttgcccactgatttgacaccagccctgtgggctctagaacacaagcatgcccagtgccctgtctgtaggggagcggatgctttagaatcacgcacagcagacctcataactgagtccatctccctgggggcagtggggcatttctggttagaaattactgttgaggtgcctggacccaggactctgcagcctgctccccagatgagctcaccctccatcctcacctgggaggcgcaggtggcctctcctgtcctggtctccctaccctgctcctggctgcatgctctgtgggttctctcccaccttgctgtcatccctctcccagtcagctttgctggcccttccccctttttctgagcctgaggtgccagcttgctcccaggcctggcctggccagtgcctcccgtgctccaggcccagctcgctccttctccctttcttaggcagtcccagcgggggtca

SEQ ID NO: 8391 - DNA, 1029 bp, Homo sapiens
cctaacacagtgaacaaagagagcttgaaaagctgccaacgagaaaaagcagatcgtgcacacaaggtcacagtggctcacgcctgtaatcgcagcactttgggaggctgaggcaggctcatcacttgaggtcaatagttcaagaccagcctgcccaacatggtgaaaccccatctctactaaaaatacaaaaattaggccaggcgtggtggctcacgcctgtaatcccagcaatttaggaggccgaggcaggcggatcacgaggtcaggatatcaagaccatactggctaacacggtgaaaccccatctctactaaaagtacaaaaaattagcctggtgtggtgacgggcgcctgtggtcccagctactcgggaggttgagacaggagaatggcatgaacttgggaggcggagcttgcagtgagccaagatcgcaccactgcactccagcctgggcgacagagcaagactctctcaaaaaaacaaacaaaataaaattagccgggcataatggtgcatgctatacccggctaaatgatccaaggacagaacaggggcacaagaccccaaaaattacctcctgcaaaaccttttcttagaaagctgcaaaagaacgtgctttaacaaagaaaacaaatctggaaaaacatcctgacacaggcggggttcccgcaagggagaaaggtgggcggggcttccaggaagatggaccacagggtggccaggtaggctggagctccgtgaagctctcaggcttcatgaaacatgacctctgactttcagagttaaaatgagaactaagccagagtggtgccgccagcccgcctttcccagtacatgaacatgcaccctcactctcgcccatgtgctcacactcacatggacactcgtgctcactctcgcccatgtgccacactcacgtgctcactcgcccatgtgctcacactcacatggacactcatgctcactctcacccatgtgctcacacacggacactcgtgctcactctcacccatgtgctcacgtact

SEQ ID NO: 8392 - DNA, 1034 bp, Homo sapiens
tggtgaagaggttgggataccggcgggcaacgctgttccaatccacgtcctccagccgaaagccctggccaggaagcaagaggcacatggtcctcccctcccgcagggctccagataccagaccacacacgtgggaggcctagctcacctccccggtgggggcctgaatgttttcagagaggtcgcttgggtccatcagagtctctgccgtcactacctgcaagaggggaccggaagccagtgggcaggggctgggtgctcccctacagcacctctcctctttgacctcacctgtgctttgaggcctcctgattcctccctgctggagcccagagttccagaggcacctgagcagggcaggcttccaggcaggccagggcgccccagcagaggcacccgacgagatggggagggctggggagggcagcctggggcaggagggcttgggggacaggctcacctccacactgccagtctgggatcgtagcatgcggcccacccacgaggagcgggccagctgcaggaggcaggacttctgcaagttctgcagctcggcctccatctcctggagcgtgcgggtggtctgcagcagccgctcctccaggtgctccttctcctgctccgagagggcctgtggttggtggtgggggggtgtcttctgcagaaggcccccaggccagccccagcctggctccccaacaccaggaccctgcccactccctgtgcccctgcctcacccactgggctcgctccttctgttccttcaactcctggatcagcttctggacctggttctgcaggagtttctcctgactgtgggagctcctggaggaggggtgacctcagcagcccccaccctgctcaggcaggggttcctaatgtcaggtcagtggcgaaggaggggagaaggaggggctccactgccaccttggccccaagggcacacagtacagccccgctggggctggccagcctccggctggtctggacaagggtctagcacccatccacatgcgcagggttagggtggaggc

SEQ ID NO: 8393 - DNA, 1065 bp, Homo sapiens
ttctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaaggtgagttcacctctggttgggtgcttcctcccttcaggatggcctccctgtttataggtgacccagcctgtgttcagcctcttgtgaggttctagttgtctgctctgcggctgaccctggggccacaggattgagtctggcttggtctttgctttgtgagcaccatggctcttgggggtgtgggtgagctcatgtgaggcgtttgtggtgtattggtcaggggcaggagagaggatggccgtgggtctcccaggaccagctgcagaaaccctggttgacataggggccatcttggcctgcaagccagaggcaggtgtgctgtggtgcgtggtcactttgctgccttgacatgtggttctctcagttgatacagaaaacaccggtacgatttggcattcattcacaataactggcatcaaaagagactgtccttaaaacaggtgaatagagtttaccgtaaacgtgcagtgtattttatatttcaaaatgaacttttagaagcagtcagctcccccctccctttctgaatattgtgaaaaatgtcagaaaaggagagcttgcagtctgaggatgactcatgagtccccgacctctgtactcagggctcagctccgacaccactacctcttgactccctcccctccctgcgattgcaccagcagcccgtgctgtccccggctctcttcaggaccgtgacctcacccagggttcctagtgactgggtcctcctgttctgtttcactgagtagctgaaaactgcctgtatgcttagtttgaagcaggacccagacattcctcatgctgctggtggtggcaggctgtgatgtcacccaaagtctggctctggtacttcctgttcctgttctgtt

SEQ ID NO: 8394 - DNA, 1059 bp, Homo sapiens
cagaggggcctgtgcacaatgccgcccccacgcctgtccttcctccctttattgttcttacttgtcactgagatgctacgcgttcatggagctgctctttcctccccgctagggctggcagctctgcagggaggcaaggctcgctgtgctccctccactgccgtgttgccagcagcttagtggagggcctggcgcatggaggcatttagcagatacttgattttcagtgtaaaagaatttttgatctctaagtgaaagtgattgacaagattctgatcctgtttttatttctcacagaatgccaattcctgtccagttgatcgaactctatttaagtgcatttgtattcgagctcaatttggtggtaaaatcttaagaaaggtgagtgtggacgctgccgtggaggccccagccgtgcttctatcccggccctgtgggacagagcatgctttccaaagtgggcttgctctcctgaaatgagggttggttaaatgcttcatagaaatcaactcaagtgccccttgtggccatgagccctgtctggggggtttggggtctgggttgggggttagaggcagagatattgccagctcctgggatatcccttcgaccccacccctgtacccatcacatctgggagcagtgctctggcccgtctgctcggagctctttatttttgagacaccatcttgctctttcacccaggctggagtgcagtagcacaatcacagcttactacagcctcaatctcctgggctcaagcaatcctcatgcctcagcctcctgagtagctgggtccacaggcatgagctaccacacccggctgtttttttttttttttttcccgagacaagagtctcgctcttttgcccaggctggagtgcagtggcacaatctcggctcactgcaagctctgcctcctgggttcacgccattgtcctgcctcagcctcccgagtagctgggactacaggcacccgccaccacgcccggctaattttttgtatttttagtagagacggggtttcactgtgttagccaggatggtctcgatctcctg

SEQ ID NO: 8395 - DNA, 1049 bp, Homo sapiens
taagatcgcaccagtgcacttcagccttcgtgacagagcaagactccgtctcagaaaaaaatttgggcaggcgtggtggctcacacctgtaatcctagctctttaggaggctgaggcaggaggatcgcttgagcccagaggccagcctgggcaacatgataagccctatctataaaaaaaattagctgggcacggtggtgcctacctgtagttccagctgcttgggaggctgaggcaggagaatcacgtgagcccaggagttggaggctgctgtgagctgagattgtgccactgcactccagcttgggtgacagggcaagatcctgtctcaaaaaaaaaaaaaaaaaattgcaagccggtgcgtgtggtcccgctgtaccggctccttgggctccgtccactgggctggactcacaggaatggggcagggagggcccagcacagagaagcacagacttcaacctcttttccttaggaagacggaagaaagtgccgggaagaaagaaaaccccgtccggaccatccgcaaaaagtaagagctcagcgacaagatctaagaaacgccaacatcgagtgaagaagagaagagggaagaaggtaaaggtgagcattgggtggcagggcctgagtctcctgctggccacagcaccctcgcgtggttacggagcagggcctaagcctcccgctggccttggcaccctcgcgcggttatggagcagggatcatcatcgtctttgcttttctgtatttactcagtgatttgctgatggaaatgaacatttctgtagcacagactgaagatggggttgaggccagctgtttcctgaggcacactgaggggttgaggggtggtcatgtgcccccaaggaaccttcctgaagccatcagctggtcggggagccaggtgtgagccaggccagtgcaagccctctggcagaggcccccaggagcagctgtgggtttcaggcaggcctggccagcctggctctgaggagtgacacaagccgtgtctgacaggccctgtccacctcttctgacccatgttcgct

SEQ ID NO: 8396 - DNA, 1051 bp, Homo sapiens
gctgcggggctctgcctgggtgcgggccctcaggccgtgggaggcagtgacggcagggccttgggtctgtgcccacaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcgggtgagtgccttccctgccacggccccttcctctgtgggctgctggtcctcaggctgttcgcaagcactcagcccatgtctcagtcacggaagatgtagctgaagttggggggaccattcctcagccatttttctgcattgatttcccttcttgagcagtttctcagttagctccgagttcttacccagccccacagcttcatgttcataagaacatgtcctgatggggtactgcccccgcccctggttaatatcgtgtcctgatggcctcaggcactgtactttgtcatccacagagtggctgttgaagcagctctccgggtgtggaaaggcgaggtgtccacctcaacaggcagacaggagtttaaagcgcacgacctcacagaaaaccagttgtgataaaaattaaaccactgacatttaagaagagtgggtgggaaatgattgccattgacttttttgttttttagctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagaga

SEQ ID NO: 8397 - DNA, 1030 bp, Homo sapiens
tcacagacgctcccgtcctcccaaaatccgttctcagactcttccgtcctccaaaaatccattctcagactcttccgtcctcccaaaatccgttctcagactctcccgtcctctcaaaatctgttcacagacgctcccgtcctcccaaaatccgttcacagacgctcccgtcctcccaaaatccgttcacagacgctcccgtcctcccaaaatccgttctcagactctcctgtcctcccagaatgaagctctgtccccatcaaacgccccctcccctcctcagccccggcgccccgtccactttctgtctgtggattcagcgcttccagggactgcgcgcagggggagcctcacgggatttgtcctttggagaccggctggattctcagcgcagcatcctccgccttcgccgccgcggcctggcctgtgtgggaatctccttcccttttgtggggaactgtgtcccgctgtgtgcagggaccgcatcgaccgcgtccgctcatctgtgggcatcttgatggacacctgggctgcctcccctttggggcgacggcgagtaacgctgctgtgaacgtgggtgtgcaaacggcgcttcccgatcccgttttcaagcgttcttggtgtatagttatgagggaattgctgggtgacagagtaattatgtgttaaatattctgaggaaacgccaaactgtcttcccagcagcgcagcagggacacggttcttgtcctcgccaacacttgctactttgtggctttttgtttgtcgcgtactaacgatgccggtgggtgcgacgtggtgtctcgctgcggttttgattggcatctccctaatggccagcgatgtggagcatgttctcaagtgtctgtgagccatttatacatcatggagtggacggagaaatggccgtcaagccctttgatgttctgctgtggttgcgagtcatgcactgtatccgtctgttaaatcagccacaatattttccccagcgtttgcatcatttcacagccccgccagcaatgtggggctg

SEQ ID NO: 8398 - DNA, 1049 bp, Homo sapiens
ctccgcgcgcccgggcggtcgcaggtcgcgcctgctttggccccggcgggttcggcatccgagcctggcaggggccaataggtagggtcgcgagggtcctccccggccgcatgcgcagtctgagcgcgcgcggggtagggctcttggcctggggtgggggcgcgggcatcagcagagccaggcggcggtgtcggggcgcgaaggtgcccgtggtgttccggtggccacacccgaggagcaggggagaccggggggctgcggggtcagaagctccgggtgtccccggagactaggagggggacggcggggtccaggaggcggggtgggctccgccggcccaggacgggggcgtcgcggggaggcctgcagggttgtggggcgtcgggctgagctcctgggaggacggagtgtcacttcctgagatggggacacctcgggcgtgctggctttggtgaggagaattgaagcagtttttctttttttttttttttttttgagacagggcctctggagtgcagtggcgtgatctcggctcactacagcgtctgcctaccgtgttcaagcgatcctcccacctcagcctgttgagcaaccgggaccccaggtgcacactccaccacgcccagctaatttttttgtgttttgggtagagagggggtctcactgtgttgtccaagctggtctcgaactcctgatctaaagcgatctgcctgccttggcctcccaaagtgcgaggactacaggcgtgagccaccgcgcctggcctgaagcagtttttccttagactgtagttggagggggtgagaccacgtggagtggttggcagacaggcaggcaccctttgaggccaaaagggcgcttgagacagagccagcaggcgagcgggccgcccaggtccctggccccctgctgccagtatgaaggtcccaccaagcctctgctccaaccaggggaaccgtcatggttgggaacagccaaggtgaggaattctgtgggtcacaccccctgaaaaccactggcctccgccgggcgcggtggctcacgcttgt

SEQ ID NO: 8399 - DNA, 1022 bp, Homo sapiens
cctgccttcagaacttgcacgtgctggaatccaaggatgggtgggagaggggccgttcctggagatgtctgcccttcggggctggcccatgccacaggacctcccatcacccctgctgccttggttggtgaattcggggcatgctgagcctttcccttgcagcctttgcacttgctactcttccctccgcttatcaaactcctaaccatccctcgaagtccatgggcaccagaagcaccgcctcagagactcacagactcagatgtacagatgtccctcagtatccatgcggaattgattccaggacccctgcagatgctcaagtccctgctataaaatagtgtagtgtttggccaggcatggtggctcacgcctgtaatcccagcactttgggaggccaaggcgggtggatcacctgaggtcaggagtttgagaccagcctggccaacatggtgaaaccccatctctactaaaaatacaaaaattagctgggcgtggtggtgggaacctgtaatcccagctactcagtaggctgagggaggtgaattacttgaacccaggaagcggaggttgcagttatccaagattgcgccactgcactccagcctgggcgacagagcaagacttggtctcaaaaaaaaaagggcggggggctgtgcgcagtggctcacacctgtaatcccaacagtttgggaggctgaggcggggggatcacgaggtcaggagttcgaaaccagcctgaaaccccgtctctactaaaaatacaaaaaattagccgggcatggtggcgtgcctgtaatcccagctacttaggaggctgaggcaggagaatcgcttaaacccaggaggcggaggttgcagtgagcagagatcatgccattgcactctagcctgggcgacagagcaagactccatctcaaaaaaaaaaaaatggtgtagtgtttgcatataacctacacgtgtccttctgtgtactttaactcatttctagattacttataatacctaatacaatgtaactg

SEQ ID NO: 8400 - DNA, 1020 bp, Homo sapiens
tcaggagttcgagtcaacctggccaacatggtgaaaccccatctctactaaaaaatacaaaactagccggacgtggtggcgtgcgcctgtaatcccagcactttgggaggctgagacaggagaatcccttgaacccaggaggcagaggttgcagtgagccaagattgcgccacggcactccagcctgggcgacagagcgagactccgtctcaaaaaataaaataaaaaggaagggaagttgaatagactacagcatgggtggaccctgagtgaaataggccaattgaaaggacagatgttacacgataccatttatctgcaatgctagatttgggagagccattgaggcagaagataggtggtgggtgcccggggttaaggggaggggacggggagtccatgtgtaatggggacagagtctctggagggatgacgcattctggaggtggacggtggtaatggatacgcatgatgctgctgaactgtgcacttcaaaatggttaagacagtagattttgtgtttatacaataaacccagaaaagatgtatgctgcaccacaaacccagaataggttttacggagattttcttggtgtttttgttgttgtttgagacagggtctggctgtgttgcccaggctggagggcagtggcacagtcatagctcactgcagcctcaacctccttggctcagggaatcctcctgcctcagcctcctgagtagctgggaccacaggcgcacaccaccatgcctggctaatttttatttatttatttattgagatggagtctcggtctgtcacccaggctagagtgcagtggcatgatctcagctcactgcaacctccgcctcccaggttcaagcgattctcgtccctcagcttcctgagtagctgggattacaggcgcctgccaccaggcccagctaatttttgtatttttagtagagacagggtttcaccatgttggtcaggctggtctcgaactcctgacctcgtgattcgcccgccttggccttcca

SEQ ID NO: 8401 - DNA, 2666 bp, Homo sapiens
tgatccggccacatgctggagggttcggggagaggctcgtttcagtctagttggcgatttcttggatagagaagtaagccgggcggaggtcgggcgcggtggctcacgcctgtagtcccagtactttgggaggacgaggcaggcggatcacctgaggtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaaagcagggtgggtacgaggcaaaatcgtgattaacaagctttggaagtttaataccagtgagctgcgtaagattgcgttaaaaaaaaaaaaaagcagtcctggcgcatggctcacccggctttgggaggccatggcgagtggattattggagccttgaagttcgagactggtctggaaaacattgcaagacccggtctccacaaaaaaaaaaaaaaaaaaaaatggttggaggcagtggtgcacatctgtagtctcagctactcatgaggctgatgcgggagaatcatttgagccttagaggtcaaggctgcactgagtagtgattgtgccactgcagtctaacagaaccaggcctcgtctctaaaatacaataaaaaattagccaggcttggttgctcatgcctgtagtcccagactgaggtgggatagtcacttgagcccgggaggtcaaggctgcagtgagatcctaccactgcactccagcctgaagtcaaagtcaatttcattgccagtttattttgccagtgttgaagatacctatgagtagtcaacataagtagtgagatgccctgtgtccttttgtcagtcctaagtctaagaaagctagtgtccatttatttttatatcacttcccaagtgaggctggtggctccctttgggcagtgcagttctggaaacttcagggcctattcccatgtggggaacccagtcctgctgtgactctgggagggagagggccggggatacaatcgtacattcctggtaacagccctgtgattgtctgcttcaggttatcagtgagctgaatggaaaaaacattgaagacgtcattgcccagggtgagttgatgtggacgggctttcgtttgttttcatggtccatcctaatccctgccggtccatctgtggcctgccaggtttcgcttgtggaccagagcaccctagaagcctcacccgaggagtgagcagggctccagtgggctcacgtcatgggcacttctagacactctcaggagcagggcagcagggggcaccctgtgttctcagcagacgtttaggtggccctgcctcttaagcctgactgctcctagccctgaggccattccccaggatttgtctgaagcttggtgtctggagaactgagttcacgtcagcagtccttaccacatgctttctgtgagggggttgggggcagggactgagggtgccagggatgtccataggctccttgcctctttgttgggcagatggttttttgttggcttcagctgagctggtggaacttgtttggaagttgagctgttggggcagctgttcttgtcttccatgcatgtgaccacgacagggccagctcagcaaacgggccaagccatgaacacagcgttgtggccagagatgtggatactggggcagcacactcattccctacctagttatgaacatgtctgtccagtggacctctgagggtggaggtggggaaattgggcaggcaggcagtgtgggcctaattcctagaaggcaagtccctggataggaaaggtggggaagagaagtccccgttgaggagtggctcagggagggagtgttcaggaagaacgggagacactggcatatggtgggtccagatatgttgggtgccatgtgccatctctggtgccatctaacttccctgtggaacagcctcccaggctgggcagctgctctggtctcacctctctgctttctgtaggtattggcaagcttgccagtgtacctgctggtggggctgtagccgtctctgctgccccaggctctgcagcccctgctgctggttctgcccctgctgcaggtaagtggtggcctggtgagtgggcaaggggctggggctcagacggtgttgctgcagtggggtcttcatggggggactggcctggcacttgggcagtgctcaccatgcctctcctctgttccacagcagaggagaagaaagatgagaagaaggaggagtctgaagagtcagatgatgacatgggatttggcctttttgattaaattcctgctcccctgcaaataaagcctttttacacatctctcaagtattccatgagcactttgtcaagggtggcctctgcccaggttcttatccaagagggcaggtgtggagctgaagtgtgggcaacatggtattggggaagcgtttctggtgcaaaatgagcatgaggaggggagtctgggcatcacagctgcctggggtcccttcctgtggccttgagcagtatcctagctcctgagtacaccccagaaga

SEQ ID NO: 8402 - DNA, 1060 bp, Homo sapiens
cagtttgagaccagcctgggcaaatagcaagaccccatctctaaaaaacaacctaacaaggcgtggtgtgcacctgtagtcccaactatgggaagttgagatggaaggatcacttgcccaggaggttgaagttaacagtgggccgtgatagtgccactgcactccatcctgagcagcagaaaccctgtcttgaaaaaaaaggacagcagagaagctgatttcaatggagtttgggtaatcagggctctgtctttggggtggcttggtgcctggacttgcaaggacaggattggtagcccctgggctctacaaatggatgcaggaagtgagcccagcttgggggtggcagacgcccctgggtttccctgcaggggtcatggctccgccataatgccctgagcaacttgggcaatcactcctcaggcttgtttttttgccgatcacagcccacccctgccttactgggcagatgtgctcagggcttgtgggaagtgaccacagggccatgtgctcactgaactaggtcctttggggatgggcctgccctcccccgacaggctctgtcctggaatacagggctaaggacagaggccatcaccctcccctcccagcctctctgccctcctggccttactccgtacgcagtctcccaggcctcagggtctttgcccgccaacgtaggcacccagaagatggtctgccactcccaccctaggcttggggtcagcaacccacccgctggctttggtgtggggagcacctgctgtgtgaccaccttagttctgggaggataaataggctatagcacagaagacagttggggtggctgggggaggcctccctcagatgggaaggcaagacctggaggaaggcagagtccctggaggggaaggaatgtggattgttggagccagggagccacagaaagtactgagatggagggggacccaagatgctttttatttattttgttttttttctttttgagatggacttttgctcttgttacccaggctggagtgcaagtggcacactctccactcactgcaacctgcgcctc

SEQ ID NO: 8403 - DNA, 1035 bp, Homo sapiens
aaagtgctggcattataggcatgagacaccgcacctggactcctttcctctactttctttgggttaatttgctagtctctttttattatttatttatttattttgagatggagtctcactctgtcgcccaggctggagtgcagtggcaccatctcggctcactgcaagcttcgcctcccgggttcacgccattctcctgcctcagcctcccaagtagctgggactacaggcgcccgccaccacgcccggctaattttttgtatttctagtacagacggggtttcaccgtgttagccaggatggtcttgatctcctgaccttgtgatctgcctgccttggccccccaaagtgctgggattacaggcgtgagccaccgcgcctggccctgtgtcccctcctatccgtctcccagtcaggggcccggtgctgtggccccgctgacccctcccctgcctcctcagccccaggatgggtgagttcaacgagaagaagacaacatgtggcaccgtttgcctcaagtacctgctgtttacctacaattgctgcttctgggtgaggaggggtcgccttgcccccacccccacccccacccctcccgggccaccatcagacctgggcagatgcgatgacctttgtgtactgcttgtagctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctggggggggggtcacggtccttccacacctgcctagtcctgtgggtccccacgttcctgctggaccagctgagggaagacaccagctccgcaagaaag

SEQ ID NO: 8404 - DNA, 1051 bp, Homo sapiens
cgggaggctgaggcaggagaatcgcttgaacctaggaggcagaggttgctgtgagccgagatcgtgccagtgcactacagcctgggcgacagagtgagactctgtctcagaaaaaaaaactaaaaaaaaaacaaggtaccgagttattttataccaggtctttgaagtctggtgtgtgtgtcacacttaagagtgagtctcactttgtactggctgtttcacttgctcactgaccgcatgtggcatgaggctgctgtgtgagcactgctgatttagagcaacccttctgttgaaaacagttgatcaattgattgatctattgatttactgagacaagatcttgctctgttgaccaggctgcccagtgcaatcacagctcaccgcagcctcaaccccccgggctcaagccatccttccaccttggcctcccaagtaactgggaccacaggcgcgcaccaccacgcctggctaacatttaaaaaaagttttgtagagatggggtcttgccatgttacctaggctggtttcaaacttatgggctcaagagatcggtctgccttgacctcccaaagtgctgggattataggcatgagccactgcacctggcccctaggagtgtgggtccactcgtgggtggaggtgggaggctgttaaacaaccgaagtgcatagagtggcccccacaacagaggcgtcagccaggatgtcagtggtgccagggctgaggagccttgtctagagggatgatagtcaaagactggagacccccttccactgtgaactgaaggcctcaccagagggaatacccgtagggcagagtgaactgtcagtgagccagtcctcttccagacttgccgctgggtgtcttgacatgggggtgctctacacaacctcaaaatgttgggaaggttacaaccagggaaagaatcgatatccaacaaaaatacctttcaacaatgaagctaccctgtttgagtggggcatcacgaaccatcctgcttcaagggagcctgtgggtctgactgcagcttcagctctgacctggagttctg

SEQ ID NO: 8405 - DNA, 1029 bp, Homo sapiens
gtatttttactagagatggtgtttctccatgttgaggctggtctcgaactcctgacctcaggtgatccacctgcctcggcctcccaaagttctgggattacaggcgtgagccaccgtgccgggcccagaatggccctttttttaagggttggttttatattttggaattttatattctgccaattacatgttttgaacctgccctgccatgatcccttgtgaggggctcagacaaactgcgatgaggcagagaaacagaagccctaggggccgtcgcgtgtgggccttgttttcatgaccagctgatttgccctagaatggctatgaagtggcagataatttagactgtgttcatatgcctaaattaaactgatttcaaagacaagcttgatggttgaaggcagggtttgcaagttccatcacagcagggccctctgtgggattttggctggtcggagtgaggccctgtgagggccagctgggctgcacctgcccagggttgtcgtgggagggtagaactcttgttgccagatgttctggtgcctgtttttaaaagggaaataaaaaacttggactctcatgagtaccatgagtttagaaaggttattcatgctcagcagcgtctgcactgcacctgcctgggcccggccacccctctcctggaggcttgtccgtgctgcctgctgtactgctgcactgccctctgctctcccctctcccctgcctctgcccgcctggaataaaacctcttccccaccttttctgtaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcgtgagtatcgctgcaggtggagacggcagaggatggcgtgggcctggcaggactgaggcccggtgcccgtgtagggccgctgcttccttctctgcccacagctgacgtgagccacgtg

SEQ ID NO: 8406 - DNA, 1041 bp, Homo sapiens
tccctgttcccatggtgtgagtgagcacccaacaccatgtgggtggaggaggggcacccagtggccccgtgtcccccactggggaagcgtggctggtgcttcgtggacccaccatctggcgtgcacgctaaagcctgccattcagcttcctgttctgagtttgatgcagatggacctgcagcacacattcttttgttttgctcaacatggtaaaatttttgttttgtgtgcagctgttatacattcatgtttgatgcttcatagaattggttgtgtgaattgtccgctgcagtttacctgctgtcctgttgaacacttagctccttgccctctgaggctgctgtgaatcctccagcatgagcagtcttggatgtcccttggtttccatgtgcacgagatggctcagctggggccgcggctcctgaacctgaggagactggcgttgccagaccagcttcccctgccgtgcacacggctctcacagcggcagcaggaggcgcgggcgcggcacgcgtagtgctagtctcttgggttttagtcatctgggtgtatagtgggagctctgtgatttattttttatttttttcttttgagacagagtctcactttgtcgcccaggctagagtgcagtggtgcagtctcagctcactgccacctctgtctcctggattcaagggattctcctgcctcagcctccagagtagctgggattacaggcacccaccaccaagcctggctaatttttgtatttttagcagagatgaggtttcaccatgttggccaggctggtcttgaactcctgacctcaagcaatcttcctgctttggcctcccaaactgctggaattataggcgtgagccaccgcacccggcctctttgagatttaaatctacattttccagattatcaatgaggttgagcaactttgcatgttgattggctgtttgggtgtcttgttttgtgaagtgcctgagtcttttacccatttttaccctgggttgtccgttttttgtgttgaatatttcaccattaagtatgatg

SEQ ID NO: 8407 - DNA, 1027 bp, Homo sapiens
gctcaccataatctctgcctcccaggttcaagcggttctcctgcctcagcctcccgagtagctgggattaacaggcgcccgccagcacgcctggctaattttgtatttttagtagagatggggtttttccatgttggtcaggctggtctcgaactcctgacctcaggtgatctgcccaccttggcctcccaaagtgctgggattacaggtgtgagcccctgcgcctggctgtgaaactttctaattatgaattcaatttattttataagttgtggaactgtgcatattttctttttctttttttttttttttttttttgagtcggagtcgcactctgttgcccaggttggagtgcaatggcacgatctcggtttaccacaacctctgcttgtgttcaagcgattctcctacctcagcctcccgagtagctgggactacaggccgtcgccaccacgcccagttaatttttgtatatttttgatggagatggggtttcaccacaatggccaggctggttgcgaactcccgacctcaagtgattgattgcacctgccttggcctcccacagtgctggcattataggcatgagacaccgcacctggactcctttcctctactttctttgggttaatttgctagtctctttttattatttatttatttatttatttatttattttgagatggagtctcactctgtcgcccaggctggagtgcagtggcacgatcttggctcactacaagctccgcctcctgggttcacgccattctcctgcctcagcctctcgagtagctgggactacaggcgcccgccaccatgcctggctaattttttgtattttttagtagagatggggtttcactgtgttagccaggatggtctcgatctcctgaccttgtgatccgcccgccttggcctctcaaagtgctgggattacaggcgggagccaccgcacctggcctagtctctttttaaacgcttgagatgaatttttgttgcttttctctttatatttgtttcaaatat

SEQ ID NO: 8408 - DNA, 1021 bp, Homo sapiens
cgaggtatggcccgcaggatggcaggaaggatggggtggagggcagttgcagaaggtgagcagtgagtggttccagcctgcctgcgtggaggtgccgagggccgttgctgacccctcttgcccctcagctcttccctgaggctctagctcctccactgttggtgccccttgctgagtcccagtttcttctcaccctaactctcaaacttctggctctctgggggccacctgagaaagccggcctctgtgtgtgtgagagcatgctggggcatgccgtggtggggcctgccctgtccgtcggagagggttaggccaccggcaaggggtgtgccatgaggacgctggcagaacctccccagccagagcctgttgtggatgctgcagctccctccagggcaggtcagcgtgtggcagccttgggttccttgctgctgacacaggtactgagggtgctgaggaaggcagggatgggcacttggactggggtctccaggaagctgaggggctggtgctggtgtagggtgcaccgcgccaggacgtgcccgcctcgccttaactctggcacctggctgccaccccggctcattgtttgtgcttcgcaggctcttcaggctcccgcgtgccacgagaacctggtcaaagtgggcggctacatcctgggggagtttggaaacttgatagctggagacccgagatccaggtgagaggccctttgcgagtcggggctgtgtgcgctccggcgggcctctcggtggtcggtggcaagaggcgaggcaccagctggccctgccgtgaggcctcgcagagccgcttctgctccccatcggcgtctttttgttttccttcagttgatagaaaaagcagggattctagtagaaaatggagacgtggggttgatggctgacttagtgaaaggggcgtctttgcggtgggatctggagctggaagagggtcccgaccagcggcctctggtgcaggccagggggtctcgccgccgtcccccccccgcgggggcgtgctg

SEQ ID NO: 8409 - DNA, 1063 bp, Homo sapiens
cctgctgcgcttggagccgaacctgcaagcccaggtcaggccctcaggaaatggtggaacacacttgagttgctttttattctggcacaatgtacgtggtgagatgtgtagctctttagtgcagttcagtcagttttgacagatgttgtttaaccaccaccctgtcaatacatggttgcctcccagcctccccgcagctggccaccgtggagcatcatccctagtgcagttcagtcagttgtgacagatgttgtgtgcctgtttaaccaccaccctgtcaatacatggttgcatcccagcctccccacagctggccaccgtggagcatcgtcccaccatggagcagcctggccctgggcggtggctctcccagctgttcctctctgtcaccgcgttgttccttctcaccacgtcccgttctggcgacggacacctgtctccgtttcacttgggtggcacccaggagtgctgctgtcgcccagggcctgtgtgtggttagtgctgcaagaacatcccacagcttctccaggtggccgtgccactttgcactcccgccagctacgtacgagacgccaggcgctcccatgccagccctcagttttcatgctgacagtgtgtgtggtgctcaggcctctgccgagttgtgggtgcctccagagagtggtccctgggcatggcccacagggttctgcatggcggatcctggacccgagggctgtgtgagcctcggcgtgcccgttgacctgctgtgctctctgtttcagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaagg

SEQ ID NO: 8410 - DNA, 1048 bp, Homo sapiens
gtgcacggggacctttgcaatggccagggcctggggccacccgagctagggcaaggggagggggagggatgtgtttataaaatttctgttttaatttcaagtacagtaatgttggtggatagaaacacacaaaccacagcactttgattttgtcagtaactcttaagagtacggagggtcctgaggctggggggtctcgtgggcacagagtatgatgcctgtgaggacgtccttccagccacacagcccgtggactgcagcattgagtgttctatttcctgggtgtcacgtccgcaaaatccgctgttttgcagggtcagtcttcgagaaatgctcttgtaagaacaggtttttaggctcatgtgcccccttcccagtgcccgtcacctctccctgaggctgtggcctgggctcacctccctcggaccgaagggcttcccacacgtctgtgtccaacacgttcccccggctttcatttaactaccggcggttgtatttagcctcagttttggaggatacttttgctgaatgtagaattctgggtttcctttgagtgcttagcaggtgctacaccatggtcctctgctggtgagaggcagccaccactgaggccctgggtatgatgtgtgtctctggctgcttttgaggttttctttttatccttcggttttgtgtgtttcgcagtgacccaccttggtgtgttcctccaggtgtctgtcctgcttgaggttcagtgagccccgtggatccacgggctgatgtatttagtacatttggggaaattcttcattgttctctcttaaaatgtggcttcttcagccaggcgcggtggctcatgcctgtaatcccaacactttgggaggtcaaggagggcggatcacgaggtcaggcgttcgagaccagcctggccaacatggtgaaaccccatctctactaaaaatacaaaaattagccaggtgtagtggcaggcacctgtaatcccagccactcgggaggctgaggcaggagaattgcttgagcctgggaggtggagtttgcggtgagctga

SEQ ID NO: 8411 - DNA, 1045 bp, Homo sapiens
tgctgtgctagcaggcggggcttcagtgttcccagctagaatggagaggagttccctgcctcagagcacccctctcctaccagggcacagcttggcagaggggagctgcaccttcctcttccactggggcctggcctccgtcggctccatccggtggtgtctggtcaccatggagaccaggcaggccccctgggtggagggtttctgggctgtgacccacctctcagtggggagggggcggccccggctgctgggaagcctgaccctgggtgtagaggaagaggctggggctcccagctgctccgggtcccacccacagtgggacctgggctggcagcgtgcgaccctcccagcactggggccagtcgagccccctcctctcccttcctctccattcgctccttggcatgcagggctgcgggtggggcaggacccggggacgaggccagtgggagtggccaagagaggggaggcttgtggaaggtgctaagggttggggactgtgacatgttgggcaccccccagctgctggggtgtggaggaattaaccagactaaactggggaggcctggggaccctatggggaggtgggggtggggttaagggctgctgagggctgcctggatggggctggcagggtcccaccctgccttggaggagaaacagaggccctgggagtgatggggccaggacagcgcctggcagagagatccagtgcggggcgtagctggggagagtcccatgctgaatttgggaggtgcctgtgagccccgactaaaggagggcctggggatgcgggaaaggggaggtgtccctgtcacctgcaggcgctgtgcacagatgtccgcctgggagggaaggacttggggacaggctggccaactcgccagggctgggaccccatcacaagactggccctagctccaaagcctggtccacgctggctcctgagggctgggaccccaggccgtggcctcactggccccaccactgacacggccacttctttgtgctgggcggagcaccagctgcccgtggccaggct

SEQ ID NO: 8412 - DNA, 1027 bp, Homo sapiens
ggacctgcccccccggaacgagataggtatgggtccaggggtggcctccagcccggcctgcactgccccaccggggtccgggggctgtctggcctgaccttcgtctgtactcagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtgtgtgtgccccgaggctgctgggcctccctccctgggccctggctgcgcggcactgccgcctggctcatcgctacccattggcctggggtctcggctgaggccattgggtggggctgtatgggctaaactgggcttagctgggctgggctgggctgggcttggctgggctgggctgggcttagctgggctgggctgggctgggagctgagctgggctgggctgtgctggactggactgggctaggctgagctgggctggcctgggctgggctgggctagtttgggctgggctagactgcacttggttgagccgagctgggctgtactggactgcgcggctgagcagggttgagttgaattagggtgggcggggctgggctgagctgggctgagctgggctaggctgcactagaatgggctgagacggatttgactgggctgagctgggcagggctgggctgagctgggcagggctgggctgggctaaactggatttggctgagccgagccaggctgggcagggctgagctgggctgggctggcttgacccaagcttggctgggctgagctgtgatatggtcacaccatgctcagagccatcagcccagcaagcctgtccccctggtcccagcaatgctgggcccgtctctgggtggcaagtgtggtgtgtgtggccagggacatcacagaactcagcagtgatgagcagacccgtggccggaggaagggcacccagcccctctggagcctctgctgggtg

SEQ ID NO: 8413 - DNA, 1089 bp, Homo sapiens
cttgggagagcctagggttggctggaggcgagcagggggtacactgggcagagtctccccagggcctgagctcgccaagggcagagaccgggtcgctcaggtctcaaggagaaagcagcccgtgttaagaacaaaggggcagcaggcctggtgggaacacgtgtgcaggggcggagcggagcagccaagccgaggtctggccccgccgcctttctgagccgtgagaggtgccactgcagagactctacagcgcccaggtgctgagatgccctgggggccgctgtgactggtgtctggacaaagatgtccccagagagaccccttcccagcgcccaggccctctccctcctctccacgatggcctcagtcactgggcagtgtctcggagaccaggcgactggcggtgtacacatatgagcctgcagcgtgaccccaggccaggcagcggcagagagcggcggtcaggctggagtcacttcacaggagaccccgggaaatgaagatgtggccagctgtggactgagtaagacgagaaccttcgtcctgctgctggctttaaaccaggggcccctgtggaaactgctcagtgctaagccccaggagcagcatctgcagcctgtgccaggattccacccagtggcctttctgcgccgatcaggtggcccttccagctgggtgcccaggtcggaggtgtgtaggtattgtcgcaagcccagatgcacagggctcagcagacttgggaaccttccgcctaggccctgacattgccgtttctgctgctaccaaaagctttcatgaacagactcataattatcttcctcagagaaggtggaaaacatcaaagccgagaaggtggctttgatgccactgtggctgcctgcgcttctcccctcccccatcttgagatggcctggaggccctgacccctctcaagggtccggcacggatgcctcccacagccccacccaagggcccggcacagacaccccttcccaagggtccagcacagatgcctcctacagctccacccaagggcccggcacagatgcctgcgacagccgttcccgagggtccagcacagacacctcc

SEQ ID NO: 8414 - DNA, 1050 bp, Homo sapiens
agccccagctgctgccagccccatgtcaaccaggcaccccagaggaacagcaccaagggaggcagctggcttcaggaagggatgcatgcggttgtctgggacactcagggctgatgtccttgagtctgaagtgctagctggaagcccaggcagtttccaggttgcagcctcgaggggcgttctttccccaggaagaccgaacctggcggatgcacccaccctgtgaggaagggtcccccgccagactcaacaggcgactgatttaagttcgtctcatctaaaaatagcttcatagcaacacccagactagtgtccggccaggctgtgcactgcccaccacgtgggtgctggagtcacagtgcaggcccctcacccctcgtcggcctggcctccctgggccgtcaggcatctttcacacatgggactatttttgccaaatgctgcacccctgggccgcaaagcagagagtcacgtttgtaccatctgtcctgtctcttcatcgggcagaacatcgaccatgtagaaactcacctgtgcttccagaactgccaggctgctttgtgcacttcctggctccaggccctggcatggggctggggtaaggtcagggccagtggtggccctcggagttttgaacccagaacagacagccgccgagaccggcaggacactgaggaggcgtcgaggggctgagtgagggttggacctggtccccgtgcttgtccggcaggactcccaggccgcacagtggccgaggaggcagctccaggaatgggcaagggaaaggggagttgtgaggccgctgggaggggcctcagaatcagtcgggagagggcaccactgagccccagccctgctggcccctcctcccggtccctgcctctgcctctcagcacacctggttccacctccaggcagcaacggcaggggacgccagcagagcgtgccacctctgaacagccacccaggcgcgctctgcctgagtctcgggctgtgctagaggcgcctctggccatggtcctctcacggctgggcttcctggcccccgcg

SEQ ID NO: 8415 - DNA, 1082 bp, Homo sapiens
gctgctgagtggcacagtgaggatgcaggccacggccagggcagagttgtcagcccaggggaggggctaggcccacccagggcaccggccatatccaggctcaggctcaggctgctggaggtccggctgctgcccaggtggctccgccttgttccctgcctccgcagccccgcctcactccaggccctgcccctgcactgccccttataagccccgccccctctggctctggcccccccagtattccccacccatgcctctggggccctacccactcctggctccaccccctccccatcgaggctgtgggcgtccagccagaaggcccaggacagcctttcactcactccctccctcctctctccattctgtactccagacaccactaactgtatggaaatgatgacggggcggctttccaaatgtggtaagaatcccccacgctcacctggcacctccacctgccacttcaccgctcaccctcagcccgctgtggccgccacctgccgcccgggttgtcccggcctccctgtgtagatgtaggcacccagcagcccagatgtccccggccccatcctctaccaggagcagcccaggtcgctcccctaccacagcaagcccaggcggggttcctggccagactcacctctgccaggccctaggatcagggcaggcccaagaaggggctcccaaggcctgaagccagtgagggtcccgctggtcccactggtgcaggctgtggcctaggggaggggccggtgcccatccctctgtccactggaggctgtgcctggcagggagcggaggggcccacagctcagggctcaggtgggggttaggcttaggaagtgggattgaggggcctccatcgacacacctgggcagtgagcacagggccccaagaagggtgggctccccatttccgcccctcttctcaggactgcccccatcccagggacccgggacatgactctagctgcttgcccccagccccccagcctgcctcccacatccacccctccatgcttgtccacccatctgttcatctgtctgtctgctgctaaactgtgtccaagctggcc

SEQ ID NO: 8416 - DNA, 1073 bp, Homo sapiens
tgtatctagggactgtgggagtctatatctaaggaccgtggggtctatatctagggaccgtgggggtccatatctcaggaccgtggggatctgtatctcaggaccgtgggggtctgtatctcgggaccgtgggagtctatatctagggactgtgggagtctatatctaaggaccgtggcgtccatatctagggaccatgggggtccatatgtcgggaccgtggggggtctatatctcgggaccgtgggggtccatatctaaggaccatatgtcgggaccgtggggttctgtatctcaggaccgtgggggtctgtatctagggaccgtagggatctgtgtctagggaccgtgggggtctatatctagggactgtgggagtctatatctaaggactgtggcggtctgtatctcgggaccgtgggggtctatatctcaggaccgtggggctccatatctcaggaccatgggggtctgtatctaaggaccgtggaggtctatatctcgggaccgtgggggtctccatctaaggactgtgggggtctagctgctctcttccaacagtgagcacgtggcctccctctctagtgcagacagggagaggagctgaacatttcgtctacccgctcagttagggattgggccacttcagtcaatcgtccctctgtgtggctttcctggagttttggttaagagcctggccagtccgtgtcttcttatccctgacaggctgtcagagagtcacttctttccctgaggtacaggcttagctctttagttgtctgctcaggcagcttcaaaatttggaaaatgtcttaagggccagattaacctgtgcctggggcaggaccccttcctctagaaaagctctgtgtactaagctccacaaggctatgcgagacttcagcgcacctgcggaggcctcaggcctcacttcttagcctccccagaaatttgcaaatgtcccagttttctgctccagcccctgtggttgccaagagccctgctgggtatttctcccagtagaattcctcttccccagtgggaccgaggctcagctcatacccagcactggt

SEQ ID NO: 8417 - DNA, 1030 bp, Homo sapiens
cttggtctgacgtggctcatgggaaactgaggcacagggtgacttgtcagggtcacacggtgcttacgtgccagagcagggattggaattcaactgggctggcccggggtccattctgagccctgactcctgccgtcagcccccgaggtgggactgcagtggctgaggctggggagcaaagcgctgtctgttccataagcccctgtcgtgtgccctggctggtgccacgtccgctcctttgttgagaacctgctggcctctgttgggagaagggaggagcctgggagcctgctgtgctggctcgtttgattacagtgcccatttccctgagaaatcgcctttttgagtttttaaaaacatatttacatttttaagagagcagaggttcgttttagtggcattgacctctgaggatgtaattttttaaagttctgatttttttaaagttctgatttttttttcactcccttccggcaggctctaacaagagaagagatcacagaaacgtgaggatcaagaagccggactacaaggtcgcctacgtgcagctggtgcgtgtgagctggccagccccagcggggcctccgaggggctcctcgcaactgtgtccttggggatgtttgtgccggagacgctgcgctggggcccagggagcccccgtgaggccggatctcagggcctcagcgcagaggcaggctccacataaggtcatgctccgtcacggccttgggggtgttagtggtggcgctgggagcacgtgagcactggggcacatggggcacgtctcagcgtccggccgttttgtgattttgaagtttgaattctctgtgggcaaaggcagccatcacaggcctagtgggtttcaactccaacgcacaccagggtgtcagagcatgggaggccccggcctctggagagcctgtccttggctgggtttcagcctcggaggcagagtgtgaggcccctgagggcaaaggtctttggtgccaaggcaggtctggctggccgggctgttggctgaggcccatgt

SEQ ID NO: 8418 - DNA, 1031 bp, Homo sapiens
acctcctttggggagccctcccagattgtccaaggtgcttgagggagggaggaatgggttgttctcccggcaccggggctgcactcctgggcagacgctgcatgcctgtcctcaggcgcggccctgctgccacccccttgggggctcggagcgcgacagcagcttggggacgcctcccgcgcccagcacggtgcacctgggccctgaggtcctggccgaaacgcgccaagttgggggtaggtgcagcgaccccatacccctcggctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaa

SEQ ID NO: 8419 - DNA, 3302 bp, Homo sapiens
gaggcagatcccatggctcccccttccgtggggagcaggaacaagggggtggggaagatcagtcaggggtcatgctgctgcacacgcctccctgggggctgcagacatcctggactcaccagcctgtgaccccaaaccacacgccccgccccatccaccccgtcctgtggagcctggtgccgcgtggggacatcctgggctttgacggctcctccctgcgctgagttttagcctctgtgccccagggctccacacaagccgctcactcctggtcaggtcgtgggctggtggctcccactagcccctcacagacacgcctgctgggcacctgggtgtgtgtccttgggccccgcctacagcctgccctctttcctccctctggccactgcccggctccagttcttcacctgcctggtcatcctgtttgcctgtgaggtggccgccggcatctggggctttgtcaacaaggaccaggtgagcctgggtgtgcagggacagggtggggtgggtgacgggggcaccctcctctcctgtcgcgggtgggggttgggctgactcatggcttgtgggagctctttgggctcttcctgggtcccacttgccaggaggatctccaggggctttatggaggaggcagcattggggctgagcaccaggccagcctcccgtgtcccagcactcccggggcagctgagagtgcagagtccttgtcctctggggtctagcctcgaagccaccctgcccagggagagcctgggaaaagtgcgtccgcctggggcggggcggggtgggggcaaggagggggaggttccccctgtgcatgtgaccgcacccctcccccagatcgccaaggatgtgaagcagttctatgaccaggccctacagcaggccgtggtggatgatgacgccaacaacgccaaggctgtggtgaagaccttccacgagacggtgcggccccggggggcgagggcggggagcagggccccgggaacccggcggggtgtgtctcgtcctggatgaatcctgcctacgcccagacctcaggagcaggaggtgcccttgggacctccaggacccctggtctcaactggtcctcgggtgggaacctagtgggccagggtggcccagggtgcggaaagctctgagcagcgcagctgaggaggaagaaggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccagtggtgtctgagacctaggggttggccggagggcaggggaatctgacatcggtggggcttggctctgtggactctgtggggtccagggtgagggtgggtgggtcgggatccctggtgttcaccaaaggagtcactctgtaaaatttggggagttatttattctgagccaaatatgagcaccggtggcctgtgacacagccccaggtcctgagaacttgtgcccaaggcggtctggctacttaattgtatacattttagggacataggacattgatcattacatctaagatgtacgttggtttagtcggaaaggtgggacgatttgaaggggagggactttcaggtcataggcggattaaaagatgttctgattaataattggttgattttatctaaagacctgaaatcaatagaatggactatctgggttaagaggagttgtggagacca

SEQ ID NO: 8420 - DNA, 1013 bp, Homo sapiens
gacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttag

SEQ ID NO: 8421 - DNA, 1064 bp, Homo sapiens
ttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaac

SEQ ID NO: 8422 - DNA, 1012 bp, Homo sapiens
gaggctttcctctttgactaatccacctcagcgcagacgctttatgggtgtcaggctgggggacagtcaggtctttctcatcccacgaggccatatttcagactatcacatagggagaaaccttggacaatacactgctttcaagggcagggctccctgcggctttccacggtgcattgtgcccctggtttattgtgactagagaatggcaatgacttttaccaagtatactgcttgtaaacatttggttaacaaggcacgtcctgcacagccctagatcccttaaaccttgattttatacaacacatgtttttgtgaactccaagttgggtcaaagtgactgaggcaaagtggctggggcaaagctacaaatgaacaacatctcagcaaagcaattgttagagtacaggtctttttcaaaatggagtctcttatgtcttccctttctacatagacacagtgacagtctgatctctcgcttttccctacatttcccccttttctttttgacaaaaccgccatcgtcatcatggccccttctcgctggtcgctgtctctccggagctgctggatatacctgtagactaacaatagagaggacagacatacaagaattaatacaaaatttgcaatagtggaatttccaatggttttaacccaagtgacagggttaagattagtgaggctgtcaacagcttttaccattgcctccgtttctgacaccagatttaactgggcttttgatgtttcaaaaatttgttctttcaatttagaaatatctaaggtaagattatcttctcttccttgtagatggcgtctaaccatgtcccagtgatgttcagattcattataggctcgaggtttaatacaaaaatctgatgtattccagtcacactgtaactgaaaaagatattctaagctcatgagcctatctctcatccaaataacagtttgtctaagatcattaatttgatttgtcaatttttgatctatttgagtctaagaattccac

SEQ ID NO: 8423 - DNA, 1044 bp, Homo sapiens
aggttgcaatgagccaagattatgccactgtactccagcctgggtgacagagcgagaccctgtctcaaataaataaataaataaagagaattcataaacaccctgcaaggtaggtggtgttatacccattttaccaatgaggaaattggagctcagagaggtgaagtgacttgctcaaggtcacccagctaataaaggcagagctgggatgcagactcagctttgtgcagttcctgagcctctatgctgccccttcacattactcagagtgcatgtctgagcctggtctcaagctatgatatctcaagctatggtatctcaagctatggctttgagaccagcatcttctctcccagagctctacatttagcttcctctgacagtgcagaagggaatccatctccttttttgtggaggctgtgaagccccatggctagtcttgccccaggcctacctgtgggctgccctatgagccgcctgcagcattgctcaccttctcagcagtctggcatctcattgaaagaaaggaatgatggtccttaagaactccacttccgaagactgtccctccatagttagagcaaattcattcccttgctgggttgctgggctctggcactgcgctggccctcgttggaggtctgcagaagtgcacagaaagtgtgggcaatggactggccatttccacagttttggaaacttttaaaaatccatattcttgctgggggtggtggctcacgcctgtaatcccagcactttgggaggccgaggcaggcagatcaccagaggtcaggagttctgagacgagcctgcccaacatggtgaaaccccatctctactaaaaatacaaaattagctgggcgtggcagcaggcgcctgtaatcccagttacttgggaggctgaggcaggagaattgcttgaccgcaggaagcggaggttgcagtgagccaaaattgcgccactgcactccaacctgagcaacacagcgagactccatctcaaaaaaaaaaaaatgcatattctggcttggcgtggtggcttat

SEQ ID NO: 8424 - DNA, 1077 bp, Homo sapiens
ggtcttagtggaggcacagctctgagctatgggtgtagagcatctgaacccatctacacattgaccaaacacaggcaggttccagtctgcgggggagatggagaaggtgccaccatgctgctgcacaaatcccaggatagctggggaatgagaatccagcactttgggcctaggacctggaaggagaggtcttttgggagaggtatggggacatctgaaggaggacttcttggaaggggaggggctggagcagaggcaagagtgattttgtcagatggagagaaggttctccacatgggcggggctggcagaggcagatgcccagacaggtcacaactctctaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcagtgggtgcctggatgagggaggagtggggaagtgttccctgaggggacgggcctgcccctaccacattcggaccttcctacttcgtggtgtgggcactccctgcaatgtggctcccaatcctctttccctccagccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgc

SEQ ID NO: 8425 - DNA, 1056 bp, Homo sapiens
cagtacattggtaaaggtgagattggaggcaatgagcctagataggagactttgcaactgttcatgagcagaagacatcagggtctgcattgtggaggtaaaatcagtaggactcagagtttaaatgtaggaagggaaggaaagaaagaaaagagtcaaagatacaccagtgttttgagtgtgggtcatgaagagactggtggtgccattagcagaaaatatatggcagtcagaaggagggtcagtgctaggggatgattagtggtggggtagctgaacttatttgaagtgctgggcaaggggctacactccacaggacttcaggaaccaaataattctttctatgcttatttcacattgctacattttacaaatgagttttctggggtccaaagaaatgaaatgatttgcctaaagtcatacagtaactccatggtggaatctaagtctgagaacccaagtctctttgctttttagctattaaacttcctaacaaagctgagccttgactctaggaaaatcagagacagtcttggagacagacaaacctgacttcaattccagatcttgccagttttctgtttgtaagatcgtaacaagattgcttttcctctctgagcctcatattcccttttgtccacatttgcaaaaaagggaatattaatttttacctcatggaggcattggaagtaaatatgctttctataatactctttttacttttttttggttttgttctgagacagggtctcattctgtcgcccacactggagtgcagtggcaccatcacagcccactgcagcctccacctcccaggctcaggcgatcctcccatctcggcccaacaagtagctggtactacaggtgtgtaccaccatgcctggctagtttttatattttttgtagagatgggggtctcaccatgttgcccaggctggtctggaactcctgagctcaagcaatccacccacctcagcctcccaaagtgctgggattataggcatcagccactgtgcctggctacatctccgattttctagtgggatatggagtggc

SEQ ID NO: 8426 - DNA, 1048 bp, Homo sapiens
caaaaggaactccctgggattaagcaagcatcttggaattggtatgccttgcttctctacatttcccatggtcttcatgggagggctggctcttgtctttctagcaaggtcacatttacactgtaggtttgttcagaggttgttgttccagaagaagcagctttcagtggagactctggacttagctgatttgcatgggcttttgtagccagccgtcaatcccctatccccaccctgccaaatacctcaataattgttagttatagctttgaaaacgtgtactcagcttgacttctgttccggatcagttgtaaattctcacataaggtagagcagagtgtgtttgcttgggttaatcaggtatttataagttgacctttactagtgaatacctaatttttccctcatgcctaagtaactctagcaggccgagggccttgttctcaggcattcccagaactgttgggagttgcagcaggtttgcctgcccttgtcatatatgcacaagggccagtaggatttatctgtctcccagcaagggtgcccaggacctctccttttatcctatcattctaaagcactgggaataccagtctcctctctctgatcagcattttagacactgatgctttctcttctagttagtttcttgggagaatgagtaagcagggaggaattgtttggctttcaggtaaaaaggacttcttgcttgtgaattgaagtcactaggcgagaagtgagtaaagaacatgttcctggataggagtggtcaagcgttggtaagttagacttggtttggggttaaatgggcctggtgctctctaggagtggaatcagtaagggtcctggctgtgtcctcattgccctccttcgggagctgagcattgctgtaggggagatctcacatatggtctggggagaagggaaaggaggagggttaaggaacgaagagacagagggaagaaaagggaacttttgctgagctgtttctctaggctaggtgctttacaccaataattttctttaatcttcacaacaactttgtgag

SEQ ID NO: 8427 - DNA, 1063 bp, Homo sapiens
tgggtgatggagcaagactctattgcaaaaaaaaagaaaagcatattgtatttaagtgtattttctagtatggcttatctcattatcagctaggtcaactagaggtagtgctttcctgattttgcttctagaaggcattctttgagcagtgggataggaccccatccttaggactttcacctctccaggtattgggccagaagtctaaagctccatgaaatactgtttatgtacaataccagcttgagctctaaacttgtaaaagaatcaactttgatatgacttagggtcccatgggacctaccaggaagtcacaggaactctgagccacagcgaagtccaccactaattagacagttaataataatgctaattgttatgataagaaatgtatgttgaatacttatatgtcaggtacaattacatatttatttaattctcacagcagtcaatgacatagatattgttattattctcattttgtagatgaagaatctaaagtcatgtgtctagtaattggtgcaagtaggacttaaacctaattagaaatttcatgttctaattccaaactctattttttttattgttttaaataaaaaaaattttatttttcatgttttttttttgagacagagtctcgctgtgttgcccaggctggagtgcagtggcacgatctcggctcactgcaacctctgcctcctgggttcaagtgattctcctgcctcagcctcctcagtaactgggactactacaggcacatgccaccatatccggctaatttttagtggagacagggtttcaacatgttggccaggctggtctcaaactcctgacttcaggcgatcttctcacctcagccacccaaagtgctaggattacaggtgtgagccactgtgcaggctcactattgtattttaattatttactttgatatcctcctaccagattttaaattgccagaaggcaggggctgttactcttcatttcattaaaaaaagaagtattgagttatggcttacatacaataaaatgaattaaatgcttgatgaatttttaccaatgt

SEQ ID NO: 8428 - DNA, 1121 bp, Homo sapiens
atgtttgttgaattgtagacaaagaccttgatttcagaaatctcttcttgattttctagcagtggggcagcttgtatctccatggtagggctgtactttgtttttatttattttttatgttttatttatttatttttgttatttagtgtttatttcataatcataaacttaactctgcaatccagctagtcatggaagaaaacagagaaaacatggagcccaaagggaactgcagcaagagcacaaagattcaaggatactgcgagcaaatggggtggaggggtgctctcctgacctacagaaggaatggtctggtggctaagataaaacacaagtcaaacttattaagagttgtccacagtcagcagtggtgatcttcttgctggtcttgccattcctggacccaaagtgctctatggcctccacaatattcatgccttctttcgccttgccaaagaccacatgcttgccatccaaccactcagtcttggcagtgcagatgaaaaactgggaactgtttgtgttgggtccagcatttgccatggacaagatgccaggacctgtatgctttaggatgaagttctcatcatcaaatttctccccgtagatggacttgctgctagtgccattatggtgtgtgaagtcaccaccctgacacataaaccctggaataattctgtgaaagcaggaacccttataaccaaatcctttctctccagtgctcagagcacgaaagttttctgctgtctttggaaccttgtctgcaaatagcttgaaggagacatggcccaagggctcgctgttgacagcaatgtcgaagaacacggtggggttaaccacggctgatagtacggggctcccggcagcagcagcatctgcaaagacttttatgttttatttttaatagagatggggttttgccatgttgcccaggctggtcttgaactcctgagctcaagcaatccacccacttcgtcctcccaaaatgctagggctataatgttgagaggttctttgtggaacaggctgccttttgataagttgtttgtgttcataagggaataaaaatgtcatcccttccagtactctcccaattttgttggtgcaaggtcttcagaata

SEQ ID NO: 8429 - DNA, 1041 bp, Homo sapiens
gttgtttgtgcttttgtgttgtatctaaaaaagtttgaccagcatggtggctcacatgtgtaatcccagaactttgggaggctgaggtgggcagatcacttcaggtcaggagtttgggaccagcctggccaacatggcaaaactctgtctctactaaaaatacaaaaagaattagccaggtttcgtgctgcatgcctgtaatcccagctacttgggagctgaggcaggagagtcactttaacccaggaagcagaggttgcagtgagctgagattgtgccactgcactccagcctgggcccacagggtgatacatctcaaaataaataagtaaataaataagattaaaaaataaaaaatctgttttcaaagccaaggttatgaagatttactcctcagttttatgggtttgctcctatgttttacctcaaagagttttatggtttagcacttatatttaggtcattgatccactttgagttaacttttgggtgtagtgtgaatttcttgaactttaaacccttgaatgtgtgccaatccagtcagtaatgtttttttttttttaattgagacagagtctcgctttgttgcccaggctggagtgcagtggcgtgatcttggctcactgccaacctctgccacctgggttcaagcgattctcctgtctcagcctcctgagtagctaggactacaagcatgtgccaccacacccaatttttttttttttttttttgacgaagtctcactcttgtcccccagggtggagtgtaaatggggtgatctcggctcactgcaacctctgcctcctgggttcaagtgattctcctgcctcagcctcccgagtagctgggattacaggtgcctgccaccacacccagctaatttttgtatttttagtagagatggggtttcactgtgttgaccaggctggtctggaactcttgacctcaggtgatctgcctgcctcagcctcccaaagtgctgggattacaggtgtgagccactgcgcccggccatttttttgtatttttagtagagacggg

SEQ ID NO: 8430 - DNA, 1052 bp, Homo sapiens
cagtaatgatttttaaatctttaaatcccaatagctatggaaaggtggtttggcaatgttttagtggctgttggctgaagcttctttcaataggggcattttagaagacatttcctcctcctcggatctgatccactgatgtgcatttgataggtttaggggcaactttgagagtaaggccagtgactttcagggatgccagtcagttgagtgacacacccttatgtacgcgtagtgagatgctctgctattggcttgtctgtatctcagcctgtgaggagcagggtgaggcctaattgaaacaaggcacagctggcaggggtgaggggaacaatgtagtcaggtagcaagtctgtactgagcccaggcaggttcccagccctgggtatggcttcctgagaactgtgcaaaaacagtaatgattagtgagaagatcatatggagacagaggccttgatttcaagttggatgacttaagactcgtcacttctctctgaaccttaatgtctttgattacaaaaggtgaatgctgacttcacagggtttctgtttttttttttttttttgagacagggtctggctctgtcggccaggctggagtgcagtgacacgatcttggttcactgcaacctttacctcctgggttcaaacgatcctcccacctcagcttctcaagtagctgggactacaggcgcatgccaccatgtctggataatttttgcattttttgtagagacaggattttgccatgttgcccaggctggtgttgaactcctggactcaaacgatcacctgccttggcctctcaaagtgttgggactgcaggtgtgagccaccgtacccagccttgttttgtttttgaagatgagctgaggttatcagtggaaaagtgatttggaaaccataaaatgagatttgggaatgtaatagagaatcaaggcgaagactaagttttctgggagtttttaaaaagattctttcgtgactgtgattctcagaaaaggtttgaggcttactgactagatagttgattttcaattttttattcaaat

SEQ ID NO: 8431 - DNA, 1068 bp, Homo sapiens
tgcttgtataaataaagttttattggaacaaagccacattcatttgattaatgtaatcaataacaatgtaatgtaattgtggctacttttaaactacagtggcagagttaattagttataatagaggctgtaaaatattaactgtctggccctttacatgaaatgttttgctgacatctgatttaatatatcaggcccggtaaagatttagtttattgttaataataaatttaaatccatacagtattctaagtatcttttgataattttgaatttttttgccaacttattgtttgaaccaattagattgttttcgtcctgtaatatagctctcagagagctcatattaggtatagaagggtcagctttgttacttgctatttatttttgtttgtaattttaatattatctttaacctatgggggttgtttttcatattcatttatttatttgcaaacatcccttaagatcatttgtgtggtaaagtttgatttagttgagaaaaaaatataaaccataatttataagtaccctgaaagcaaatgagtgactgcagatactgatgttcttccttgcacactggggagctcccatctctattctcaggaaaactcatatgtggtaagcgataccgaaatacatgacatacagacccagagagggcaccattgttagtcagtacagttaacattggtaaagcataattcttatattttaagattaaaaacaattataaaataagagttttaatttttctttttgtgcttcactggaaagtcttatgcattccactttggagaccactgtcttaatacatactgtttgtgtaaattctttcaaattctgaatgtaggcataatccctgaatataaataaaagtttgtagtatcataataattgagctttaagtccagcaaatactttgtgtggatagtactgccagcagctgcaattagagaatctgtgggctaagcaaagccttactcagatgctttatctgtttttatcctgtgtggacagtcatctctcttccaatagaattttgtatctgcagctaattaaatcaag

SEQ ID NO: 8432 - DNA, 1072 bp, Homo sapiens
tgttcaaacttctggtggggtttgctccatgggcaaaagatttgttgcagtgggatggtactgttaggttgtccttaacagtatgagttgggcagacaagggcctacctaagaccattgtccccttgactggaccagactttttgagagcagtgctattttcttttctggagcctacatggcaaatcagggcatttattcagtcattaaacaaattcttatttaatacatattaaagccaggcactattcgaaggctagggattccacagtgtacaaaacagataagatccctgcttttagggagcttgcgttctagtgatctgtatgtcacaggtgattaagtgataagaaaactttgaaattaggcagaactgtgatcagattatagtagtctagtgactttgcctttggttttctcagggtaaagtggtagttaatgattcctaccattgcagcgttgttgtcaggattaagtgagaaaagtgctgtttaaagttcccaacacaaagaattctcaaaactcgacaatagaaaataagccaggccaggtgtggtagtggctcacgcctgtaatcccaacactttgggaggctgaggcaggcagatcacttgaggtcaggagtttgagaccagcttggccaacatggcaaaaccctctctgtactaaaaatacaaaaaaattagctggtgtggtgacacgtgcctgtaatcccagttactgggaaggctgaggcaggagaatcgcttgaagccgggaggcggaggttgcagtgagtggagatcgcaccactgcattccagattgggcaacaaagtgagactctgcctcaaaaaaaagaagaagaagaaggaagaaggaagaaggaagaagaaaataagccacttaataaaaaatgggaaaagatttgaacagagacttcaaagtagatatatggatggctaataagctatgaaaagatactcaatattattaaccattagggaaatgcaaattaaaaccataatgaggtatcaccacatgcctgttagaatggctaaaaataaaaaatggacaatatcaagtcctggacga

SEQ ID NO: 8433 - DNA, 1041 bp, Homo sapiens
ttgcattttacaggctctaggtgacacagtggtaagtggcagaaatgtgattcaagacattatctgtgaaattctttttcctctgtgacacttcataagctttgtgatttctctggatgttgaccaagctgcgtgatcagttaagagtggaaaactttgtgcagtctcaggcagtatggggatggaggagttggagagaaagttgcttggctctgtctttgggattgagtggtaacactttcctctgcatagaacagtggttctttccttcgaggaccaactctcttctatatatctgtctcacctagatgctttcaatatgtctgattaatctgtgtgtccttggatctcagcacaagacctgtcacatagtaactactcagtaaatattggttaggcaaatgaaagaacaaatggtgcttaacaaagccttctggaactcccaatgcctgcactattcttctgccttctcttgtgtagtacaatactcttaataggatattttgtccttaaggacacacacacacacacacacacacacacacacacacacagtgtgtatatatattttgtattgctcattgatgcataagcctaaatcccccctcttagagttgattagatgccaggagcttcttgggagaggcatgagtttgttttactctcttatattctttgtccctaagcctcttcccataccactgcccaaaggtgagtgtcatttataaggaacacgtgatgagctctaattctttttgccaagtctattgaagtgggtgttctattttggaaatggagtcctagaggttttcctgctgttgagtgtttggctgggtttgtgatcctctcagggtgtttgaaagccatgtatagggatggtagcatgagggaaaactgagcagtgaatcgaagttgccgtttgttcatggggattgtcagggagagagatttcctcagcacctgaagccagagcagagggtggatttattatatctagtccagggatcagcaaactgtttttttcgtgtagcctgcaaacta

SEQ ID NO: 8434 - DNA, 1060 bp, Homo sapiens
gcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataaccacacactctgctctgtgccgggccctcggcttggagatggatttatggagctaaattaattattcatttatgtattccagaaaatttacaagatgctggtgaagaataaatgataaataaaatatagtctctatttttgagttgcttagggagagtaagagggggataatgtataccctgagaactaagggaacaaataggatagggcaatgaactcacctgggagagatctagaaaacttcacagaaggcagtgactttttatttaatagacaaagagtgggagaaagcattttaaatggagcaccttgtgcaaaatcttgggggtataaaagatcatggtttggtcaaggagcatgaaatggcttgatgtgtctagagcaggcaactttttctgtaaaggattagatagtaattattttagactttgatagccatagagtctctgttacaaatactcaactctgtctttgtagcatgaaagcagccacagaaaatatacatcaatgcatgagcctggctatgtttcagtaaaactttatgaaaactggctgggcatggtggcttatgcctgcaatcccatcactttgggaagccaaggcaggaggattgcttgagtctatgagtttgagactagcctggacaatatggtaagaccctgtctctacaaaaaatgaagaaaaaattagcccctgtgcctgtagtccaagctactcgggaggctgaggcaggaggactgcttaagcccaggaggctgcagtgagccatcttcacgccactgcatttcagcatgggcaatagagggagactcagtctcaaaaccaacaa

SEQ ID NO: 8435 - DNA, 1102 bp, Homo sapiens
tgaatgctcagttgaatagctggacgaatggatggatggataattgattctcaaccctggtcacaacagtttaaaaatattccaaaatcaaatttattgagttataatttacataaaagaagatacacctattttaaatgtacagtttgatgcattttgacagatgttatcatttgtgtaaccaccaccacattcaagatatagaatatatccatcaccttataatgttgcatttgtgattttttcccagtcagtccccagctcccttcctggctccagctaaccattgatctgctttctatcactatagatttgtcttttctaggatttcatataaatagactcacagtgtatactcctttcatacttagtattttatgggacagatagatattaaacacacaaatgtggtaaatattaaggtcagcatgacaacaaatgaaagcagtgcttggcattctagagtcatggctttgcttgtctcttttcacagtatacaattggaccgtggatgaggtggtacagtggctgatcacatatgtggagctgcctcagtatgaggagaccttccggaagctgcagctcagtggccatgccatgccaaggtcaggaggggactgggtttttctctgttgagggtacggggaatgggctggagtgggcctgccttcagattgctctggccagttaagtgaggttctgcctttttcagggcagcgtctatagatcttgcctcttctcacatctgttgtgcacttgctataaagtatgatgggcgctttgtatccactctcttctttaatattcctgtcagtcctgggaatagtactgatagctgccatttactgagtgcttagtacatgccaggcattctactcaacactgtatacagtatctcatttaattcttacatcagtcctgtaaggtgggtattattgtatatagatgatgaaactggttaagtaacttatccaaggtcacaaacatgactagttaggggcaaaactgagatttgaatcttggtgtacatcaaaccctgttggtgtttcttttttctttttttcctgtgccctgagcagctgcctcttttatcacccgggag

SEQ ID NO: 8436 - DNA, 1032 bp, Homo sapiens
ctaccatgcctggctactttttgtatttttagcagcgggggggtttcaccacgttggttaggctggtctcgaactcctgacctcgtgatctgcccgccttggcctcccatagtgctgggattacaggagtgaagcaccgcgctggcctactttttctattttttgtagaaatggggtctcactatgttgcccaggcttatctcaacacctggcctcacatgatgctcccgccttagcctcccaaaatgctgcaattacaggctcacttacgactttccatgatttttgaaattacttcacagggagcctgggcagcttctggagggcagtgagaaaccaacgaaaaggctttagggaaaagatgccacagatgaaatttcataaagatcgctttgggtagcccaaatcagaagcttctacaccagccttacatattacggttctcatctattcttattctccactctaagtcaccaagtccatcctacctccacaaggcaaataccctgtctctgccaccatccactgaagaaccctaaaagcaaatgggtactgaccctgccctgcttaaaattctctcagggctctgatttgcgtcaggataaaatccaaacgccatcggccttgcgcggttttcttccagttccagagtgtcagtcctctggccgatctaaaagccctggggctccaagctgcccacggctgtggagcctgggctggagcccacagcggacggcagtgttagtattattataataaatgtcagagcaagaaaaacgttcccgccggttaggttttgttatttcaaaaataaattaaccgcctttcctccggcggagacgcgcaggtgagagggcggcgcctgacccagcgggctctaggtgctacgccagggccccgagggtcccgaactcggcttgcccacacaaaacatggtagcaggagagcagcatttccgccgggcatgtccatatccaatggggcccatgggagaggcgtagtcttctgggtcttgcccagactcaacatggc

SEQ ID NO: 8437 - DNA, 1038 bp, Homo sapiens
ggtcttcctagcttgcccaggctggtctcgaactcctggactcaagccattctcccacattggcttcccaaagtgctgtgattatgggtgtgagccacaacgcctggcttttttttttaatagtgtcgtgaactgctaagcttaagtgatctcctcacctcagccactgagtagctgggactataggcatgtactaccacacctggccatgatggttttcttaattactcttttaaggaagctattgtttcttgggaaagctcaagtaattcttggttttatttttgtaggctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtggtaagtctggggtgaaaaagtaaaaatttagtactctcagaaaagtaataagggtactagaaataaatcttgactgtttaaagaagcaaatatggctagatggggtggcttacacctcgaatcccagcaatttgggaggccaaggcaggcaaatcgcttgagtccaggagtttgagaccagcctgggcaatgtggcgaaaccccatctctacgttttaagaaaaatctaaaattataaaatagactaggtgcagtggctcacgcctgtaatcccagtgctttgggaggctgaggcaggtggatcgctgaggtcaggagtttgagaccagcctggccaacatggcgaaaccctttctctactaaaaatacaaaaaattagctgggcgtggtggtgggggcctgtaatcccagctactggggaggctgaggcaggagaattgcttgaacccgggaggcggaggttgcagtgagctgagactgtgccactgcactcctgcctgggcaacagagtgagactccgtctcataaataaataaataaataaataaatagcaaatatgtaaattagtg

SEQ ID NO: 8438 - DNA, 1030 bp, Homo sapiens
aagcctgcttcctgtcattgtttattatatatactgttatatacagtttgaagtaggctagcttttaaaataaatatatatatatattagtaaatatgtggtaccaatacttttggattaatagccaatctaaaaacatgtttaaggatgataatatagtcccatttatgctcatgttttttccctctttcaaaacatactataaacataatagtaaaagtttggaaaatcacatttaatctcacaacatatatttatgtattatcttctagtgttttcatatacatgtttttaaacctaattaggatacttaatttatatgtattgtttcttttttttagaatgttagatggacttctattctacagtaataatgcttagtgttatctcattgtatcctgtgttgattttagttctggagtcagggccgagagataagagattttgtgaaaataagtaattattttaatttaattatgggttctttttcacccctatcagcgcctgaattctgctattatctatgaccgagatttctcttacaattacttcggctttaaggtaaataatgggtttcaagtatgtgggaatttatacttaaatcatgaaataaaggattttgtttatgttttggtgacagttatcaaggccataagttgtttggagttgagatggacctggggaattagtggggttaaggtagcagtggtggtttgaattaaggcaaaggtagcttatctatttgcagtttttgaattttccacatattacttctggattacctgaggagttatgcagataaattaccataagtatttcataacattctaagtatttttgcgttgataggcagtatagtatagtgtagtgactgagaacatgaatgtcagtgtccacctgaattccagtctctgctctatttcttattagcaagttatttaatctctctgtgcttgtttcctccattttagaatggggagaatataaaatttcaacaacaaatttaattaaaaaaaaattttttttttga

SEQ ID NO: 8439 - DNA, 1032 bp, Homo sapiens
caagatcgcgccactgcactccagcctgggcaacagagcgagactccgtctccaaaaaagaaagaaaagataaaaaaaaagatacaaaatgatacatctgtataggacagttatcatgaatagagcttgtaggactgaaaattgctatgggtgagttagtgagtgagtggtgaatgaatatgaaggcctggctgggcgtggtgggtcatgcctgtaatctcagcactttgggaggctgaggcaggtggatcacgaggtcaggagttcaagaccaacagggccaacatggtgaaaccctgtctctactaaaaatacaaaaattagctgggtatggtggcaggcgcctgtaatccactacttgggaggctgaggcaggagaattgcttgaacctggaaggcggaggttgcagtgagccaacatcgcaccactacactccagcctgggcaacaggagcgaaactctatcttaaaaaaaaaaaaaaaaggaatatgaaggcctagtacattactgacgactgtagactgtacaaacattgtgcacactaaatttattttaaaaatattttcttcaataataaattaaccttcgattactggatgaccactgtcgtatgtgtagtccatcgttgactttttttgtttgtttttaagacagagtctcactcttttgcccaggctggagtgcagtggcatgatcttggcttactgcagcctgcacctcccaggtccaagtgattctcctgcctcagctttacaaatagttgggattacaggcgtgcaccaccacacccagctaatttttgtatttttaatacagacggggtttcaccatgttggccaggctgatctcaaactcctgaccttgagtgatccgtcttccttggcctcccgaagtgctgggattacaggcatgagctaccatgcccggttttttaagttttttagaaatttctctaaaacatgattaaaggacattaaataataaataaatggaatagattcaattttataaaaatgtcagtttttcccaag

SEQ ID NO: 8440 - DNA, 1092 bp, Homo sapiens
ctctatatttttctgaatgtctgaatatttatataaacacctagtcaatagatagaatccatttgcatgattgaatattcaaggcagtgaagagattattgatagagtaaggttcctgaggtggggagcaggatgagatccaaagtgaggtaaaggggttgtctttaaaaagactgtaaaggagctatgattttggtagacgtatcaaagaattggttgacaattggagagattattttcataaatgtttgtttttcttggcttactaacaacctgaaaagacggtgatgtatgtttatgaatatgcatgagaaaatgtgaaaatagcacgtttgcagtctggtgaaaatgtaagccaatattttagacttatctataagacttcctactaggcttatttacttactatctaggggaggcagcaagatgattttaaaatgatatttcgatatgttttattgtgtcatgtacagtaaagtgggttttcttctttgaaaatcatttaggaactttctaaacttcaactcttttttttttttttgccttagtgtctttgtgttgagtaatcatttttgtgactctgcttcatttccttgctctaagttgagacattttttcccccgtagctgttttcttctgagtatgaaagatgacagcattgaaggcatttatgacactctaaagcaatgtgcattgatttctaagtctgctggaggaattggtgttgctgtgagttgtattcgggctactggcagctacattgctggggtaggtttctgccatttgacttttaaagggggattcaagtctaaaagcaaacagattcatggttgagagggcatatgctattttttgggagtcctgggtctctgttaaattactaaatggctatgtgacttggagtgagtcattttacttctggcttcattttcatctatgatattagatatttagatttgactagataatctctagaatcctttttagctcaggttttagaattctggcttattttagcagtaataagagcagttatcattgattgattgcttactgtatgttaagtttgttataaatgttttacatgaggta

SEQ ID NO: 8441 - DNA, 1093 bp, Homo sapiens
actataggcctgtgccaccacacccagctaatttttatattttttgtagaggcgggggtctcactttcttgcctaggctgatctcaaactcctaggctcaagcaatctacctgccttggcctcccaaagtgttgggattatgggtgttagccactgcacctcgcctaggttgttcttaaaacaaaaacaaaaactacctggaataacaaaactctccctaattggctggatgcagtggctcctgccagtaatcccagcactttgggaggctgaggtgggctgatcgtgtaagctcacaagttcaagaccacgagttcaagctcacgagttcaacatgacgcaaccccatctccacaaaaaatacaaaaattaaccgggtgtggtggcgaacgcctgtagtttcagcttctctggaggctgaggtgggaggatggcttgagcccggtaggcaggaggttgcagtgagccgagattataccactgcactccagcctgggcggtagagctagaacttgtctcaaacaaaacagaacaaacaaacaaaaactctccctaattgatagaagaaacagtaaagttgagagaattgggttgtttaccttattttatcaacaggatggtttacaactagagtctgccttttgtgactgtaggcacactaatcgcttgttggtttatgaatttctctctgatggactttggggaccttgataagacagatcaactttttgacctacaataagagcatggcttatactgtcaaagcaacttcctttgggctttatgtacatgtcatgtggtgtaaagagagctgggctgttgctgaagaggaggctccatctgtagttcatcatgtcactttagaaaagttaatcttgtttcacattttgtttatatcattcgttcgtttttactcatagaattgtaaaatattacttttacaattatatatggaaaacttacacttttataatacttttatttatgttatttaattcattgtagtgaaaatcaaaggagatactataaaagtgctttgggagacatgatgtttctttgtttcatttttattctgaagagaattatgatttat

SEQ ID NO: 8442 - DNA, 1099 bp, Homo sapiens
ttaccacaccacaatgtttttgttgtcgatactgtttttgagaaaatgtctcactttgtcacccaggctggagtgcagtggcatgatcttggctcactgcagcctctgcctcctgggttcaagcaattctcatgcctcagcctcctgagtagctgggattacaggcatgctgcgccaccatgcctggctaattatattgtttcttgaataacagatgtcaagatcttaaaggaatatagctttcgtgtggtggcattgatgtctcgtctttataaaagatagaatttaccaagcaatctagcattaaataactcttaagtgattttagtttaagcttcaaagctgtagtcttttctaagcagtcactgttatttatttcttcatacattttctgcttttccattcagattgtaaatcctcacttattgaaagatcttaccgagcggggcctatggcatgaagagatgaaaaaccagattattgcatgcaatggctctattcaggtatagaatgaaaatgaagtgtgctctgcaggggctgagttggacattgtggtacctcctcactcatgctagacaatggagagaatgacttcattgtgttcatctaggttttgcttgtgtagctctgttcacctctgcattgttgtgctaggattgtacacatctttacataacccttaccatcttgtttttatgcaataatataaaaaagtagttctcaatttttctgcatcttagaatcaactggggagcttttaaaatcctgaagcttaggttgcattccttaccaattaaatgtctaggaacaggaaccagacatcaattttttttttttttttttttttttgagacgaagtctctgtcgcccaggctggagtgcagtggtggaatcatggctcactgcaacctctgcctcctaggttcaagcgattctcctgcctcagcctcccaagtagctgggattacaggtgcctgccaccacgcccggctgttttttgtatttttagtagagacagggtttcaccatattggccaggctcctgacctcaggtgatccgcctgccttggcctcccagggtgctaggattacatgcatg

SEQ ID NO: 8443 - DNA, 1050 bp, Homo sapiens
ctactaaaaatacaaaaaattagccgggcgtggtggcgggcgcctgtagttccagctactggggaggctgaggcaggagaatggagtgaacctggaaggcggagcttccaggtgaaccgagatggcgccattgcactccaacctgggcgacagagcgagactccgtttcaaaaaacaaacaaacaaacaaaaaactgttgagcaacagtgcacttgtaacacttctcttgatcttgctttactatctcagggacattaactgagtatctggatcttacatagtgctattttagaagctaaaggacaacacaaataaaaccccacttagagagtttataatccagtgaggcagaaagagcagaaccgtttttcaataatttcaatatctcatatacagcgatgaataataaaaatggttatgaaagtacagaggggctccatttatgtcaattaattctggctttcatgatttttagttcctacgcaatatctgagttgtaatttttgtcattgtgttgtaggacattttatgtaaccacttaaaaaaattaaattgctatttgaataatttctctttcatcctaacttcttcatatctcccattacctcatttcaacaatttattcattgcctattttcattcttcttggtagtttttttcctccttcttgccaagagatcataaacaaaacaaaagaaaaccatagtgtatatattttgacctgatctgtgttgggcctagcaaaaaaaaaatgacttctctcctttccatcactttacaagcatatcttcctgcatccttcctacgttcacgctgggctcagagacagagggtaccttattctttttcctagccaataactccactttagctcctatcaaccagaaacacttagttcagttcaaactgaactaaactatacatatatatacgtgtatatatatatatacacacacatatatatatatacacacacacatatatacgtatatatatatacacacacacatacatatatatatacacacacacacacacacacacacata

SEQ ID NO: 8444 - DNA, 1053 bp, Homo sapiens
tcctgaattattggcttcatcatatccaccctctccaccccagaatggcagaaaagaaacagttaccacaccctgcagaccttttggtgtaaaataggtgatgattaactggggtggaaacaggtcatgaagatctgtctaaaagagtccctttcaagtgagtttgcacacaccatcaagcaacaagcctctcattaattagggttaggaaaccaaggttcaattctcaggaagtcataatttcattcatttactcaatatgaatttacaaaatgcctacatattatcagcttccatgtgcagtcatttctagataaaaaagaaacctggcttctctagaggggccaccaagttcctcctccaagtctatagctgaaaggaccttttttggaattgggtttcttctctacctctgaaagagtaacactttaaagctgaattatctttagcctggaaattaacatatttagcctgtaagtctaacatttagcaatgcttgcatcccagacatacagtagaagatacactaaattctgaaggtagctgtgctgcaaaataatgtaaaagtaaacaattgtacagtatttatgctcaaaatttcagttccagacctagcgtgtaaccactggcattgttattcttgccatccaggagagctgacagtgtcattttgatacctggctttagggtctcagtgtattctaaacctgttaggctagagttgttcacttagccaagaagcaggtgtcagggttgatcagatacttgggtattccaaagtgagtgtttgtattagtctgttttcacactgctagtaaagatacaccttgggactgggtaatttataaaggaaaaggtttaatgggctcacacagttccacgtggctggagaggcctcaccattgtgggggaaggcgaaagccacatcttacatggtggcaggcgggagagaaaatgaaagccaagtgaaaggagtttccccttataaaaccatcagatcccgtgagacattcactaccatgagaacagtatggggaaactgcccccatgatt

SEQ ID NO: 8445 - DNA, 1034 bp, Homo sapiens
ctccccagagtttcagcctcctcttagttaagtttctcctggaatccactgtatgacctggactctacagttgaatcagagccattttcctgcccagcaacagcagtttctgctctaggatggatgaatcaataacaggtgtgcagaggcttgaactagacctttccctaagggttgatcttgacctaggagcagggaggagaaggaatgtatcaatgtctattttgtctgttgtttatgctgacctttgggaattagggaatttgagaacaggaatcctggtcttttatgctgctgagcttatttttgaacctatcttgaacctttggaaggccactgtagttagtggaaggatgcaatgatggagtccttcttaattatgcatatgttgcatctgtgatgcacaacccctgcctagagttctgggaggccctcctgtgtactgacctcttgcccatggtctattatcatggtttgttgtcaggtggggctggatattcacacaggactgtggctaattaccatgtgtagatagtccggttctgagagaggaggcccactcagattttgtgaaaataactaattaatgtgaaggaggcataccttgcctggcttgagccaggttttgggttctacatgttgctctaaactccatcagaggaggttaatcacaaaggacagaactctgaagtctcaaaaatggcctcaactgcaaggaatttcttttctttttctttctttttttttttttttttttttttttttgagacggagtctcgctctgtcacccaggctggagtgcagtggcgggatctcggctcactgcaagctctgccttccgggttcacgccattctcctgcctcagcctcccaagtagctgggactacaggcacccaccaccatgcccggctaattttttttgtatttttagtagagatggggtttcactgtgttagccaggatggtcttgatctcctgaccttgtgatccgcccacctcggcctcccaaagtgctgggattacaggtgtgaac

SEQ ID NO: 8446 - DNA, 1031 bp, Homo sapiens
cattttagttaaatttccattatgaaattgttttttctttcatttataattctttccatagttctgtcacataatttctgagtttttctaattctgatatgtgtcctctcatgacttctatcatttttctattgtcttttagcttgttttgaaataggctatagttttgctctggtttttgacatgctttcattgtctctggggatttattctatgcctcgctttgtttttttcttataaaagcttggtatggggtttgatgctgatacttttctactgctcatagaaaactggaaattttagcttttcttaactttcaaaagaagacttggttcaaaatagttctctaacctctaagtttcactttctattgtttttctgtattaaaaaaagatggcttactttctgaggttttctggtttccctcccctaccttcatctagacttttcctttttctctattgctgctcaatccttattctactcccagcattttctccatgacgagctctgtcccaaaagggagccctgactgtttggtttcaagagtacacagggcatagattacttaagcttctatagaccttacctcacctgttcttggagggggtaagacccccttccagttttacctgctgttctgaaatgggccctctgcctcccagtaaatgcttgatgactgtttgggggttttcttattcttaggtccatctgttgcttcattgtttccctctgcatcattcatcacaaatggtgatgccatgtgtgttttgaggttgcagatggtttgaccccacctacttgtattttaggatctgtgaggatcccttgccctcatttgttaaaaaatgctatccttgtgtttttggttttattatctaattgttctgtcatttttacgtgggcatttgggggagatttcaaaatgatgctgccattgccatcatcttctcagaatcccttctggcattttttttaaaggatgattctttttcttatatggagcagagactgtaaagtataggaggcaa

SEQ ID NO: 8447 - DNA, 1033 bp, Homo sapiens
caaaatcacatctttacaaaaaacacaaaagttagccaggcatggtgtcacatgctcataatcccagctaccagggaggctgaggtgggaggatcacctgagcccaggaggttgaggctgcagtgagccatgagcatgccattgaactccagcctgggcaacagagcgagaccccatctcaaaaaaaaaaatttaaattacttataattcatgtccctttttcctgggtaaatgttttaataaaacaaggcttgaataaaacaagctgcttctggttttccaaatgcctctctgattgttcattacattctatgatttctttgcatgggaattagtcactggccatatctttccattattatgccatgtgctgattcttcctaataaactgggtactttggtgttgaatcactggatttgattcaggtttccatttctaaatgaaatccaaaatgtgaatttattccatgtccttatgcttttaagaaagaaagaaagccctcatattgacaattagaatctcagtaacagtgactttgcttccaaggataaacttgtaagctgtgaaagaacatgtcaagcatattgtcactttaagtccattgcaatttctgtttactttcctgtatcaaattttctccaaatatacatttgagctactccttgtggaattaagaaaactcacatttttcctgattatcttaatctctgattactgaggtatgattgccaccacagagaaaaaagctctactaaaaaaaatacttttttccaaaagcaaacaagaaaattttcaacctatgtgtacaaataacttgaatgtactccattttaaattttgactttggaatcatataaatgtttaattaaacataattgcatcagtaaagtgaaaatagctaaaaaaaaaatgtagttaaaacaaatgaacccaactatatattggtagcaaaagcacagaattatctcaagatttaaaatatagtatacttattaaacatgatggattatatcctaagaaaaaaaattgcaa

SEQ ID NO: 8448 - DNA, 1033 bp, Homo sapiens
taccatgagactttaaattgaaagttggctttgaaagtattggaaaattctgacttaaaaatacaaaatatactaagtaaagagaaaaaatagaagaggcacatgaagatgctaagaagactgtagagggagctgtctgatcagcttagatactaaaggacaatctaagatgaaagaaaagaacacacaatcaaagactgccttacatgcactattctctgagaagtaacttattaaacatttgtgtgaataaagctgaaataaaagacaattatgtttaagaattgtgtctagaaaatttgtgttcaaatatgctagaattgcaaaaaatgctgtgtgggaaagaaagggtagggtgctttgtttttagccactggcaaaactaagaaagagcagaacagaccctgcttgaggatcatgctctaataaatatttttgcagatggagagaaagtagatgtctcagtcctggtttggttctgtcttctctttcaaggtataatattgggctgggaaggactctggacttttgaaagaaggaaaagagtgcagagggagagtggaacatcagagagtttcagctcataccagacctagagtttacagtccaccttctaagagtttgcaaaggggattcttaatatattcacagtttggtcattgaaataatcatttattaagcattctgtcctattcctgtcaccaggccagacactgggaatacagatgaagacaatacaatataatttccttgggagtttgaagaattccagagtataggaccacagctggagatgaggaaatgttctgatttctcctgggggaatgaagtgtgttccctgaattagtggcttcctggtttttagacaataaggcttcaaaccaggttgacacatcccatgtcaaacatttggtgggcaataaaagtgagattcagtcttctgagtctataactcatcttactttgattctgctctagcccctagtccttcttctttgctatgtcctcctagcttctagtccttagcttggtc

SEQ ID NO: 8449 - DNA, 1034 bp, Homo sapiens
accacttcattgtgtgcctgttgacctccagtgcagcctctgcattgatttcagtgtgggattttcctggccactgaagcttactttgttcatctgggctgcaggtttcaaatgatgggaatttaatgccctttgagaaatgccctctaattaataactaaagagagctaatgtgtaataccttggatcccttgccacttaggtggggtatatctgaggtgtattaagcctccatagcaggtttaacctttactccctcactgtaggaactggcttgataatgtaccttttattggcttccttttctggatcacttctcctgtgtttccttctccttctaaataatgcttttccctttaatacttgttttagggtatgctactggggaaacccaaactacaatattctatcctgcgtcctgaggacttatcactgagtgggggttgttcttgaagctgcaaaattcacagaagatttgagcttcattttgcttagaaccttaaaagttaataggaaaaatagaaccaaaaaagcactctagtttctcgtattttaaaaagttatgacttacacaattccccaattatattatacagctctctgagatgacagaataattgttaaggacatttgaaactgccctgctcaaaaaacattaatgattggtgctgcctgtaggatagagtctcatttaacttgaagggcattctagtccccatgaatatatccattttcttgccatagcaggctgtttattgtttctaaacatggcttgcatgctatggtacctcctctgtgtttctgctcactggtcctctggtttgtgtatgaattctcattgtcaccgtcccagaattaagtaacccagccatgcgccccagcatggccttccgcagtcggctcccaagggatgagtggatgagagggtcattctgcccacgctgtgcaatgggtgggcttgaggggaatgaccacactgacctttgatctttgcttctttgcagatatctcagtgagcctgctgacccttgtgg

SEQ ID NO: 8450 - DNA, 1577 bp, Homo sapiens
gtgagtattcaaacctattgcaagaaacactgctatatggctcaaagcttatttttaaaaagccattttgcttatactaactgagtagtaatctgtgtattatatatttgtctttcaattgagtagaactttagaggtccttcaatctagcagataaagctgagatgaatggccattaggacattcagctgaggttacatagctgaataatagccaaatcaaaattaagaccaagttttttaaataatcatttcagtctgtgcaggaaaaggtggctcaaaatgatcatatacactggtttacttctccttcccctctttacctggctaactcccactaagctcttaaatcccagcttatgtgccatttcctcagagaactctttttctgagccctggactagtgtaggtttttctggcatttgtttccatgacactctgtatttctatcattactcatgcttcttttgtgtatttgttcaattttctttctataagtgcaaaacccacatttggtttgcttcctgctgggtgctcaacctctagaatggtgtctgaaagttagatatttaataagcacttgctgcataaagtgaaactccttatgagggactaatttgttgagtctctagggactgcttgagttggaggctgttatgcagaactgaactcataaactaatcttttttaaaaaattctttgtttctccaaggagagtgtgagttttataaatgttggcactcaaataaaaattaatcctcatgctttcctatgaaagaacaaaacggcaattattgagtgtaaaaatgatggtgtaattaaacctctcaactactgaagccagatcaataatagtacaatacatctttgtgaggattttatcagtcagcaagagagaagacagcatcaagggggaaggtcaaaatttcggagactatgagtccagtgttctgggttaatgttgtctgtcaggacgatcctcttggcatttttagtataccccacttactagtggctttctgaaaaagtaggcattaagcacttcaggaatctctttcttggtggttggcttagaaactggttcggagactgtctctgggagctatgatcacctcagttagactctgatttggagaagatgccacagttctcatgtaatgacagtagaagtaatgaatttccctctatgccaatacagattccagttcagaagaggcaaggacacagtttacaacagcatagactttcttttaatgttaagaacttaaaactcttatttcagcaaggtttgttattttgtagtgactgatttggagactttcctgttctgtctcccaaaggcctgaggccactcgcagacctgatggaggtggacacctggaaccacccaggcagggggaatataagtattcagggaagtccagagtgcttgctcttcatagtcgaatacaaatggggcaggcaggctctgtgattgaagatatttattaatttgaatcccttttcatttcattgtaccataagtcatatgtgattattatattgatgcaacacaagtgagccccaaaactggggctt

SEQ ID NO: 8451 - DNA, 1024 bp, Homo sapiens
gggctgtaggactcctctgggaaagggtataacttgcctgtcattttcaagatggttcccatcagctgaggagaattttcccaagaaatatagagccatgaactgttcgcagccaatgctcatagccgctaaggaatggatgcactggctttgtcaaaggggatgtaggcagggaacaatagggtctattgcagtgtgacaggacaatgggaaaggggttatgggaacataggtgggaccctgactcccatgacctctgagatataggaaaaggaaggagaaagagaagagggatcctcttcccctcacctcccaccccacatactcctttcctaggtgagagttggcttgctgccttggcgttgtggctaccaaagacaggtgtctgcacagcaggctggatgctcctgagaggcaggttggctttgcagagagctgaggtggacttttgctgcatccccttcacacagttaaattattccatggctgaacacatggggagggttgagctagatgaaaaaaacaaatcttctacaaacctggaacagctgtaaaagaaatagagttgtcaaggtcagcaatttcatctctgaagaaaggtgagaccagtaagggagaacattcccctgggactacatttaatggtcttctacctatggaagtattactatccaaaatagtgatccagtttcctgacagaaagccttgtcccatggattggcatttgcttgcttggaaaatgagttttcaacctttcgagaatcgaaacagtttgtggtatttacaatacagccttactgtccagtagctaagtgtagtctaattctaacagatggctctccagggaaattttccttcagattggattatgcttccaggctgaaattcactaattaaggggagtctaaataaacatagtgggggagtgagagggaggggaaggtaggctgtttcttaggaagctgttttggaaagtggccatatttgcaatctttatctttccagctccacacactcagctatg

SEQ ID NO: 8452 - DNA, 1036 bp, Homo sapiens
tatgagtctattctggactctctattcttttccatcgctctatttgtctagctttactccaatatcacagtgtcttgattgcagatttataaatcttgaaatcaaatagtgtaagtgctgcaactttaccctactttgtcaaagttgttttagttatctaggtcttttgcatttccatatgaattttataatcagctcattattttacacacacacacacacacacacacacacacacacttgaatttttattggggttgcattaaatatagaatcactttctattatttggaaataataggaatcttaaaaatagtgagtcttcccatcacaaacagtgtatctctctccatttagtacatcgtctttaccttccctcagcaatattttctaagacaggtctctcgagctctctcattgtttatcgttctcttctctggtactctaccctgcaaattctaggggggatggcctctccagactcccaagtccgtttcctcaactgagggagcccactaggctctgcctgggttttcacctgtctgtactgtgtctctgaaactttctccaggtggtgacatgggcagttttagttcttgcctcatttgtttcctgtcactcaaggatcacatatcttcattacctgatgtccaatcattgtttcatatattttgtccagatttttagttgtttaaaatgtgagagtaaattcatttcctgcctctctgtcattgtcagaagtgattgattttatgtgagaattgaagaaagagagtggtcaaagatggatgattttctggttttcagcatgagcaaactccagatgttggtatttactgagatgggaaatattaggtgaagaataggctgtattctggtataagtaagatcatgtgttccatttttaacatattcagtttgtgctacctgtgagacattcaagtataaaaaaatcaaaaaacagttgtatagactaggctggagctcagaagcagggcctgagttggaaatatgaattaacaaattgtcaacatat

SEQ ID NO: 8453 - DNA, 1140 bp, Homo sapiens
aaaagggaagaggaggactgaaattgggaaggaatttttcaaaatgggagaaaacagattatttaaatactgacagctaagagccagtagtggggaagcctggagatgcaagaaagagaggatgagcagcagagggggttcctgtggctgagaccccatcggatggcacgaatggatgggacccagaacagagttggcggatttgcttttgataaaactcttcttcccatgttgcagtgggagggagaggccaatgcaagtgcaaatacatttatgaatccaaaggtaagaagtcaagtgtagcccttctgatgtctctgtcttctctgggagggaagaaacagggctgtgtactgagcatatggaagagcctctgccttcagggagcttgtggtcttttggcgtgtactgctctgatgatttcttttatagtaactacaaaatcagtctcacttcaacttgcgtcccttttaaattttaaaatgttttacttttcaaaaataatttgctggattttccttgattatgtaatctgtctgctcaatacagaaaacttgaatgaaaacagaagagtagataattctgatacaaagtcacctatagtccctctgccctaaagtaaccactgttaaagtttgatatatctttcctgtataatctctgtccatggttcttcacttgcaatttttatatggttgtgacactattttgcctgcttctttgctgtaatttgtttaagtaaggaaactaaacacaaagttttgtctcaaaggaccatttctgcaggtgggtggggcccctgttcctgaacagggcttcattccctttgtccatgtttgctgagatcagggcttccctgctagccaggcatccctgaacaagccaaaatgcagagcacagccttcaaaggaagcttgtctgtcttctctctttggaggctgaggggtcacagtcagcgtacccagaagagaagctgggacttatcaattaaccaatactgctttcaaaccgttttcatcaaaatattttttttttttgagatgaagtctcacgcttgtcccccaggctggagtgcgatggcacgatctcagctcactgcaacctctgcctcccaggttcaagcgactctcttgcctcagc

SEQ ID NO: 8454 - DNA, 1024 bp, Homo sapiens
gagaatcctaaagatagcaaagcagtgtgaagtaagcttccatatatgcatttgtttttctctgggcattcttttttgttccatcagtttatattccatcaattgcatcaatataatactaattatattagtaattgttgaacctgctaccatgaatcacctctcactcaactcccagcacaaatttcctactcaactttcctctcctccctcttacatggattgattattcttagcccttcattattcccttagaattttagaatcaggttatccagctctatgaaaaccaatgtaaccatttttattttaaaaactgcattgcatttatatattaattcgactagaatttacatctttataatattgactttatctatagacataatttatttctccattgatttaagtgctcattaagtcattcaaaaatatttattgagccataatatgtgccagaaattattctagaaactgttaagcagcggagaataaaagcagaaaaaacactggcttttaggactttatactctaaaaaagtataaaagtgggagaaacaaataattacaaaaaatatacatgttaagaggtgatgagtactgcgaagacgaaaatggtatagaaagggttaaagaacgacgaatactgttttatagaggggtcataataatggtcttcttaaaatcataagtttttttagatttatttatcagtacaatatagttttagatgctagcatagacattgtcttcttttaaagttatggtttttttggctggtgaataaaaatgctattggtttttgaaaattgattttatatccaggaaatttttatatttggttattaaattagtttgcagattctcataacgattgtcattttcaacgtaacacaatttttcttcctttttaatcttccagctgattattatttttcttaagtagggcactgttaggtcctcctgtacaatattctacagaaatggggcaagcaagtattcttgtcttgttcttaaagggatgg

SEQ ID NO: 8455 - DNA, 1033 bp, Homo sapiens
gcaggaagatccataagcctccttcacttaccttagtttgtgggctgaagacccatggctgccagacacaaaactgctccctcacccatgcttggttgcctcttgtgggaattagagcagccattattgcaagaaactcatttcagatgactccctctttattacatggaggccagcctagatccaggacgagaggtggcatccttagcacaaatcgtggggttctttgaacaaggttcttggaaacaagttgacccatgtcagttttaggacagccagggtatacgttagatcccaagtcctattggccgtgaagcttagcctgtagttttaagtgaggaaatgaaaaaacaaacaaacaaacaaacaaaaaaccacatccccaattccttcatcagtttaattgagtagctattgatcttacataccaaaattttaagaaaaaactattgtgggccattttcacagtgtaggtcacaatgagatcatcggcgtgtgtcaagtaggcaacgaggctgagaggctgggcagagaccactggagtgaaatgttgtcatatcctcggaagcccattgcacactggcattccctggtggaggtaagaccctaatccacatgctccactttgcataagagtaaatgctttactgttgaaatgcaggagctgccaaacatatgagtgcaccaggatctatggtcatagacgggttttcctggttgcatttcctggggctgttgggacttgcattcaatttgaggctgaatctgtgcttcccaccagtctggtaggttttgagtattgatcagagatcatccctcattttgattgtatttttaaaagatcaagattctctgcttctgtgttaaggctttgggttggtacttggagggcatctgcaaggtgtgggtgagtggggactttcaggccttcgtacagtgacttgagactgactttggaaaaaacataaggccttgattctaagaccagctctggcaccaacctgtgattctgggcaagtgggttagtatcagg

SEQ ID NO: 8456 - DNA, 2032 bp, Homo sapiens
ccatgcattgccctctgaaggagtggcttatgggctagataaatgaacatagcaaaagcctaatacgtgtgttaggggatggcgaaagagaagtgagcagtcaggacgtggagggctacatgctgctgcaatatcttgcccatatgatgaggtgctcccccccaatatagtccagcatcgtgtctcatgtctcagtgtctctgagaacaaaatttttgttatgaatgaaaacagaaaaaacaagaaacatttaaatcacattaaaatagggcaagaaaacataaatttatttattatctgaaaggatacataccatcttggtaagaaacaggaagaggtaaatgaactttatcttgctaattagtagttctcggtcttttccaggttatgtcagtctctttgggataattattttctcctcttcctaggagtctcctctctccttccttcctccctcccagctaggtatagggaagtacaaaggctacctcgtggcattggctggaactgtgcatattgttctgcttgtctttgggcatcagacttcatcatcactacctctgctgctgaggatcatggctggtgtaactgtgggctatagtctcagcatagaaacttggccaccttgaggctgatgagaccccacatcagctgttgaagtccctgtggatccctgagggcaggtagcacctcccactcaatgcttggcctgggagcttttctttgcagcccttaatacagagtcattccccacttggtggaattccctgaaattctaacaaccaatactctcacatccttcaggcatttgggcacacaagggagccacaggagactcagtgccatcacaggcatcttcttcatgcctataaagttacatggtcatttctacattgttcctctagcctgtgttggcccaggggtcatgtttgccttaagcttccccctcaatccatctaaacttggggtttcaagcctgaacggtaaagccagaacctctcctcctctcttctctgtatctcttctgccaaagggtctctgcttcctctacctgtctggtggaaacaatatatatcttagcatgatttccctctacctatgactcacgctcagacctccaaggtttcctctcagcatgtaaggaaacatttggaatttggatcccctttttctcaataaggcctggctttaagataaagttgcatggtcatttctacatgtaacatgaaataagatacttatttcataggagactagctgatcatttaccttgagttatcagccctcagcttccaagaatatatggcgtttattcaatgcatgcattttctgatttacagacaataagaacattatctctgttacgtaggtattgagttagcatttggtgaacaaatgaaaaaaaaatgaatgaatgagatatatatagaatgaattgagttcccttcgttctaaagttccagaattcccatgcagtggagtacacagtagaagtcagttcagacaaggtgtaaaaaggtattgagaatggatttgtattaggctgttcaaatagagatggcccttattaagctccaagttttaattaccttttctctatttaggagaagaacatgaaaagggaccaattcctcccttggttccaataaactgccacgtaatgacaatggctttgcatttttgaataatgagaaatattcagaactgaggccccttagtgaatcatgagggtccccctctacttgatgtaggcagccaagtcctagagcgctcaatatgtcctttcataagagagaagaaacacacagagatcccaatggtgaatggcagactgctgtgccctaagtgaaaactgatcaggaggtgacaaggactttagcccacaagttgacctttctcactaggaatatattttagcagcagttttacacaaggtaatgctttgccccatctacctgtgaagataaagaagagaaaaataataggaatggggtattttttgacaaaatgaagaaattattcttcagatttt

SEQ ID NO: 8457 - DNA, 1035 bp, Homo sapiens
ggtggtattttttgagtggaacaatgaaagatgtgagaatacaggtggtattttcattgcttcttcctactgccctttggaactctggaagactgaagaatatctaaagatgatcagtagtggacttacaagaataggttgatatttagaatgaggttctgaaacacagcttaagataccagaataaatcattctagccatgagtgcagagaatcttacaaagacatgggggactatgttgcttagcgactgatcagctgatctcatcaagaggatttaaaaactgataccaggaggaagagtaagacaacacaataaaatagacaacccacaagaccagttgctatgaatgacatccagtgggatgtggaaaaaaagggttccaggacaggaggtttccagtgattcacaggagataagattgaatcctagatgtaagtgatggccatggccttgggtgtcctaatgcatcctgcagagagaacaaacagaataacccaggacaatgatcacagccttgtagatataactggcacccaaacatgtcaacagaccacttagaagcagacagattaatgtgctatacatgcctgaagagctgtgtacctaacgttgaaagctcattgatacacatattgtgggcattagcagaaatgagcctgccagggaaatatgacaggtggagaggtgagactcctaaaacaaatcaaagcactagtacagagataaaaatccagtggtgagggagaaacccactgaggagatgtttcctggaagtcttctttggttaaagacaaagtgaaaacttctccagttgctttgctacaagtattagaatacttttgatgtaatgaacagaaatcctgacacaaactagattgaacaaagaaactgtagcatctggacaaagggtctagagataggattgtagattccatggttaaggatggggggttccgggattgtagattctgtggttaatgatggtatcaggaacaccagttcttcccaggctattgggccatccttccttcc

SEQ ID NO: 8458 - DNA, 1029 bp, Homo sapiens
agctcctgagcatttcagctaacactgaataggaattaaaaatcactctggaatgagtgagttgagagataggaaataaagttgacaggacatggtgtgatcagaagtgagggattagaagaaaatatcagggatgacttctacatctttggttaagtgtgaaagaagaaagggaaggtaggggttgactaaaggtctggagtgcaaaagagatgtgggcaagtatgtcaggttaggaattatgtcattggaatatagaaggtaattgaacccataaaattggatgagatcacctaaagcaggggttggcaaactttctataaaggtccagacggtaaatattttaggctttgtgtgcagtctctatcacaactacttaattctgcctttgtagcaagaaagcagccataaaaaaattggcgtgtaaactttattcacaaaaaacatttctagatcagggcctggcctagaaaaggaacattgaataaaaagacaagagaacagagacaaaaccctaaaaacctaaaaagtcaggaagaagtagccaacaagattagaaaggtaggaagaaaactagaaggaaagttttaagatgggaagtaagtggtcaagtctgttcaacgctgatgagaggtcaaataagataaaggatatatgtgcatttggtttagggacatagtttcagtgaagggagcagaaaccatagtgagttggaattagataaacactggtagatatagacaacactgtggtttctggtggagagggaaacttttaaatcctggggtaggaggttccaatagattagaagagaatggaaaactcaacgtagtggtcttaggtcaagaaacaaatgtagtgggaataaataaataaataaataaataaataaataaataaaagaaatacagcctgggcaccatggctcacacttgtaatcccagcactttgggaggctgaggcaggcagatcacttgaggtcagtagttcaagaccagcctggccaacatggtgaaaccccgtctctag

SEQ ID NO: 8459 - DNA, 1065 bp, Homo sapiens
agcctccttcctgaacccactgtcaaggctgcaagaaatttttgagatcccacatccaaccccttgtgtaacaggcaaaacaggcctcaggttctgaaccaaggtcacactgcaagtttgtggtagactcagaattagaacgcaggccacctgctcagggttctttctctgtactgcaggagagggaaccagcatcactgtgtgggagtcaaggggcttctcaggagtgagtagtcctttggccatgaccttgccttatgtgaatggaagttctgagcatagtgtgaactgtatgtctacagctgatggctgcctggcagggactcttggccatactgggtttctgggctggctcatttctggtgtttggtatctctctacttcacgttgaatggctcttccctgttgaaaggctctgccagtatcccttaatatcaggtaaaactgcacaattcaagatggtgccagcaagcatgatgtttcccccatggtgacacagggctgtaagtagggagatgaggagccaggcatctttggaattgagggctgacttatagggctgacttatctccgtaggtttggaatagtcataattaatggcaaagttaatggtccagccacttagggatatagcaaagcaagagaatcttggcttgttgtcttcaacttgttgaagaatatcatctccatttcatccacccattacttggcatcttgggatcatttgaaactgttccacctgtgaaaccttaatctttgtgtacctcgtatgcattctgcctcccatatctccaccatgtctgttcatagagacctcaggcccctgagccctagtttttctcctcactctgaatcaactcttgttcctattctatctgagctctgttgcttgtcacttcaactgcccaccattcaccacctggcctcttagtctcctacctcaaccttagagcagggtcactgcctgctttctctagtcctggtttaaaggtgtggggggaattccttcgtgaattgacattggtccaaattcatggcccgcagcctccagcgagcccccagcaa

SEQ ID NO: 8460 - DNA, 1020 bp, Homo sapiens
tctgctaattctgtcatctgtgtcttcctacttgtactgtttttacccacaacacttctaacactaaatgtgtggtttctttccacaccaacaaccaatttggcaactctctagatgccaactgagggtcctgcaatttaatttgattctggtactaattattataactgaagttaatgcagaccccacagtttaagggctcagtcccgcaagacttcccccatttcataagtcccaggttgtcacctatacttctggccaaccagctataaattgggggttcctaggacccctgctcaggtatgaacatttgctagaatggctaacagaactcaggaaagcactttatttactctttactgatttattataaaggatacaactcaggaacagccaaatggaagagacacctagggcaaggtatgcaatggcgtggagcttccatgacttctccaggtgtgccacctccccagcaccccgatatgtttacctgccaggaactctccaaactctgtcatttagggttttatggaggtcctgttacataggtacaactgattaaatcattgaccattggtgagtgaactcaatctctagcccttctcctttccccagtggcttaggggtgagctgcaagttctaatcctctaatcacatggttggttcctttggcagccagcctccatcattaagctatctaggagcccaccaagagtcacctcattagaataaactcaggtatggttgaaagtggcttattgagaataaaaaagatgttcctatcatgcaagaatttccaagggttttagaagctctgtgtcaagaactggggacaaagaccaaatatatatttcttcttgtgtgcactggtgattgatttttctcctagttatgcatcttctcctcctccttttttgaatgcctgggtaatttttgattagatgataaatgttttggattttacaatgttgggctttgttttatcctttaatagttaatggtgggctttgttctgacaaa

SEQ ID NO: 8461 - DNA, 1052 bp, Homo sapiens
cttccttgggcctggcatcagcgacgatgccacctgtgtgggggaggactcagtgggtagtgtcctggcttcccttcagccccacagagcttccctcaaaccttgctgacagctgggcgctctcagtaaactgaggcaagcctgggcctagaccagtgtgtgggggcgtgtgctgtgggcagggaggatgagagagctggcctcaggatgggggtggaaacaccctgcggtgcctctacagggaaaaccaggtccttcaagtctgtgtgacctcagatcccaaataagtcaatgccggcctcccctccccgtccctcagagcagggcctaggagttggggaggggcagctttgcacaccccttgccctgggatcctggggtgcaagagtaggacgaggacagtcggctcagaggggacagagatcttgctagtttgctctgtgcccctttagcccacactcatgtccctgcatacactggaccctcctattgcctggaagttgtcctgcctcctgccgctgcccctacccgctaagagatccagatccccaaataaagccacactggaccccaggatcccaggcttggagacagtgcttttggggaactccaaggtcccccagctctcttgctacttcaggaacagtttggaggggggcccagtagaagtgaccccctccctgtcacctactcaacatcccagatagggctcagaaagttgctccaaaactcctgggaagagaccccacccctggagttccttcctgctcctcctcctctgttctcgctcccccaggactatggaggcttcagcccgttctcactcggcagggtggttggtggggcagggtgacgactctcggtgtttcctgacaacaggctgggggactcaagcgccaatgtgaagctgaagagcgtcctggagacagggggcggtgagacggagtctgcccaggccacaccagtggccggggtttggacctgggcctggggagggtcgctgtttgagaggaggacgcagctttataaaatgactccgtaagtatggcctg

SEQ ID NO: 8462 - DNA, 1085 bp, Homo sapiens
gcagtgtggtcctctgccttctggagctgcactggttcccactgtgtcccagtaagctgccaggcgacagaagccacagatctggacttgccgggggtccagggttgcagccaggggcacagggttgcagccagatgccctggtggcctttcctctcctgacagcccacatctgtgatttcctgggtccagcaggggtagcttccactgtgactgaggggaaagaatgagggcaggaagaggagaaggtgaagtcaacatggaaagtgtggccagagggttgggtctgtccctagattccctgacccctgggcctctggttagcactgatggagtagctggagcatgtaaggtagagtctctgaagagagggagttcggaaacaggctagaggatgttggctgtgtgtgcttttccagggcacagaattgtccttgtgtccttgccccttgttgtcaatcgtggatgactgctctgatatctgtggggtgccttgggggaagtgagtggatgtagaggggcaggttccctgggaggtgaagctgccacctcgttggtgctggactgagcagatggattggtggacactgaagcctgggtttctctgccctcatgagccagtggctttcctgagcctccctgttcaggcccccagcaggaggtgcccgtgatgtaggagactccagggtcagctgaaagacctatccatcagcgccctgtctcttgtctgagtctcctggcggggctgcagctggcagcctgggcttggcagttattccataattggagctgaagtcattaaaaaaccattactgtctccttgtgtggttatcgtttaggtcagcctagaacagggcccatcagaaacaggcaggctggggaagcgtcggtgagaaaggaagatgccttaggaatggtgctggggtggagatgaggaggaagggccatctgggtgggggcggagaagggaactgggcctattgaggaagccaggggagcttttggtgctgctcttcctggagacagccatcgcagttgcccttggtctccacaacagctgctgttggctggggattctttgttatt

SEQ ID NO: 8463 - DNA, 1034 bp, Homo sapiens
gaaaaagctccttttgcaagaagtttcccatatgtttgctgagctactgggagcagggccaggataccaagagacggggtagatcctccgtggaaacctgctgttcagttttcccaccacaagccctgccctagggagcccctggtgcagggtggcagagggaagaagcctggcagtgccacacattgtgaggaatctaatcaaggatggcttcctgtacaaaggactttgagacaacttgaggatggggatggcattcccagggaatggcaggcgggaggacagctgagatagaagctcagggcaaagatgaggagtcagtgggtcccctccacattgggctgaggaaggagctgaggcctgtgccctggcagattccgtggtctatgccagccaaggcctctaataggcctgaggtcagaaatggagattcccagttcaaggtgagctcagtgcaggccttgatacacaagagacagtggtagggtggctgctaggtagtggggtaatgtagggactgagctgaaactgggtggtggggatatatcctgaggattgtggccagccccggctcatgtgtgtacctgagagaatatccttttatatctggacatgtgtgggaatatatgtgtgaatgggagtctatatgtgtagatatggctaagagtgtgtgcataagtttgtgggggtacaggtgagtcagtgtctgaacatgagtatgtgaccatgtgtatttcaggggcagcgtagacttctcctccttcatcccttcttcttctctccttggcccaggcatctccagcagcatgagctttgacgaggatgaggaggatgaggaggagaatagctccagctcctcccagctaaatagtaacacccgccccagctctgctactagcaggaagtccgtcagggtgagtgagtgagtctgcatccacagcagtttttggaggactgctcatccgttagaggtggactgcatgtgaagagatggactcgtatgcctttaggagcttctctgctggcctcttatg

SEQ ID NO: 8464 - DNA, 1231 bp, Homo sapiens
ggcactttgtcatctcactgaacgttcaacctaagaggtagatcctattttctttatagatgaggaaactgaagctcagctgcagatgtcacacagctcaaaaacgaccaaactggaatataaatataggggattactctacccctttgaacctttttcttcatttttaaaatcaggggtgggtatctcatcaacctgggcatgggcacttcttggaggccatcagtaagtaatccacagctactttgtatgatcctgtggtgccacctgctgaccagttttggggaggcagcctgagtcttcaagttcttactgagctccaactaagcatattgtttgaggcactaaggatatagtaatgaacagacataaatgtatacctttatgggacttaaagccctagcagggcagacaagctatgaaacagatctatcagtgaagtaagtatgttctttataaacactaagaagaaaaagtaggggaggggagataagaaatgtcaaggtatgtgtgagaatttcagaatggcagggagggcgtcactgaggtagctcttgagtaaagaccagaaggaagtgaaaaacagcagtgtacgtgtctaggggacacagtgaggacaaaagtcctgaatgcctggcatgaagaaggaatggagtggataccaggcagtaaatggtgaggagaggaaggtcatggggccacgtgcaggtgaagtcacatctccagctttaacttggagtgagctggagagccactggagagttctgagcagaggagaaagatcatctgacttaatgtgcctgagcactggctgctgtgttgagaacagatggtgggaaggaggaataggagggccaacaacagaaaccaggagtccaggcaaaggctgttagaatgatcttggtgagagaagctagtggtgaaaagtggtggaagtctgggtataattggaaggtggagctgacagaaactgctgatggattagacgtaggatgtagaagagaggactcgagtgtgaccaagtagtttgccggagcgagtggaagaacagcattgccgtgagcagaagcaaggatgacgcataagaggagctagttctggcagggtagagacccaggggctcagttctggccgtgttaggtttagagggatgtgtgttagacttcggagtggagatggtgggaactagctcttcctctttattcccgtcccccccaccttctccagtagg

SEQ ID NO: 8465 - DNA, 2217 bp, Homo sapiens
ttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgttttt

SEQ ID NO: 8466 - DNA, 1115 bp, Homo sapiens
ctcaagcaagcacgggcggcgtgcagtacagcacacctagccccgattcttcaacagttctcgccctccgagcctagcacaacgagcctcaccgaaaccgtacaccgccaccaggacactccgtgatgggggatcaccaccctcagaaagaggaagcgactagcaggcgcgcaatcccgcgagaccaggaggccccgcccgaagcccggcctctgtgaccggaagtgaggcgttttgccccgcccccgtggccgatacctcgcgagacttggcgaaggccttcctttttcgtctgggctgccaacatggtaggtgtttcgtttcttgcctcctcttccttgccggcggagacccctaagctgtattcccattgcccctagtcatccactccctaccatggtcggggcttccaggctgcgcatggccgcctgcggggcagggtggccggcgcgggcccggggcggggctcccggagccgtgtgttaggcccgcggttcggatctctaggacacgcgggcccctgcgctaccgtggtgagacctcacggccctgagcggatcggtaccctcagctttcccaaacgctccagaagttaggtctttgacccacaggcttacaggaccatctcggctggcgggcatcgccccctgcccctaattccttaggccttaccaccaagctttttccacacagccatccagactgaggaagacccggaaacttaggggccacgtgagccacggccacggccgcataggtaagtgccggcttcccctcggggtgggccttgggctctcttcgggtgcttagctagtctggagatcggtagcctataagtgggttagaataagacctttttgtggtcaagttgcacagctgttgatttttttctgacgatcctctagtattccagttctaaggaatttcacatcagtggggtaataggaattgagcaggcacggtattgggttagttgaagacatggagtactgtgggaatgctgtgatgtggaacctgaaaagatgtttcacccggaatcctaaagtaatcgcattgctgaaaaccggcatcggtagggtgggaacagcgtaagcgggacacagaagtctgggaaa

SEQ ID NO: 8467 - DNA, 1076 bp, Homo sapiens
gagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgaggctagagtcacgcttgggtatcggctattgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgac

SEQ ID NO: 8468 - DNA, 1328 bp, Homo sapiens
aaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcggtgcccccgttagtgcccagatcagaaacatacataccctgcctagggatttagaaagtgggttggcagtctttcctcacgcccatcacgcagttggtacctactacagtgtattgtaaacttttttctctgttcttctagggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtct

SEQ ID NO: 8469 - DNA, 1121 bp, Homo sapiens
tgctacagttttatggttcttcctgtgattttgagctttttttgacccaaaataatacagtctaaaactatagacaaataagatggcacttagactcctgggttttagttagtggaggtttccttagtgcactgtggggtcataataagccgagaaccatggctgtctatgggacacatctgtcaggacaacctttagaggatgttggggatcaaatagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctactaaatacacaaaattagccaggcgtggtggcacatgcctgtaatcccagctactttggaggctgagccaggagaatctccaggaggcggaggttgctgtgagccgagatcgtgccattgcactccagcttgggcaacaagagtgaaactctgtccaccccccccaaaaaaagtaagggctctccattagggcccatagaggacttgtaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgatctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatggtctcgatctcctgatctgcccgcctcagcctcccaaagtgctgggattacaggcatgagccaccgcgcccggcccaggcacttaatttttgtgtttgacttagta

SEQ ID NO: 8470 - DNA, 1025 bp, Homo sapiens
gtgacaaagctgaataattgcaaaagagactatgacctgctatgccaaaaatatttatctggccctttacagaaaaagttggctgactcctgatctaggaggatgggaaggtatatagagtagggaaatatgattatcaggcagcattaaggcctgaaggttatggacatgaatttaaagtaagactaaacagcatagttgctgcacagaagtaggtacaaaggcaaagagctggctttaaagttgtgattttgcaaactgaaaatgacaaaaaggggtagactaagttaaaagtacatgcaagttgcatgattataatgagtgatcctgggatttaagttgattatgacaggaacagaaggaacttggagattagggacaatgaaaaggtggtagtgaaaggagtgttggagttaagttactagatgtctggaagacagactgtggtggtcagataatgagatagattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgtgggagaaaaaaatcaccttgagagggctgtagtgaaagcagtatcctaaggtagcagccaagtttcagactgctgggatccaagccagggaaaggtttctgactctttagaatgctgagctttaggctgggcacagtggctcacgcctgtaatcccag

SEQ ID NO: 8471 - DNA, 1024 bp, Homo sapiens
gtttcctaaattatattgagtgtatgtaatctattgtttaaaaggttcataatcgaatagcagaagtgtcttgggatggccctttggcaattttttccccccaggtaatttgtttaccttcagtgtttacagctaacatcaggtaccttgatatctggtggcagagtttaaaggaataatttgacatttagttgaattaaaatagaagcttcaaatagaaattgatggggtttattaaaaggttctatgtatttttagagtccttccctgatgggtgattataagactcaaacatgtttgtttatatagtcatctcttaccacctttttgcttttatcgttttaacagtttaaaaagtattatactatttttagttcctgttcaacatattgagccacttccctcagtatcaaatagtctgaaaatgtggcatactacttttctgaatattatgttagtctgtaaaaaataatgtagtgtacatttttaattttttttattttttgtaggcagtctcactctgtcctccatgctggagtgcagtggtgcgaactcggctctctgcaacctctgcctcccaggttcaagcgattcttctgccttagcctcctgagtagctgggattataggcgtgagccaccactcccagccttttcatttctttttaatttatttgcagatgtaataattttgttatgggaaatacaaagtaccaataatttcatcattctagaaaaacagattacatttttgtgttatttcttgctgttctttccccctgcacctattttgttaaaaattttgttggggctgggtgcagtggctcacgcctgtaatcccagcactttgggaggccaaggcggggttatcacaagatcaggaaatcgagaccatcctggctaacacggtgaaaccccgtctctactaaaaatacaaagaattagccgggcgtggtggcgggcgcctgtagtcccagctactcgggaggctgaggcaggagaatggcgtgaacctgggaggcgga

SEQ ID NO: 8472 - DNA, 1070 bp, Homo sapiens
ggaaataaatgaatttaaattatcactttaaattaattaattaaataacctggactctgctaggcagataggaattattattattattattatttttagacaaactggctgtattgcccaggctagaattcagtagctccatcttttttttgtttttgtttttttgagacggagtcttgctctgtcgcccagactggagtgcagtggcgcgatctcggctcactgcaagctccgcctcccaggttcacgccattctcctgcctcagcctcccgagtagctgggactataggcgcccgccaccacgcccggctaattctttgtatttttagtagagatggggtttcaccgtgttagccaggatggtctccatctcctgacctcgtgatctgccctgcctctgcctcccaaagtgctgggattacaggcgtgagccaccgcccccggccctcagtagcctcatcttgactcactgtaaactctgcctcccaggctcaagccatcctcccacctcagcctcctgagtagctgggactgtaggcacgtaccatcatgccctgataattgttgtattttttgtagagatggcgtcctgccatattgtccaggctggtctcaagcttgtgagctcaagtgatctgccttcctgggccttccaaagtgctaggattatgggcgtgagccaccatgcctggccatgacttctttaaaagcaaacaattttatgtaaatgactgaactccctggtcagcagtaaatctttttgtaaatatttctaatttaatagaaaagggtaatttttattgtctcctttccctcccttcccttcctttcttccttcccttcctcctttccctccttctcttccttcctttcctgtcttccacagggtcttgatccttgcccaggccggggtgcagtgactcagttatagctcattgaatcttcaaacttctgggctcaaataatctttctactttagcctgccaaacatctggggctgcaggcatgtgtcactacacccatctaattattttattttgtagagatggaatctcactatgttgctgag

SEQ ID NO: 8473 - DNA, 1056 bp, Homo sapiens
aagaatggatcaacagtaagaaattagtttttgtaattaacccttacatcacgttaaaatagagacctgtaaacatctttatggatgtcagataaagcatttgataaaattaaataaccatgtctgctttgaaaaaaataaacaactgttagaatcctagaacagaatctttcttaacttgatgaaaggtgttcattagaaatctacaataaatatcacaccttatggtgaaaataaaatatcccagtaaaatgggaatatggcaaggatgcccactcactgtttaccattatagataacaagcaaagaagtttgcctatgtactaaaagcaggaaatgtggattgaatgaaatacttttggtaggtattgtgaagagtaaaaagaagtaggattttctttagcaaggatttcgaaatattaattcttgacttttatttagtatacactaccactggaactgataaaccaacagaacctgacagaatggatagaaattttaaagactgttgtgaacagggatgtacctaatgtaagtttctgtatgttctcttatattactaaatgtaaatatttaatgatcttttgaagactttaactggtgtttcctgtaacattctttatgaatttttataatatggtgatgtatttttttctagattagaggtaccttttcatttgtttatatatgcattacatctgtacatttacttagtgtaaaaagttgtaaagggtgtttttttaaatatattattggtttaatttcttctgttgtccttttgtttcatcctaaatcttctgttccctctcagttcataaattaagagctcatagctggctcttagcctagttaatttgtcagatgcccacgtacagaggaagaggaagaacttgatttacagattggccaacttttgtagttatgttattttttcttaataactctattgagaaataactcacatacagtaaaatttattcttttaaagtacaacttggtagtttttagtacattcagagttgtccaattgtgttatttgtataatcaaacttttta

SEQ ID NO: 8474 - DNA, 1106 bp, Homo sapiens
tgaaaatgtgtttagtggtttttggtggtgaagttctggaatacgaaaattggttgtggattctggggttcaaagaatgagaataaatatatgtaacattaatagtcatttttaatagtgttatatctgtttggaaattgagatgattatatttggaactgtatcaaaataactgttgtttatatttacagaaaaagatctataaagatcagatggaatacatgttgcagaatcatgtattccctctcttcagcagtgaactaggctacatgagagcaagggtatgttttaaagctgcattatttatatacttttgtcttgtaatgaatgactctgtggacttttatattgaaacttttaaatgttcactttgaagcctgtgtcttattttaggtttctgtttaatgtaaatctttacatggctgctgtaatgtgtgcataggtttcatctgtgtctggtagcagtgtctgtctgtgtttttcattcagatcttgctatccacacaaacatcatgcggccaaagagtaacttgggatcatagtactggtctagtgttgtctctggacacatctaccactggccagcctccaaattcccacacacagaactcagggaatagagattagcttgggggaatttaaggtaaggtatctacagtaactcactgtgtttttacaaaaggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaaggtaaaggatttttgtatgtcaagaaaagtgaatgttggccaggtgcggtaggtcacacctgtaatcttagcacttcggtaggcttaggtgggaagagcgcttgaagccaggtgttcaagaccagcctgggcaacatctctacaaaaaaaatttttaaaaattaactggacatagtggcatgtacctgtagtgccagctacttgggagtctgaggcagcaggatcactagagcccgacggttcgaggctgcagtgtgct

SEQ ID NO: 8475 - DNA, 1045 bp, Homo sapiens
taaattacatgttttctgcaagttgccttttgcagcatgaggtttttcactaaacttttttttttttttttttgagacagagtctccctttgttgcctaggcaggagtgcagtggcgccatcttggctcaccgcaacctctgcctcccaggttcaagtgattctcctgcctcagcctcctgagtaactgggagtgcaggcgcgcaccaccatgcccagctaatttttctatttttagtagagacagggtttcaccatgttggccggcaggtctggaactcctgacctcaagtgatccgcctcccttgacctcccaaagtgcagaaattacaggcgtgagccaccacgccagccacgtaaactgtttttgtattctgccttataattgaatataagcagaagccatgaccaatcctataggtgctttatgttttaacagattaattgtttattctattttaggaattgtaaatgtattaagttctgtatatttgaaatggatgtcttgcttttatatctgattagtggatattattttacccttcctccccttaacattcttatggccctcagggatttgggatctaatttaggactatctagacaattatagaggaatttgtatttcttgtcagtcttgagttgggggctgagttcacattccatggttcactatatctaataaaatttgaaaaactaaggtgacttaaggattattgagattcgtagcaataatgccttccttcggataatttctctgtgagtcattgacggtgacttttcaattacattgagctgaattaatctctatttgcacataacagatgggctatcttccaaatggttttttttttttttttgagatggagttttggtcttgttgcccaggctggactgcaatggcgctcggctcactgcaacctccacctcctgggttcaagcaattctcctgcctcagcttcccaagtagctgggattacaggcacccgccaccatgcctggctaattttttgtatttttagtagagacggggtttcaccatgctg

SEQ ID NO: 8476 - DNA, 1998 bp, Homo sapiens
cagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgcctcagcagtaaatattggtcatctaatgctacaatagggttaattgaggcaacaaagaagttaatatttttagaatgtttgcatgctattaattatagtcttagaatatcttgctatctttttttgtagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggtaagtgatgtattgcaattttactacatttgctttgggaggaactctgcttatttaagaaaagaaaacagttttttttttttttttttttttttttttttttaggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccggtaagggattttcaatggaagaagacaaaacttatctacttagaaatattaccgcactgggccgggcgcagtggctcaggcctgtaatcccagcactttgggaggctgaggcaggtggatcacacggtcaggagttcgagaccagcctggccagtatggtgaaaccccacctctactaaaaatacaaaaattagctgggtgtagtggtgggcacttgtagtcccagctacttgggaggctgaggcaggagaatcgcttgaacccatgaggcggaggttgcagtgagccaagattgcatcactgcactccagcctgggtaacagaacgagactccatctcagattaaaaaaaaatatatatatatatcactagcccttctcccaaataaatgtgggatcatacccaaatgctttcattcacagaaaagacttcctttcttctcactagagtgatgtaatcaggaacttcagctgtattaccaacatgtagaacagttcaaaccattatagtatgcaaccaacaaagatttgtttattttacacattctcagcactgtagatacaaagatgaatgagatgtcatgcagttcttcaaaagttttctatccgactgtgggaaagtattacaaagccaaataattatgtatataataatagagttgacacgaagtgctgagtccacttaagagcgagagattatagttcccttttttatatggtggcatgagcctatagtcccagctacttggaagtctgaggtatcagattcgcttgagcccaggagtttgattccagcctgggtaacatagtgaaaccccagttttttgttttttggctttttttcctttgagacggagttttgctcctgttgcccaggctggagtgcaacagcgcgatcttggctcactgcaacatctgcctcccgggttcaagcaattctcctgcctcagccccccagatagctgggattataggcacgtgccaccatgcccagcttatttttgtatttttagtagagacaggat

SEQ ID NO: 8477 - DNA, 1035 bp, Homo sapiens
ctagtagtggttccagaactggttcatgttatctattctaaactaataatcaatagatggacaaaagaaacaacaaccccaggagatgggacctgatcatgcaacctggcactggaaaagaaatcagcgggattttgggggtggggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcatt

SEQ ID NO: 8478 - DNA, 1027 bp, Homo sapiens
ccagggtcatttatgttataacatgtgtcaatactttatttttattgccaaatgatatttcattgtatgaacatagtacattttacttatccattcatctgttgatggacatttgggttgtttccaccctttggctattacacataatgctatgaacatttgtacgaaagtttttgtgtggacataggttttcatttctcttgggagtagaatacctaggaatagaattgctgagtcatatagtaactatgttcaaccttttgaggtactctaaaactttttcagtgtggctgcaccacgtttacattcctaccagcaatgtgtaaaggttccagtttctccatatccttaccaacacttgttatcatcagtctttttgattatagtttttctagtgtggatgaaatggtgtctcttgtaggtttggtttgcctgtctctgatggttaataatgttgagcattttttctgtgcctaacgatcatttataatcattggagaaatgtctgtttgaattctttacccattttaaagttggattattcgtcttattatgatttggttgtgagagtactttatatgttctagatagaagtcccttatcagatacatggtttgcaaaatgtccatagtcctttgctgtgtgttggaatgttgctgtgaagtaaggactggttgtgttcttcacagaaacgtggcatggctgcattgaactgtgcctctactacatggttttatttttaaaataaaaaaccactccaccctcatagcatagttccatttctggaaggtaagcactgaatttttaaatgttcatacaagcatatacagataactatatacatttttaaataaatgaatgcaatcatatggtatctacttttctgcaacttgctttttcccacttaccatatatcttggacatgtttctcactgtttcagatagatagatctcattcttttaaatgcctacatgtttcatttagggatgtcgtgtgtgtgtgtttgtgtgtgtgtgtgtgtgtgtg

SEQ ID NO: 8479 - DNA, 1064 bp, Homo sapiens
atgtattaccctttatatttgcaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggtaacaatctctgatcttttggtcttttatctttcaaggctcagtttaactcctgccttttccagaaaccatttccaactaatctcttccctcctttctatcacttggcatggtggaaagagattaagcaacttgaaaaagtttcaccttaacagtcatacattcatttattcaacaaacagttattgagtatctcctgccaggcatcaaacatagagagataagacattgtcaagggcaggctacttgggaagagatagtagacatacagttgctgcagtgtctcccattatatggacaagatgctgtgggagcagagaggggagcagtcacttctgcaggaatgggagaagcattttgggaggggtttctgggagatatttggcatacagactcaatcctgaagtttgccacataagagagaagggtattcctggcaggggaaatgtcatggggaaaggcacaaaggtatgaaaaagcatgatactcagtggttccatatgacaggagcattaagtacatgtagaagatttgtacaaggtgagttctgagaggtagccagaggccttgtgtgttgtgctgtcaaagttaaggtacttcttaaactggactttgtgaagcttgtgagggggcggggtggtctatggatatattcttttttttttttttttttttttttttttgggatggagtttcgctgttgttgcccaggctggagtgcaatggcgcgatctcggctcactgcaacctccgcctcccaggtttaagcgattctcccacctcagcctccctagtaactgggattacaggcatgtgccaccatgcccgggtaattttgtatttttagtagagacggggtt

SEQ ID NO: 8480 - DNA, 1050 bp, Homo sapiens
ctataacatttatagacttgtcaagggtatggggaaacaggtatgctcatgcattgacaatgggcatatatattggtacagccttctctgtggagaagagtgtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgatatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactg

SEQ ID NO: 8481 - DNA, 1020 bp, Homo sapiens
tttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgct

SEQ ID NO: 8482 - DNA, 1074 bp, Homo sapiens
cttccttctcctgcattccctgtaatctcactgggcatcttcctggcaatctgtgcaccttctaccggggagctctgtctctctggctccagttgtaacttgactggctccccacctgagttgagagtacgtaggcctttatctctgcacccatcctgtgcacgttcatagaagtcatcagctctgttaacttgatttgcaattggattgttaaatacaactgattgtcatgttgatttggtgttacttggtttttcaggctgaactaaccaggaacactaagtgattgttttgagctttttcttaagcaaagatttacttgcttttcagcagctgaagtagatagcaataggctaatagtggggaaacagacttccagaaacacattttctacttgcttttaaacttgtattcatgaatagtcctttcttagaacaaaccgtatagtttaagactgtattatctgttttgattgcaattttagtatattctgtgttaactgatggtagactgaaaactgtattgagagagatggaaaggggttttctttataggaaggtgctaggtgcacataggtagctgagtaaatgtagttgaattcaacgttagacattttttccaccatttttcccccttggtttggttttggtgctcttcttttgtttgtacagtttgtcccttggtatccttgggggattggttccaggactccctgcagataccaaaatcgtaggatgctcaagactcttatataaaatggcataatatttgcatataacctatgtatatctttctttatactttaaattatctctagattacttataatacctaatgcaatataaatgctgtgtaaatagttgttaagttacattgtttaaggaataatgacaggaagaaaagtttgcccatgttaagtatagatgcagtttttttttttttttttttgagacggagtcttgctctgttgcccaggctggagtgcagtggcgcaatctcggcttactgcaagctccgcctcctgggtttatgccattctcctgcctcagcctcctcagtagctgggattacagg

SEQ ID NO: 8483 - DNA, 1049 bp, Homo sapiens
cagcacttgtgaggctgaggcaggtggatggcttgagctcaggagtttgagaccagcctggacaacatggtgaaacctgtttctacaaaaaatagaaaaattagctgggtgtgatggcaggtgcctgtagtcccagctgctgggggtgaggggtgggggatggtggctgaggtgggagaattgcttgagcccaggaggtcgagcctgtggtgagcccagatcgagctactgcactccagcctgagtaacagagcaagaccctgtctcaaaaaaaaagaagaaaaagaaaagaaaagaaaagaaaatggtatgtcagggaccaaaaacgtctaagaggagggggtgattcagactgccaactgccagacctttgggagagtgacttggccagaaggtatctgtcccagcatgggttctccaggaagccaatgttaagacactgttaggaatacaaaagtgttacctgtggggtgggagagaggaaatgaaattgggaaaaggaactgtcaaaccatcatatggatttggcaaaaccaggagctctgaagcaaagattgccccttatgggactcccacattgaggaaaagtgatcctaccaccccgctctgtcactgggaccctgaaagtagctggaggctatcagcttaacacagtccttgtagctgggtagcagttacctacttgagggggcatctgagtggtgcatctctgtgtctacctcagaatccatttagaaaagcaatttcaagagattgatagggatagaagtcatattttagggaccatgcggggtcaggttggtgagaaggtggggcagccgagggaaacctcacatttgtgattttttttcattcttttatttttaattttattttatatatttttgatttctgtatattttaatgacttcagatttgtgatctttcttaaattaaaaaatttttctttttgagacagggtcttacactgtcacccaggctggagtgcagtggtgctgttatggctcactgcaaccttgaactcctaggctcaagtggtcctcccacct

SEQ ID NO: 8484 - DNA, 1086 bp, Homo sapiens
ttccttttttttttttttttttttgagatagagtttcgctcttgttgcccaggctggagtgcaatggcgtgatctcagctcactgcaacctccgcctcccgggttcaggcatgcgccaccacgcccggctaatttttgtatttttactagagatggggtttctccatgtttgtcaggttggtctcaaactcctgacctcaggtgatccgcctgcctcggcctcccagagtgctgggattacaggcatgggccaccatgcccagcctcttctttgaccgtgtatgtaaagataatgtacctgtacttggctcatactgagtaattgacattctcagtttcttccatgtgctaggattggtagcctgtttattaataggaagatagtgtatgcacatgaaactgtaactatttgagaggtcagtgctaggattggtagtctgtttattaataggaagatagtgtgtacacatgaaacggtaactatttgagaggtcagtattttatgtgccaagggagtgatatggacagatgttggttcagtgtcatgctaaatgtaacatcttaattgagccactgaaagtgtaatacctaaagcaaatatgtaggatatggctgttggttaattggattgattaaaatgggagccaaaggaggctttgtctttctattttacttgccttagatactgcttatatcggactgatttgttggagtttttccttattcctttttaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagaggtaaggtgtggcttggggagtttttacttggtcattttagcatttaatagacctggcttggtattttttctgttaattcagcatagatatggaaggagatccttggctagtgtttttggatcagaggcaaagcagcctgagtatagaaaagctccaaatatagtaatttggggcatgt

SEQ ID NO: 8485 - DNA, 1038 bp, Homo sapiens
agctcaaggactctttcatgcacatctgtgcaaaaactttgctctgggatatgggggtggctcataatctgtgactctacatacctagtggggttctcccttggtaacccgtagaaatgccacattgtgtgctgaacttcctctgagtagagtagactcatgaagatttttaagaatgcttttataatcttaggaactgcatgggcatatatataatcttagaaaaagttattactatcacacacttactttctaaaagcagctcctcatttcttactgcctcccacccttgaaacagtcttgcatcttgcctctttctgctgcaatatattttctgtaaaaattccctttaaaggttacgctgagcacctgccgtatgtgattgctgctgcttccttccactgtgcacacatcaaaagtgggtgttatgagggaatggtggggagctagaacttggtgtccttttttataattttaaaattataaaatagctcgtacctgtagaggagaatatgaaatatgtatatacaaataatcatacagtgaatacccatgaaaatactacccaggttaagatagattattgccaatacaggttgagtatcccttatccgaaatgcttatgacccaaagtgtttcagatttgggatttttttggattttggaatgtttacattatatactgtatttaccagttgagatcctcttgccttagcctcccaaatccaaaagtctgaaattggaaatgcttcaatgagcatttcctttgagcattatgtcagagctcaaaaagttttggattttggagcattttatattctttattcaggtctttccctcatccctaacccctggaaaccactgatcaattctctgttcctgtatttttgccttttccaaattgtcatataaatggaatcatacagaatgtacattttaagaccgcattctttgacttagcattgtacatttgagattcatacattgatgccctttttaacttttaaactctgccttccaggagcatgtagtgttctg

SEQ ID NO: 8486 - DNA, 1028 bp, Homo sapiens
aggaggtggagcttgcagtgagccgagattgcaccactgcactccagcctgggtgacaaagcgagactctgtctcaaaagaaaaaaaaaaaaaaagaaaaaaggaaaaaagtcaaagagactgctagggaataagccttattgggccataatctgtggatttcactctctagtatacatggcaagaaagtggtgcttctgataccgtggctctgacctgagacttttctctgtctctcctctcaggcatggtatgagcagggctaagtggaaaaaactgtatctatctttcatgttaaagaagtccagaagactggtaagaatgcaagtgtaatttgatgtaaattatagaaaaattatgacattctcctatgttatatttagaagcttaatggaacttttttacacagtgtaggctctatgatttcagagtatagctccctaacagggcttccatttgtatatttgaacataaattatctatctatattgtcccacaaagactctgtaatcgttatgaaactccttgagcagaggaaaagctggactccaaatacagtcttcatttggaaggagtcttttagatgcaggtccaaccaaagcactgtacaggagtaacagttcaggtttttcctaacagattccattttatagataaatgcattgagaatcaaaatgtgtaagcctcagcctcaaggctgagtggtcagtcccaaggtggagttaaggcctgcagtcagaacacaggagaccatgcagctctcagtaatgcagggtgcagagttgctggaggtttgggtaggaactgctctcccttgaaatcactggagtaaagactatgatgctaaggattgcagaggctgctacaggaatagctaagaacctaacagtagtcaaaagatttcttgacatagtcagcaaggaccagtctagtacttgcccacggtgaattccaagtttgggtgggcacatccccttctgccgcttttggggcccctttactcccctgttgctgccatctttgaaggg

SEQ ID NO: 8487 - DNA, 1405 bp, Homo sapiens
tctaggttttgagagccagctcctaatttttgtggcaagaatttagggaacagtctccatttgtgtcacaacccaaacctatagtgtctcaaactttgaaatagctttttggtatgaaacctagtccaatgtttataaaaagcttaaactgcttatatatgttaaaactaaggaaaaccttaacacaaaatttcagaaagtgaaacataaatgatttcttactctacctctatttccaatggtgaatataaataattaaagaaaatgggactcctcttgtgcattctgtcaatacattcccaaatacagactccttttttggcatgcttttctcctttatcatcaaataaagttcctgtagattaaaaaaatccaacaaaacaaaattaaataaattcacactttgccaaaaaacgtatgatgcatgcagcagataaaaaagtggaatattttttatggctttaaaaacagcaacatttgtgtgaaaaccttagaaaataactgcaaagctaaagaccggaatgaatttcatcgctacagggaaacagatccagatggaggaaacatctgataaagtttgcctaagcagccagcagtctatcaatcatgactcttccaaccctcatcctgcatctatatctagattcaaagaagtccatgcaggaggcagtctacacttttcaagagaaaatggaaggacttcagagttgatttgatgaagctcagtaaaaaacataattttatgtttctcttttaagttgttggctgtttgtttattatgaagccatttaaagagttttcttgtttagcagtgtatatatactgcagatcatggttactgagactctagatgacagaagcgtgtagtctgtgtccttgggtgacttaaaaataaaagcagaacttttatacctttttcaaatagtcaatctattactaacatgagcccactttgtttttaatagggaggaaaatgtgttggggtgaggcaaaaagtagttctttaaaaggccatgaagggtgtctcagcagtggtgtcttgcttggaatgaagtgacatagtcaaaatcaacatgcattttaccagtttatcaaaaaaaaaaaaaaaaaaagactcaagcccaagatggcatgaaattctataatatgtggggcccctaagactaattaacagtttcttctctaccttttaactgcagggtccagtgcagtagttctcaaccttggacatggatttaaaaaaccaagggctttaaaaaaatcccagtgtccaggtctcacctcagaccaattaaatcagaatctctggggatggcccgagatattagttattttaaaagttcaagtaactccaatgtccaaagttgcaaatgctctaggggttgcagtaagattttgaaagcca

SEQ ID NO: 8488 - DNA, 1034 bp, Homo sapiens
taatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaacttttatgggtaacttcgtgtctttttttgttcgatatatttgtgcatggcagtgtagcataaattatgcaaatatttgaaaaatcctacattaagcctcaagacttttataattcttacagattcgtggagtgtttattttaaagatgcaagaaaactaaggtaccagcatgtatttttattttcagtaattcagtaattaacactaatatttttatgtagtggtttgtaagagctttaattattgtagtcaacaagtattattaaatgtgctatattagccattgaggtgagaatgcagagataaagttcccttcttgtcttcaaaaattgagtaaagataaatttgttgttcctgtggtgtgagaaatagggtgatgatgtttgcacaggttgtgggagcaaaaaggaggttggaagaagcagtgaagacaaggttt

SEQ ID NO: 8489 - DNA, 1034 bp, Homo sapiens
gaacgtcaggagagtgaacgggagcaaataaaacgctgtccattctgactggaagggccagagccgtgtctaagggcgggggccgggaggtggcccgcggtggtgtctctaccaggacgaggcctggggtatctgaagaggggatgacgtccaggcgctttgctaaagggaagccagaagggtatgagttgctagggtcagagatggggctttcggctcgagtctttccctgcagggcagagagtccgaagagcccgagaaggcagggaggacagtgggcctggtccttccccggccggcagagggagtcccgagatggaacgtccagctctcctctaacgaaaagcgtttgcatggctgtctcgccaattctgtacctcccggggctgaggaagagccgaggtgactagaagctagcgacaagtgccggccacctccgacgccaggcgccgggcttggagcccgacgggccgaattctcgcgagagcggccgccgccatttttccattgattgcagcgggctgggggaggggccgacgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggtgaggggccccagaggaggttaggccttaggcctgcggccgctcgaggcaacacaggcccgggccggggttcggctgcgggcccggccggggtgcaggctcggctgtgggggaatgaggaggcgtgaggcagtcgggggtggacggtgggtgcggcgagcagttgggagacccgctggctctaggggccggggagcggacctcccgcctcgggttttatggggctggacgaataaaggagcg

SEQ ID NO: 8490 - DNA, 1049 bp, Homo sapiens
agtgcattttaggaagtggcaaaaaatttagtgtagatgcatggggcgcctggttctggcagattgtgtctaaaaattccaaaggctttgtgtgcccagaaagtgtttagatttttattgtttagacattagggggcaaaaaatatttttttccccagaaaaagtcaacagatttgtttacaattgttataaaatttagttgctgaaacttgttcatggaaacattttttacttgctggaatgttttttgtccccaacattaataccaaaaatttgcatacaaatcaaagtgggggaaaaacttgctaataccttattctctcatccatttatttccatttgcaatcatataattaggtacctttttgttttttaagaataaaatatttcttttcataatacattttagcacattttctacatatgagtctttttggtgggatatccttaggcataattgttacatatttgatatggataaaacaaaggtgggtgtcttcaaataggctaaccaggtaggcctcacttgcctttagaaaagtgtcagtggctgcactctggaagtatagatctgttttgaagttctcacaactgatgctggaagggaaatttgcaagtgagaagttcagcatacatttgataacttctgatctgattttcactgagagccacagtacaaggcttataatgatgtggtttcttaacctttctagtacacaacatattcttgtgagtggcttttgtagctagttacttcctgtgtgctttaccactggcatttttgtgggcatttggctttgtaggaactgtagtgtagagaactccctatttacttctcttcttggctgaagctctgcaagctaaaggtgacaccgtgctaggcagtgatgactgttggtggcagtcacagtgcagtaactgagaacaccataaggaatgtctttaatttgagaattaatggaatcttcctaaggttatccacagtgctccaaataatatttatttaataaaaataaaatatttaataaagagaagctctggattataaa

SEQ ID NO: 8491 - DNA, 1023 bp, Homo sapiens
gggttggttttttaaaatttagtataattttctggaagttttttcaggttgttacatgtatcaatagttggttcctatttattgcttagtagttttccatgatatggatgtactataatttgtttgaccatttagttgatgaaagacatctgggtttgcagttttgggctgttgtaagtaaagctgctataagcattcctgtactggtttttatgtgaacataattatttcatctgtgataaatgttgaaaagtgcaatttctaagttgtatggtaattgtatatatagtttttttttttaattactggactgttttccagaatagctgtaccattttacaggaaggcatgagagattcaatttctctactttgccagtatttgatgttgctattttttttttattttaaccattctgaaaacgatgtggtaatatttcattttggtattaatttgcatttatctaatggttagtatgttgtacatctttttatgtgcttatttgcatctgtttatacgcttcattgaaatgtcttttcatgatttttgtctatgtgctaattggattgtttgcttttttttgtaggtttttagagttctttatatattctagatactaatcctttgttgattatgtggtttgaaatattttctcccagtctgtaacttttagtccttaacggaatctttgcagagtaggcattttaaattttgatgaagtccagtttatcaatttttccttttatggattatgattttggtgtcaaggctaaggactctgcctagcctgagtactgagaacattttctcctatgtgttttcctaaaggttttatagttttatgttttccatttatgtttatgatccacatttatgttaattttaatataagatggagagttaggttgagaattttttttttttgcttctggatgtctaaatgaaatattacagcatcatttttggaaagactatttttcttccattgagttgcttttgtacctagtcaaaaatcagttgtgc

SEQ ID NO: 8492 - DNA, 1064 bp, Homo sapiens
acagatacataaagaccctgaaggatgatggatgcctgatagtttagatttgcttatagattagttaccactgcacagcatcacctccttgagagcagggtgaacagtgttgggagaacagtgttgaaagatagttgcagttcaacaatttttttgtgaaaggcaccatgtattaaaaattctaaaaatgcgtacatatactttgatctagtaattctttctttgagaaattatcttaaggaaaaattatacaaacaagcaatgctgtagtgaatgtttggaggggcttaaatgcccattaatagcagattagttaaattatggtttgtctatataatggaacactgcagtttttaaactgaatgttttggcatacaaaaacaatgagtattgagggacaagaagtagatttcaaatactggtatatgaaattgtcctatttggttaaaagtactctctctgtataataaatattatatgtgcatagactggagaagatgagatgagagcaatggtggctattttagagttgcttttcagaaaactgtatgttgctattataacagaaatatatttctattgtaaaagtaaaagcgcctttcaagagaatatgttgatttctttttattaactgaagaagggagaataagacaaaatatgtacagaaaaagtgtagagtgatgtaaaatcaagatttttcaagagattatctcttgattataggttacttttatttccttttatatgtttttgtattaattgtaatttaattgttaaactcataagaaggagatatatattaaaatagttgtgagggatattgttaagcagccttgttttaagagtagctgtcgtgaaaaattcaaatttttagagactagcaaaatcaagagatctcttggtttcctttagtgcagagaactgcagaatttctttactggacacaaaatattatgtgacttacaacatttgatttacacacaattcttaagctatcattctttattaaaatggctatttccatatttatcttattctttatcacctctttatcatagattttt

SEQ ID NO: 8493 - DNA, 1079 bp, Homo sapiens
accaagtgaatggaaaacagaaaaaagcaggagtcgcaatcctagtttctgacaaaacagagtttacaccaacaaagataaaaaaagacaagggcattacataatagtaaagggttcaatccaacaagaagagctaactatcctaaatatatatgcactcaatacaggaacacccagattcataaagcaagttcttagagaccaacaaaagagacttacactcccacacaataacaatgggagactttaacaccccactgacagtattagacagatcatcgaaacagaaaattaacaaagatattcagtacctaaactcagctctggatcaagtggacctgatagatatctacagaactccccaccccacaacaacagaatatacattcttctcatcaccacacagcacttactctaaaactgatcacataatcagaagtaaaacactcctcagcaaatgcaaaagaactgaaattacaacagactctcagaccatagcacaatcaaactagaactcaagaaattcactcaaaaccacatgactacaaaattgaacaacctgctcccaaatgactcttgagtaaataatgacattaaggcagaaatcaagaagttctttgaaactgataagaacaaagagataacataccagaatttctgggatgcagctaaagcagggttaagaaagaaatttatagcaccaaatgcccatatcaaaaagctaggaagatgtcaagttaacaacctaacattacaactaaaagaactagagaaccaagagcaaacaaaccccaaagctagcagaagacaagaaataaccaaaatcagcacagaaatgaaggagatagatagagacacgaaaaacctttcaaaaatcaacaaatccaggagttggttttttgaaaaaattaataaaatagataaactgctagttagactaataagaaaagagaagaatcaaataaacacaatcagaaacgataagggggatatcaccactgaccccacagaaatacgaaaaaccatcagagaatactataaacatctctgtgcacataaaatagaaaatatggataaat

SEQ ID NO: 8494 - DNA, 1195 bp, Homo sapiens
tcttagaacttcaaaacaggtgattttaaatattacattacaaatatcagtgtaaaaagaacactatagtgttacattgcagattgcttatttttaattttattattatgttatagagattagagtcttgctttgtcacccaggctggagtgcagttgtaagatcatagctcactgcagcctcgaactcctaggctcaagcgatcctcccaccccagcctcccaagtagctaggactacaggtgtgcaccacaatgcctgtcttttaaatttttgtagagatgaggtctcactatgttgcccaggctagtcttgagtaatctttctgcctcggcctcccaagtagcggggaatacaggtgtgcatcacaacgcctggcttttaaatttttctagagatgaggtctcactgtgttgcccaggctagtctcaaagtgatcttcctgactcagcctcccaagtagctgggattacaggtagaagccatggtgcccaactccaggttttgttttaatgtcatctgtaatctttcgtttactatattttgtaattagaatttagaataatttcctcatagctagttattgtgcagctttaatggtttattttttctggaaataatagtaaaacctgattatgtttggtatttaggattcatttctatcagtagaactttttgtagcaaacaaccacaataaaaaaaatacaaaattatctttgatttcagataataggaggtaattaaactgtttcccattacactatctagagtagtgattctcagattttaatttctttaaaattaattttgggggtacttgttaaaaatgcaggttccagccgggcacagtggctcactgttataatcccatcactttgggaggccgaggtgggcagatcacctgaggtcagggtttgagaccagcctggctaacatggtgaaaccccatctctactaaaaatacaaaaattagctgaccgtggtagcaggtgcctgtaatcccagctactcgggaggctgaggcaggagaatcgcttgaacccaggaggtggttgcagtgagccgaaattgagccactgcactccagcctgggcaacagaaggagactccatctcaaaaaacaaaaaagaaaaatgtaggttccaaggcattacttcccaaaatgctgatatagctgctctgtagtaggctggaag

SEQ ID NO: 8495 - DNA, 1089 bp, Homo sapiens
tatttttggaacttttaatattgctgattgtgttactcaacattatatcaccattagattaatctgtcagcttgttatctgaacttacagaagttgatgtatttgtcattctgtatgcatgtattgccctgtagtgtttaaatgctaggcacttggtggatagagagggaattagtaataagatctttgttcttgagtaatttataagtctttctacaatagcaatatgtatatgtttgaaatagtttaaataacatttaaagacagccaaataccattagagtttaaagagaagaaaggttggtgaaacttggagaagaaagtaagcttcaggtaggtcatgaagctagatatggtttggccaggttgagaagaaagagaatacactgtgcagataggaggcctgtcaaaagtgaaagtgaataataggaagggctacctgagtgttagtcattgtttgtatcagatagtgttccgagcactttatatatagactcacttaattctcatagtaactgtatgaattttatgctattattgtccgcattttacaaagaaggtaactgaaggcacagagaaatatagctttgcctgaaagcacactgctagaagttgcacctagtagatgccaggattcactactctgttctgcctgtgcactagcggatgccaataagcacagtgtgttgcggggggcttcaggagatcagcataaccagagttttgtcagagtactggaggatgaggttaataaatagagttcagagcctgctctcaaaactagcacagaccagatcgttggacaatgtgcctgttttagggagtatgcacaggaatggggatcctgggcacttgtttaaccatctgttttaatactctgaaagtggactgtaaatttacagcactgtagaggaaattaagagcatagccagggctattcatcagcaaacatgtattggacatttactgtgtgctaggcattcttttaggtataaggattagagtgatgagtaagagaaagtacctcatttagagcttccttaggtaaacctatatataagctcatttcacagaatcatgtatgccagg

SEQ ID NO: 8496 - DNA, 1029 bp, Homo sapiens
ttaaaaattgaagggtttttcttttttttctctctctcttttaaaaaatttattaaatatttatttctttttttagagatggggtctcgctgtgttgaccaggctggtctcaaactcctggcctctagcaatcctcctgtctcagcctctcaaagtgctgggatttcaggcatgagctaccacgcccagccagggtttttcttttttaaaccttcatctaaaatgtccaatttctggagttgttttatctttatggtcaaataaattaacttgcaaataataggtaggattaaaataggactgaaagtagcactcatctaacttattataatatccacaatcaatttttatgggtttttttttagtatgataacaggttatttttataatgagtgctgggagacttctgcagtttaaaaaataagctcccgtaaagtagggaggtcaaaaaaagccttttattataataatttcttttttcaatagatttttagttattgtaactgatatttgttagatttctgatcttcattttactcatccaagtacggaatcaatattgaaaggctcttctgccattctgtatatctcagattgagttctgttcaatactagtctgtaaaaggatttagtagatattttggggaaggtgtccttgattaaatagatttgggaaactataacaataatcctctttggaaatatcacagtgcatattatattttaaatgccccagtgattcctgtagttgagaagtttgtttaaatgtgtttaacctagcattttctttctctgtgggacatctgttaatatctcaagagacattaggattctgaggaacataatatgggaagctctacattagattaaggtgatttaagaatgtcactactttgtttatatttgtgtccttgggatgttgagagggagtgagaatactaaaatatgtgttataatttcctgttgttttacatattttttattaatcctgaaaaattaatatcagctgaagaattacttgtagtaatc

SEQ ID NO: 8497 - DNA, 1684 bp, Homo sapiens
atgactgtgatactgcaatactaagaaaggcaaatcttgtgtagaatgaaataattttttttgcttaatttttatagtgataatattattttactgttgataattttccttggtacattttgagttcctaaatttctaaccattctacttataacttttagtaattacagtcttttttattcaggattttgtcattaatataatattttaagtaattataaaacaaatttttttctaactaggaagaagcattgcatgcatttattcagccagagattctggatggcccaaatcagtatttttgtgaacgttgtaagaagaagtgtgatgcacggaaggtaaatgccatgtagagattaatacttaggaatctgagataatattccatattcaatagactctccccctttttgttgtttgttttttagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgaggtaaatatttgttattttaaagtatttttcattaatccacattagtcagtcatggttttgaaagagctgtttgaggtaataacactgatgtcatttggactgtcttcttgatggaaactttttctttcttattttctaatgtggaattcaataaaatgatttacctttgtataagcttttcctgactgcataaattatattttaaatattcttgtttgatcagagtaacttatgatactctttgaaaagacaataaggaactcagctttggaattatttcttgaagttgagtgataatcttatattttataatttcgtcgttattgaaaccagcctgaaggtaagccatactcatgtttctgatctataataaatgcagacaatgcctatgatggaatgaatgaaccaactgaatagcatgggcttaatttcttgtacttacctactattttgtatttactatttgtctgttttccttttttagtttttttaatttgaaactttatttaaataatttaagcatgggatttgaagtgacacatgatgtaatgcttatcaatttcttcccacactttggcctgccaaaattctctggttcttctatccttattcaatgaaagacttacaatattccactctattattttggaaactcttctgattttattatgtggaatacttataatcacttaggctaattatttcaaagtgatttattctcagaattaccctgaagcgttttttttttgttttgttttgttttgttttactggaactgattactatagttataaaaaatgccttttcccaggagttcaaaaataattttaaacattcactaagttttatttagtactattgagtactatgaggcagtttggtgtagaagagcacatgttttaggcatagctagatgtggattcaaattcttgtcctgctacttgctagcctcttgaccttggataattcataaaaccttttgagcctcatttccagatgccatagatgaagtagctgttcattgaatggtaactatgatcaataacattttgaaaagtttaatttaaaataatgtctcagacagttgcgcttaagctaggaaa

SEQ ID NO: 8498 - DNA, 2013 bp, Homo sapiens
attctaggttggtggtaatttttctttcaacatgaaatatttcattacactcttcttgcttgcatggtttataatgataaatgtgctataattcttatccttgttcctctataggtaaggtgtttttcccctctgcctcccctgaagatttttttgtctttggttttgttcagtttgaacatgatatgcctaaacatgggagtttttgttttttgttgttgttttggtttttggtttattgggcaggatgggtatttattctatttggtgttgagcttccaggtctgttgcttagtgttaccagtttttgtaaataaagatttatcagaacacattcactctggttgtttacatattatgtatgtctggttttgtactataatgacagagttgagtagttgcgacagaaaccgtatggcccagaaagcctaaaatactcactctttgacccttgcattagtgggccaaatgatctagattttagttcttactttgctattaataaactgtatcactttggacaaatcatttaatctgtgtgcctttcatttgctacattttggaggaatttggactaggtgctttctgttctacgcagatctagaaatttgtaattctgtttgctagtaccatgtttgaagatgtatccccttttaattaggagtaatgtattgctttgttaaatagtagtaaaagagaagaaaatgttaggacacgtttttatgtaattttatttacaaattatcatgctacatttggatgaaggcactttactttccttcctactttttggcaatgtatttgtgatttgaaactaaaattattgcaattgggaacccttactctgtcatgactgtattatctttgctttaaaatagatatatacaattctaatttggaaggtgattcagtcttctgaatatatcaccattattgtcatctagaagttgctgctattagaattttccaggaagataattatgttggctttgatcattatgatgaaacttaaaaaatgtatagctgttggttggcagactttttctgtgtttattttttttctaaatggggagactgcttatgataagatattcatatcattcagtgatatcaaaattttgtctagtgtatttactacattcaaagcattttaatttaataacatggggttaccacatttcataagttgttcaatgctttaaacacattttggattgcaaataaattctgaaacttcctccctatcaccactgtaattaattttagttttaggaataaaatttgaaccacaaaacaagttttcagacattttcaaaatttgttctagaaatttcactaattaacaatatattgtggtcagtttaaagttattttaagataaattagaatttcttgaaagttatagaaggctctacaatgctttttaggaaaagaataaagaagagaaaccctagtacttgtagaaaagtaaataaaataaagcttgtctgtcataaactggaaatcttctgatgtcaaattgcctttttaacctccttctctgtttctgtcttcctacctgttctttttttgtgatagagttactggtttgcagagtctctagtatctcaaactgtcttaggagttgtgaagtacatgggcttctgaaagaaaagattgtcttaaatataaaaataagtcattataaatgacctcttttttttaaacaagttgcctcttttcttgattttcttccacaaatacttaagtttgcctaaaataatctttagttccaaactttaaagaattgtttgcagaacaggaagctaaagaaataatattaatttattgtagatatagtataattcaggattcattcttaatatgagagaacaaatcagtagatcatgatatcacagataatgcataaatacattagaagatgttccaaataattatattcctcagctcttttgtaaaggaaatagaatttgaataagaaacagtatgttacttcggattttttttatcgac

SEQ ID NO: 8499 - DNA, 1036 bp, Homo sapiens
tatttaaaaataacatttaagttgtgcctgtaactttgatgtctttgatgcaaatcataaatgtgtggattttgttagggcctattgtaatgttattccccaacagactaaaacactgtgtatttatatatgtatatatataaatatatatgtatatatattttttctttctgggggattactttcttttagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggaggtgagcaattttacactatttttagttgttctgtacttagaattttcatgagaaagtttttttttttattgtagaaatgaacataatttaaattttgtatatggtcttaaaatgtagaataattttgacaggttgagaagtactcagcaacagcttggaattaagttctagattacttgcaaagagttgtgtacataattttaaaaacaacaaaaaacaacaaagcttctagcttacggtcttcagtgggttttttcttctccagtgggcggtactgaatcattctggatgctgtcaatccctaaagttatcaattgctctcttaggaagatctctctttctctttctttctctttatggagaagaccttggtccaaaaaagtatattcccataaagtctcagaagtagaggctgtttttcaggtcttctttggaagggtggattcattatcccatcactgtcagcatttacaatttttcgtcatcctctctatttctacaggtcccagggacttcatcttttctttcttcattaaatctatcacattcactcagcacattgagtttgttatttttttttctttgagactgcttaggaaaaccaaaatatcatgcccctagttttcccagagacag

SEQ ID NO: 8500 - DNA, 1035 bp, Homo sapiens
agaaaatttttttctgtaaattttcctgtgtcttttttgtttgcttccttgcagtttgttacaaagccaagtcatttgcccattaaatttttccatgatctggattttggtgttatattcacaaggtgtctttacacatgttcctgtgtctgtagttcaggctaaacttggatttcctaaaggtgaaagatttctacaatctaaagaaaaaccagagtattaatttcctaaagagaaggatatataatacacaactttctgaaattggacaacccaataaacaagatgtttgtgtgtatgtgtatgtccataccgtctatcttagtgtagttttatggctagttacaaagacatttgagcctaatgttcattttattcagtctccaaaacaatagagtccttcagaaactatatcatcacacatgttataacataactgtgtattgtgttgtattgatgcaatataatgatgatgatgaatgagcatgtcactaaaattaatatataataaaactctgacttactatgtaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagt

SEQ ID NO: 8501 - DNA, 1033 bp, Homo sapiens
gtattctttttttgaatgttgagaatattaattcccccttatgaggaaattacaaagttaggtttttaatacattttaagaaaactctgctaatattttcttagccacgtttgttctttagtttcttttttactattatggcttattttgtattgaagacatggtactgataatttatcagagactcaagaacaatgactatttgtgtcctaagccaggtggcttaaagaatagaagtgtattgtctcacaatctgagatcaggctgtcaacagggttggttccttctgagtgctgtgggggagaatctgttccatactctctcctagcttctgtggtttttggccatcattggcaaccttggcttgtagatacatcaccccagtctctgccttcatcttcatgtggtgttctttctgtgggcttgtctgtctgtattgttttcccctttttcataaaccactagtcctattgtattagggcccaccctgaagaccttattttactttgagtatcactggaaagaccctatttccaaataaggtcacattctgaggtactagggattaggatttcaaaatgtctttttgtggggggcacaattcaacccatagcagtgaccttgaggaggtccaagtagcagacatacttgtcacacctcccagttttcgttatcaacattggcacatttaaagtattggtgtttggagggaggcttataggaggaaagttggcttttagaagatcacatcaaggtaaacaactagttctatattctttttttgctgttgcttaggaaaattttaattttccttttcttctgtagaaagtaaaatatgaattctggatattttgttacaagattatcctagtttttagagagctcaataatactaacacctcatgtatttcaggctgcttcaggtctaattcaaccataaatttaaatggttgaaattctgattaattgacaagttaagttgggaggtaaggaacaactaggataccatctactatggtgtgtaggcaagtgc

SEQ ID NO: 8502 - DNA, 1033 bp, Homo sapiens
attgcaacaatgatgtctaccttgcaggattttatgagaattagagctgttgcatgtaaaataactggcacagtgcctattatagatgttcaataatgatagctgttactactgctaataacatggaagttattctccgccacttttagaagtaagcaatatgttcctgtgattaacaccttagaaatctgggacatctcagtatataaaataatattacttcaccagtaacagatttcattatcttgctgaggagcatcatagcattcaagcatacattaatagaggtggagggctctactggactaatatgtgattaatattttatatgtagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttgg

SEQ ID NO: 8503 - DNA, 1064 bp, Homo sapiens
ttatgttccagccatgagtccaggagaagagatgaaatcctcatgtaaacatttgtaagcatctaaaatctccactcactgtcatggaacaaagaacaacatttgaggaaagccctacaatcatttcaaaaataaaatacttttaaaaagtatgtgtaaacacattctgttaggttttcaataggttgtgcagcctgaaatcagtaggaaatccaatgagggctttgcctgaggaccagagcaccagcacaaggagacctcctcctgcacaggccctaggcagcatcctttcttttctgttttttctgcagatgccatgagggtagccgttgtgtggtatctttggtgcctagcatactacctagtacttaaccagtgctccctaaaatgcttcttaactaactgtctgaatcatcactgggcatcttattcccatagagggagtccccaggttaccccaaactctgctttaaccttggatgactcttccagtccccagattctatccaggtctctatttttgagcgtgtgtgtgtgtgtgtgtgtatgtagcttatgaaaatgcctcatccctacccctaggaatctcttttccttttgcgggaagacattgtcagttaatcctgttatttgacaaaggcctgtgagaccagagggtcctagagtccatgggcactgatttcccagtggcagcagtgagcccggaggaggcccatcggttggggggtttggggtgggggtgggggtgcagggggtgaccagatggaatgtgaaggccggttgacttctttgttttcatccagaaaagcttgcttttctgaaatggcatggtacgtatttatatgaaggaggactaaggtaaaagagcccaatagcaagatttaggagagataagagacttacagaccaaaactctataggagagattcagagttcccttaattccccaaagtctgtctcattctccctcccctgcctattccatcccctcttgcccatctcagcttcatttcctcactaaagtgcaaagtgaaggcagctgaaaatcagccagatgcagagcc

SEQ ID NO: 8504 - DNA, 1044 bp, Homo sapiens
tgtttcatcccctctgagttcatagaatcctctcccttcctcctctgcccccatgtatacagggatcagcaagacccatttctacctctcctgaatacatcctctgccattttgacttctctgaactattgaaaaaacttccaaactcacttctttgcttcccatctcacctcctccaacctattccctacacagctagcagaggaaacttttaaaatcacaagtccagtcttgcctgtacttatttataactcttagtgcctctctcctgctggacaaagtccaaaccccttggcacaacattcaaagcattccatcatccgatgacccccagctgtctccttggtctcacccacacatgtggctcatccgtgtagtaatacgtgtaaagtgcttaggatagtgcctgacacatagtagatgctcgataaatgtctgtcatcattggttttactattttttttacataccattgctgcatttttatatatgccacacatattaacatgcctgtacctttgatcatgctagtccttctgcctctaaggcctgccttcctcctttacccaccaggggagaccattattgctcatccttctgatctctagaattaatcaaattaatcaaatgtgcctccctattatagcctttacagtactgtcacttttttttttttcttgagacagattctcgctgtcacccaggctggagtgcagtggcatgatcttggcttattgcagtctcgacctccagggttcaagtgaccctcctgccttagcctcctgagtagctgggactacagggcatgtaccatcatgcccagctaatttttgtattttttctggagacggggttttgccatgttgcccaggctggtctcaaactcctgggctcaagcaacccgcctcagcctcccaaagtactgtgattacagcagtgagccactgcgcctggccctatagtcacatttagaaaagatagtcatatacttttttttgtgttcctccccacacacacacaaatgtttctctctctgagggacta

SEQ ID NO: 8505 - DNA, 1064 bp, Homo sapiens
cactaggaaaatatagaaattttaaacttatatgtacttttgtatatcaaatatttaaaaatttaaaatgataatcattacttcaagaatttgacaaacctatcacagtgctagtttttaacatacttctcttaataacatattaagaaaaaagttcatagagaatatttgaataatacagttaatcagctctaactaatctgtatatagcatatgataccctgcaaactgtattcttttcaactgctcatggaacacttaacgaaatttgactatgcccataaagcaaatctcaacaaattagcatacagaccaaattctctgactacaatgcaagtttctctcctaatatacttggagacaaaagtattttttaaacaactcaggaactgttcatactggaaagagtattttacatattttagttcttgaagggtggttacgttaatatagtgtggtatatatgacaattgtgtttgttagaacatctcagttctcccaccattcagggtaattgagtttattctgccttgtctttatgcgtcagaacttttgactactgtttcattgttttctatatataatctctccaaaagcaaatttgggtaataccttcaaaaacaactcaaagattcacaaaataatccacctgagaaaattttctaaatcacatcctatcaatttcaaaatcatgcctaatacttatgaagagttaaactagttatgaacaatttgtgtaactatggaaacatgagagaaacagtttcctggaagaataaaacttcagcaatagaaaactttatggagctagctgaaattagcccacaaaagaacattatctttaaatccttagtaatgttgagtaaattactattaagctatagaaatattatttgagggggcctcttatattttaagggttgaataccttaaagataaaggaggtggtaggaatagcagaagaagttcgcaaattaatcttttatttaaaatgttagaaaattaaaatatgtcacataagcctgcaaaatagagataatgatgttttatttgtatacccagag

SEQ ID NO: 8506 - DNA, 1044 bp, Homo sapiens
ataaaatcctgctgcatcttatcggcagtcatgtcttagggttagtgaaatgttgaaacaacacgtttgcatctctagtcctaaggatctgggaggttatacattgtggatgggtgttgccttgagggttgctttgagggagtggggttttttacacgtttatattttttaggagcatggatttccttatgtaacatcagaataaaggggaaacacactcactggggtaagccctcatgatacatccgaagagctgtgttgccctgtggtaggaactgaggagggctttgcggaggaagtgatgttggagttgggctttgaaggaacagggggattttttccagatgccattttggggggtgagttgggagtaggttgttagaaaataaacaaaccttgtgaaatattctcctgagtaatgaacttaaccctcgcatatcgatacggtttgttgccagtaatgggctactacagatttgaaacttggctgtgaggaattaattgaaaggagtaggaggggggaactgattgacatgaacagtgggctgtttcctgattttggtttggaaaaaggataatgtgggttcaaaatcacagatttggaattggacacacgttggctcagctacttgctagtgtggccttgcacaaattacttgttctctgcaagcctcggtgtccccatctataaatttcagttgtgcccactatataccagacacatggtgtggtgaatgctcagtaaatagcaacttcaaatgtcatgttgcataatagatctttaaggattttctgccaagtcaccctggacagtgacccttgaggaacacccaaggctgaggcatttacttagaatctgagccggattcctggtctcaggcaaacagatagaaatctaggagaggctgaggcaagcccataaagcccttgaccattaatcgctttgaaccacacgtcccttattcataaagtggaggaaatccatcagtaaatacgtaatatttgaggtcattccttacccagtatgaattaaatggaaatgct

SEQ ID NO: 8507 - DNA, 1140 bp, Homo sapiens
ctccgtctcaaaaaaaaaaaaaaaaaaaaaataataagcccttaatgtcaaatatctagtcactgtttggatttccttgattgtctcataaatgttttttcatagttggctggtctagatgagggtcccaaaccagatcaacaggttatatttggttgctgtgtttcttaaaactctttaaatcacatccccacctttcttgtaattgatttgttacagaagcccctgtgtttctcttctagactgcctcgttctggattttgcagttgtatctccatggtgctgtgtattttattctcttatcctctgtatttcctataaatgggaaatttagatgttgacatttgatctaattcagggtttttaaaaacttttttgatgcaaatatttcatagctagtattctaccaggaggcacacaatgtacagtgtcactttttctgtgatgttagtgccattgattgatgatctctgcctgtatctattatttcatgtagtttttgcaaactggtggttctctgatactctagttctgtttttggagacaggtctcactcactgtgtcacccaagctagagtgcagtgatgcgatcccggcttgccgtagccttgacttcccgggctcaggtgatcctctgacctcagcctcctaaatagctgggactgtcagtgcgccaccatgcctggctagttttttagttttttgtagagacagggtttcatcactcaggctggtctgaaactcctgggctcaagcgatctgctcacctcggcttcccaaattgctgagattacaggcgtgagccatctcacccaacccattcctctttttatggagaaggtttctcttagcaactatatggttaacctagcatatagtttgtaaaggaaagatagtttttttttgttttgcatatcattaggcaatcactgattttaaattattgaatgcgtttcagtccattgcagttcctcctcttactgatgctcaaattgtttcatctttggccagtgggaatttctttagttggctcctgtggccttttgatgtgaccctattaatagtcttttatagtttccttgctgtccaacctcttgtgtattctgggagatagaatgaaccatttctgcagagtttggg

SEQ ID NO: 8508 - DNA, 1132 bp, Homo sapiens
taaaaatacaaaaattagccaggcatggtggcaggcacctataatcccagctagctgggagactgaggtgggagaatcgcttgaacccaggagtcaaaggttgcagtgagccaagatcacgccactgcactccagcctgggcaacagagcgaaactccgtctcaaaaaaaaaaaaaaaagggccctcagaacagggaccagaggggtttagacttttataagtgtgtttcttctggtcatcacagatctaataaaaaataacatgttcatatgatgctttagagttgacagagctttttcagtcgggtaactctttgatctctcacaacttggtttgtgcaagtgaggaagcggggaccgggaggtgaggagccttgccgtgaagccatggctgaaatgcttcctgccatgcctgctccttccttgctgcgctctctcttttttggtgggaggattatgtgttaggacaaggctaggggaaaggtgaagtgggggtggaggatggagggcaggtggggtctggagatggtaaaggaattgtttaaactaccagagcagatgggtctctctgcagtattcagagcacaggcagagcaggaagggactcagatgtggttttcagaccagtgaatatttttgtcacttaaagagggtttttttttttttaaatattgattcctgctgttcatcctggatcttctaaatcttaatcactcatggtgaagcttgggtgattgagtgctctgaaaccttaccagctgatccttaggagtcccatttgattctagccccgtgtctctttaactagaaaagtttgagaatttaggtctcagcatgtcctgggagcttattagaaatgcataatatgagatcccatcccagacctgctgaattagaatctgcattttaataaaattccaggtaattagggcatgcgcattaagttttgagaagcattgctataagatgcttcagggaaacttcagggagtgtagctggggtaatttcacatactctttccaggtttgttatttgccttttgacttaccttatataactttttcatgcagaaattagttgtaagttggatttatcagtacttcctttatagtttctatgttttttatttgca

SEQ ID NO: 8509 - DNA, 1048 bp, Homo sapiens
aaaattccagaagctgtttttactggagttgtattacatttgtagaatagtttacctcattctgttttttaaatagttttaccttttctaaattatatacaccaatagtacttcagagcatttttcagttagagtcatgccagcctttgcaatggaattttgaaacttatatcttctgtggggttattcatagagactttccacttattctgtatcactgcatcctgtttatttctctcaataaaactagtgtatctgatttactcactagattataagcctcacaagggaagtttccatgtctctttatttaccagtgtaattgctcagtgtctagaaaacctctggtacatagatgcccaatacatatttgttgaatgaatgaaatttcggtaaccagagactctagcattgcagttgaagatcgatgacatgtcgaattgtttggatttggatcccagtttgaattcagtgcaccttttgagattattgtgcagtcttttgggggaagtgttccttctctgccattgaattgaggatggacctgggaatgttttggtctatgagacttgacagttggtgtgaattcattgtgaaagtggagactgatgacccagcacaggcgttgtcaacccacacattatttgggaaataatgctgtgaatcaaatcccacaactttgattcaacagcatctcccttttaggtcattctggtattaatttttcttttaattaggaaaaataaaatatttctgcaaagaactttgtacctttttttctataattagagatcccttagataaattagcatcacccatttaagcccttttgttttaggcacaaatacccaacctgtgtgctacttatggacaggaatggaatcttcattcatttttataactcttaacaactttggactttttcttccataactagagatcccttagataaattagcatcatccatttaaacccttttgttttaggtacaaatacccaacctgtgtgcactttatggacaggaatagactcttcattcatttttata

SEQ ID NO: 8510 - DNA, 1079 bp, Homo sapiens
tgttttattcatagaactgggtcttggttctggtattgcttattcatttttggcatcttcagattagctggaagggtattgctacactgtcaaaaataaaatacagtgaaatttatgctaatgaaaacatacaccgtgtgtatgcccaactctgtgctttgcaaagtagacattcaatggctatctctggaatgactggattaatgaatgagtgagtggatgattgaatggaaagagactccatcctctgggaaggaaagaagaatggaatgggcttgacagccatactactcttaaagctgaacttgttgcttggctggaaggagggatgaggcaggagctaagctgacagaagcactcagggaattcgcatatcctctttcttgtgatttctgttttagggaaccaacaggtctttggtaccatctcccatttttccagaccacaagcttttatcttgttcttcagaatcctagaattttgccaccaagtttcagcctaaaggaaaatacacttgtagcatgcaagttctcacctcaaaacctgcgtgaaaatagtcggtgtcattgtagagtgatgcagtgcagaaaggggcctgggatgcttcacccggagaatgaaagtcccaaatctggatcccatttgctcttaccatccaccttgataggagtgtgggtgtggcacctgtcaccattctgcttgcatttgtgtgagtttatgccaggcaaacatgagtaaaaccaattccttccaacacttgacacatagataagtgaagaaaattttatcttacattgtgaacacaatggcaggtaagattgcaggaatgatggtttgtgtacaagctattaataaaagttgtgtgttgcatatacaaactttgctttattgtagatggccttttagttcggtgctatacatgtaatattcaaagtgtacattatattaccatgttgtctttttacttttatgagttatttgtaatgtggataataattcttagttcacatcacattttgctgaccactcaaggaaaagttgaactacaaatatttcaaatgaggtgataaattactgtt

SEQ ID NO: 8511 - DNA, 1024 bp, Homo sapiens
tggatggagaatcaagtttgcatgtgtgccctgtagcattcattcttgccgcatgctgggagatgggtggttattaggttatgtcaaagtagtgtttgccttaatacacgatcttcctgcagtaacccaataatggaagtggaagggagggaggaggggaaggtgatgacctgcttatttgaaagtgggaagcatctggaagtcaaggaagctttgtgtggtgttaacagggagctagtaggggtctgtaccccactgctcaccccaggcccctggcaggtttgaattcactaattctagtcctcaggtgaggtagcatggcttagcggtcagcaggacagcatctgggctcagactgcctggctcctggcccactgtttttcacctctgcctttgggcaaattacttcaccttgccatttactgggttgtacagtgggggtattaatagaagtaccttcctcatagggctgttgtaagagtgaaatgagttaacggatatgaagggcttagaaccatgtctggctcatagtgagcagcacgtgaatctttcttgtggttgtggtggtggtggtgaaggtagaggaggaagagtggttttcttagcctctaacctcatgctctgagggtaagcacagctctggtagtcatcattcagagtccgcttataaccctgtctcctcccaccatgtcatacagagacatgtgaacatctgtggggacgtgccccaggcattctttgtgagtagtggttcacggaggatgcttggcccagccacaacctaaggttttcatgctacacctgtcacttgctggttgtgggacctctggcaggtccctagcctctcagagcatgaaatagagataatcaggtgtcccccggcccctcacaggattgtcttgggggcatgacaagataatgaaagtcaaagtgctttgcaaactgaagttcccctgcagaggaaaggtgtgattgctgctgttggcatcatcttcctcattatgttcttgcattcccttggtct

SEQ ID NO: 8512 - DNA, 1053 bp, Homo sapiens
gtgtagaagcacctggctcagtgcaggtgcaggaagaaagcttcccttcttgcgttcttgttccctcccctgtaggaacagcatccatttactaatgagatgaccaggttcaggagcaccacattttttctggctcttgcgagtgcctactgttcatttatgcaaccactgtgtatgagggcacagtatctccagtccctgttctagcagctggggttactttgtggagtaagaaggatgatctgcacacacccctatccccagcatcctggagctgacactatagtggggaggagagaaggggcaggttaataagcaaacaaagaaaataaatgctgtatatagttggatgtagatactctctgtcagctcactcattcattcattcacccattatttcaacgaacagttctaaatacacattatgttcccagcattatgctaagcatggacatgtgaaattggataacgtctgttagcccaggaattatttcaacagaaaaaaaaagtctggaaaatatagatcactctcttgtgttcttcccttttgaacatcctaactctttagggttaaatactcatttgagcaagtacaagcttctaaatatacccactcctcaagccccccgccccactgtccagcaggttttcctgttgataggacagtggacgtatgagtttgagtgtttggcagatgtttgcatgattcttagatcagtgcttctcaaacatccctgtgcgtaagagttgcctgggaggctggttaaattcagattcaggtgcctcactcctaaatattctgattcactgggtctgggttggtgccagttgtctgagcttttagcctgcagtgcaggtgaattggttgcaggtggtctgtgaaccacacatggatgaaacagtgtcatattcacaccaggctggaagaatgtttaacctcttcagtttaaggaggaaactatttcccagggagtggaggggctctgaaattcgaagctacagtgacaagatgggccaggacttttgaacagaacagatctgggatctcatcct

SEQ ID NO: 8513 - DNA, 1087 bp, Homo sapiens
aaaacataaaaggatcagcttttagtcatgctccttcaacttataaaatgtaggttgcctaaattatgtagtacagagtgaggataaagaaaatcacagtattgtaacacattgcctgtaactgctttgcaaaagcaaacgtctcccacgaaatcttagaaaggtgtgtttgagggtgtaatcttggcttgtggtgcaagggagcccaacttgtttttcaagttggtcttgaataagtttgttctttctggaatgctcgccatcctcagtatgacagagttcgcttgatgacaaactcttttactctcctatacataccatggccactgaactggtttgtttatttgcctggggtaaatgattgaaacacattcccctttgcagtggtgctcagcatttgatagatgattcttattccccaggctccttcatggtgatgccaagcccaagtctagccttccagtggcccctgaggccacactgtcccctccgcaacaaacactgagaaagacacacactctcttgggtgtgcacgtagtttattgagctcgtgggctctccgtaatgctgccccactatgcgcatagtaggagaatccgatattggcagaataactgggtctatgtacataaagtagaatgatcgaggctcgatttcaatttaatttgttaatgaaacaagatggatcacattttcccttcccgcacacctctcgggctgtttgagatgaggcacaattaatttatttgtactgtctgtggaggcgtatgccagctaatgtagtgcaagagcttttatctttatgtttgtaatgaagaggggcaggccgctggcaaattgacaaggagtgctgatgactcatcctctgaatgcgagtgctttcttctgaaatcataaaatgcgcgtgcacacgcaagcctagttcctgtttgaaatggacagaacccctttgggaaagttcaggtgcctttgaaacactgcaggggaaagaacaggccagtgaggctgtttctccggctccctggcctgtcttgagggcagaacctcctgctcagtgggggccctactctgggatgggaattcccat

SEQ ID NO: 8514 - DNA, 1033 bp, Homo sapiens
acagaaacaaaaacaacaacaaaaaatgagtctactagaaactgtaaaatgacaactgtggttcacattatagttctgtgggtggggatgctggatggagagactgacgcaggagaggcagctccattgttggagtgagggggttttagaatgaagagctgtgaatcgggtcctgtgggccctggggcatagtctgtggtaggcgcttcgcatctctgaaccttgctgccctgtttctgacatccccttaactaacacccatcccacagtggggactgaggataaagtcagaatgcctaggaaaagcattttttaaaaatattaagtatgaagccattgtgatccatggttctctttgtaataaaaatttgggattaaggccatatataccatactctgtactgtataccgatagttcaaaagacagacaagaaacctggccagttataaaatagaaggtcgaagtgtgggaaatgcattcagcacagaatgaattacagagtgggagtggatctgtgtgagatgccgtagataagaaaattccttttctgttgcacttggcttgctctactctaggaattccctcacccttacatgcaagtttgtatccaggctttcatagtccttgttccttgttttgtttagtctccaaaggccaacaaggaatatccatatctttttttttttaaatcttcaagtatttcatattgtattcctgaaactccacactcattaaatgcttgaatgaattgccattataccactgtttcctgaaaacctgggtgtgtcaggcatctgctgggctggtaggatgatgatgggcaggacacagcccctgccctcaaggtgctctcagttgggaatgagacagaatgcagtgtgaccaagccgtagtagaggtgagcctgaggactgtgggagacctgaatagtgttcctaactgctaaacgtgatttaaaggatgactgagttaaagacagcaaaggagggagctaagggacagttgtagctgcctggagtgcactctgttgtg

SEQ ID NO: 8515 - DNA, 1043 bp, Homo sapiens
gcctggcatgtgggctctgaaaatcagagcagtattccagcccctcccttttcatcagttaattaattaattctatatttattaaaggtgatgtgtgccaagccaggtcctaaagacacactccagtaagacaaggttgctgccttcatggagtttgacactggggagatagacttgttgatgggcagttggcagaggtgctctgatataagggcatggtgctgtggaaacaggcacagggcaactcagcctgacataggtatccaggaaggctccatggaggaagtgatagctctgttgaaatgagaagatggttggaaagatacaaggggtgactctgtgtatgtgtgaagcatctgttggaatatgagtgctccagcactgagagttatgtttaggttacactgtgagtataatttgacttggtctgattgctttgctttgaggtctcattctttctatctatctatctatctatctgtctatctatctatctatctatcagtcatctatctctgtcatctatctacaatctttttaattgtgataaagtacacataaaagttaccatcttcatttttaagtgtacagtttagtggtattaagtgcattgacattgttttgctatcgtcaccaccatccatgcacagaactctttttatctgcaaaactgaaaatgtctattaaacaagaactctccattccttcctcctcctagcccttgtcaaccaccattctactttctgtgaatttgactactctaggtaccgcatatgagtggaatcctactgtatttgtccttttgtgaccggcttaattcacttagcataatctccacaagatgtattcttgtcatgggtgtcagaattgccttccttttcaaggctggataatattcaaggtcccattttattaaaacctcaagcatatgtgaaatattcactgatcaacacattaacgagctctctattccctttactgataagtcattcatgcatttgtccctctctccctctgttactgattacatgttaggtgccaga

SEQ ID NO: 8516 - DNA, 1377 bp, Homo sapiens
tattttggtaatgaaattttgttcgtggttggcagtagggcaaatgcagtcttataaaggagaaaaaaggacaactctatgatgaggtttttggccaccggaggaggtggcttcattcgctttctgctaacttggtctttggggagctgagactttatgtgtttgggctgtgtgtggataggtggcttctgctgtgggcacccttatgtgtaggcagtcgtttttatggattactagaaggggtacgagatgtcctttgacctggttcctaagggcatgtgtgctcagtccctggggctctctctttctctgtgcttgtctttttcattttttgtttttacacagctacgtgtgactcttttcctggtagatcatgggagaggagatagatagcaggaggacaagatgagagggaagttcttgatcaacaaacttatccagaattggatttcagaggagcaggctgtagtttaaaacaaaacaaaatagatagcaaaccacgggaacacctgaatttgttacttttgcaactgaaaatcccagtcagatagaccccataatcaaatagggcagggacaggaactaaccttcactggttgcttgctgtagaggcagagaagtatataacacttaacagtctggactctataaataatatgaatcctggccctgcacttctagatatcagatttttatcgagttaccttacttctctgtctcaatttcctcaactgaaaaggaggattagatagatcttactgtgtaggattattagaagaattaaatgaactaattgttatctggaacaccaccaccccctgcaatgtttgaactgtatctagcatatagtgagaggtatgtaagtgcttatgaactgaaaacaaagaagtgctctctgccaagcactatgctaaaggctccacatacaattctgtctaatgctcttaacaatgctttgaagctggtattatcatcctcactgtatagacaggaagctgagtctgagaggggtaaaatggcttgcacatggccaatataaatggtatagctagcaggtttcaaattcagggctgtctgactctacatcttggacttttctactgagcttttgttccttccttggtagagaccgttatacataaatccagtgaatcagtattgagccccagcgcagctgtattccagccctgtgctaggggttgtcagggatactgtagtgaaccagacagacatggtccctgccctcatggagctatctcaagttcatttgcaggaaactgacctgaggtcaggactgtgtgccaaagctttctgagaagtttgagagccctttgaagatggtcaccttccacttagccttttgaagcctattcttgg

SEQ ID NO: 8517 - DNA, 1027 bp, Homo sapiens
gagttaagcatccctagttcagttagagggctgtgtggttaagggagaaattgagctgagccctcctttcttagggtttctgtcaaagaacagggggacggggagctccagggcagacttttagagatcagagccacaaatgatggaagggactgttgctgggcagaggttcatcaggcctccctcacagtggccctccgcagcatcagagggaagtagagagtgggtggacatttgtgttcttagcagcacaggcctggattcaacgatgtttctctgttctcatccccaccggacccccacctctagagcttcagttcctcactcatctgctgctgtggccttccattttacgtgaaagcgtgtctctgatttattattgttgttatgtattttatcccgttccagtgatagtatgtgtttaaagtggtctttttaaaataaatgatcattattgatggtagtgttctgttggtctctcactaaaggtgctattttagagactgttcaacttgataaatctaaatatagaagtgtgttcgttgggaggatcctagaaaaaaatctggaggaatttacagtctactaatagtggttgccacagggagatgggattataggagactcggtttctattatgtttctgtattaatgggattttttcaatcgcaaacatatgttacttttggaatcagaagaaaaaagataattgtgtcaagtttattttttcctctggttctgagtaaaggatattcattaaagaaaaatgtggaaaatagcaagagttagaaagcaaaccatattgcctgggtccactgtggtgtggtgtttactggcggcggggggttcacccggggaagttacggcagggtcacagtgggcagggaggggtgcaggggtgtttggagagcatctctcccttccacttgtgggtggctgaggtatcaagctcaggggacaggtggtcagagagtggcagtgctagggcgggggaggagaacagggcattcttattataggttttagg

SEQ ID NO: 8518 - DNA, 1037 bp, Homo sapiens
caacactattaaagttcataaacaattgtagcaaggtttctggatacaagataaatacataaaaatataaaactcaattgtaaattttttttttttttttttgagatggagtttcgctcttgtcacctaggctggactgcagtggtgcgatcttggctcactacaacctccgcctcccaggttcaagcgattctcctggctcagcctcccgagtaactgggattacaggtgcctgccaccatacccagctaagttttgtatttttagtagagacatggtttcaccacattggccaggctggtctcgaactcctgacctcaggtgatgcgcctgcctcggtctcccaaagtgccaggattacaggtgtgagccactgtgcctgccactcgattgtatttctgtacttaacagcaaacaacctgaaaatgaaataaagcaattttattcatcatagtgtgaaaaagaacaacatacacaggaataaatgtgacaaaagagcaaaaaacatttacctccaaaactacaaaatattgtttaaataaattaaataaccgaataaattggaagacattctgtgttcatgggttggaagacttaacattgctaagacagcagtacctacaaattgatctacagattcagtgaaatccttatcagaatcccaggatcccatgacttctttgacaagttgattctaaaatttatatggaaattcaagacccagaatagccaaaacaatcttgaaaaagaagaacaaagttggaggactcacactttgtgatttcaaaacttactacagagctacagtctgaatcaagacagtgtggtactgggataaattagacatatcatcaatggagtagaatcacaagtccagaaataaacccttatatttattgtcaattgattttcaacagatataccaagacaattcaataggaaataatagacttttcaacaaatgatgctgagacatgcgaagagtgaagtcggatcccttcctcacatatcatatatcataattaactagaaaatga

SEQ ID NO: 8519 - DNA, 1056 bp, Homo sapiens
catgaaagaccacatattgtacgattccatttatacatggaatcatatgaatcatacgaaatgcccggaataggtcagtctacagaagcaggaagcagattagtggttacctgagactggaggatttgagagaaaatagggagtaactgcaaatgggtatggagttctttctggggtgattaagatgttctaaaactagttacggtaatgcttacacaactctgtgaatgtagtaaaaacttgaattgtacacttaaaatgggtgagctgtatgaaatatgaattatatcacaataaaggtagtatcagtgtatatgctcagcatcatgcttggccttgataaattggtaaatgttagctaccaatgtaatagtaactctctgacttcatgtgcagagcacgtttatagtagcaaagatggaaagaaaggaaaatgctgagagagtagatgaacatacaagttaactcagataccaggtgagggagaaggtgactgaatctgtggcagccgtatggtaggagctgagtgctgcttttggagaaggtgaatgaagttatgtggtgcaagagcctgataccctaaaagtgtctagtaaacctgaatgtagttacccttaaaatgtggttgaacttgggtctggggatccagatgtcactaaacagtatcttcttcacaaaagagtaatcaccgtcagtgtgataaaagccagagtttttgtgtctagaagtcactaaaccaggtaagggtttgtgtgtgtgtgtgtgtgtgtgtgtgtgtgtgtgtgcgcgcactttctttttaaatcactgtatgacaaaggccagagttttagtttttgtgccttttttttttttttttttttaaggcagtgtctgggggaacttatcttcccacagtcagcccatggctgaccagctttgatttttgcagggtgtctttgggcctgaatgtttgagcctccctacaggagatggctagagcctagccctcatgctctggaagttagttctggtaaaagctttgcagttggcgctgtggatgccctgtgctactta

SEQ ID NO: 8520 - DNA, 1025 bp, Homo sapiens
gcccattctctcactggagttaggagtaggattgccggacctggcaaatagaagtacgggaggcccagttaaattggaattgcagataaacaaaaagttattttttagtatgagtatatcccatgccgtggttatattttatatagcaactctacttagtaaggactggcctgattttgcttacctctggggcatggtttcacagtgcctctttcattcagtagatgcttattgagtgccaaggatatgtcagatgccactctaggcactggggatattgcagtgagcaacaacagacaagagttggtgaactcatggagcttacattctagtgggggcgatagacaataaggaagatatgtaagtatgttaggtggtggaagtgataaagaggaaaataaagcagggaaggaagatagggaggattcaaacctgaagaagatgagggattgaggggataagccagacagacatttgcagaagagtcttctaggcagagagcaccacagacatcaaagctcgggcatgcctcatgtgtttgaggactggtgggcctccgtggcttgagtggagtcagcagggaagaggatccagcatggaggtcagagctcagatcttgcaaagcctcatagccctctgtaaggatatgggctttcactctgagcgggagtgtgatctgattaggttttgaaaggatcaccggctgctgggtagtgaaagactgaaagcaagcctgggcccaggtctctcaccgtatcctcaggggtgggccatgggatttgagacctgcatgccatttggaataaaagggcatgccacctggacacagcatcaccttgcaggatctttgatttctttttgcctttttcttcctcatttaagggatacattcctactcaaaaaagggaaggatatgttgcagttatctacctcttttttgctaaccattgtatgatgcgcctggtttaagggacagttccctaatggttcctattaagctttggagaaagagtagtggtgtggtg

SEQ ID NO: 8521 - DNA, 1025 bp, Homo sapiens
gcaggagcacccgagtgggtgtgcatgcacataatgggcccagctgctgtggctgcagcctgtgaatgccttccaagaggccagatgcctggacacatctctcagcagctacttttcctttaagggggatgataactccctggcgcttatccctagtacctctgacaaggaaaggaaatccatcctgccctgaacagcagggtgagcaccttcacctgattcagtctcatgcatctcagcaagggagatgctagtatctaattgtcttagtttcctagggctgccataacacaatagtgtaaactaggtgacctaaaacaacaggcatttattttctcacagttctggaggtgagaagctggaggttgaggggttggcagggccatgttttctcaagtctttaggggaggatgtgttctgtgcctttctcttaaaggctactgtgttgccatcaatgcttggctttccttatctcacagctgttaatttcagtctctaactttgttgtctcatggtattctctcctagggttgtcgttgcattatcttcttgtaaggacaattgtcatattgaactaagggatcgccctactccagtatgaccttgactgatcatatcttcaatgacaccatctctgaataaggtcaaatttgaggtgtactgagggttaacacttcaacaaatctttttggggcatgcaattcaacccataactctcatgttgcatacatgggtgcaggtttaaagaggatcagtaatttgggtatggtcacaattaggcagtgttgggaccaggattggaactcaggccagcctgtccaaagccacttctctttctactaaactttggtgtgtcagaatcacttggagggctgataagaaagactggggcccaggctttatacccttgctcctccacctgtggtccatggaccaactggcaacatcagcatcacctgagagctttttttggaaatgcagagtctcaggtcccaccacatacatatttttaacaagatccccag

SEQ ID NO: 8522 - DNA, 1082 bp, Homo sapiens
ttactataggctaagggctgtagggaacactttaattcactgaataatgtcagtaactctgtgaaatagatattagtgacctattttgcagatgcacaaactgaagctcaaaggggttttcacagatagtgcaatactaagttggagccttggtttgaacctgagcgtgtctgcttccaaagcccatgctcttaggtggattttcagtgatgccagaagatggttggactttcctgaagatgtttatgtgcattgtcgccacagagtcaaaccaagaattgtatggttgtatttcattcagaatcataacatgcttaatccagatgatgcctcagatgatgaaggtgggttgcccacaggctgtattgattggtgattcttaagagtgtaaaaaaaggaaatcacttgattttgttgtggggaggcagaatgtatcacacaatagcttggttgagtttggcttaatgtagatatgtttaatataattagactgagggctgaaatgggcaccttcaggtcactgtggaatgagacagagccctcactagatttttgagtcacttgaggtggttatgccaagccctgttcacatttcacacttgagtttaagtatttgtgaagggaatatagatctttggtttgaactagatatagctcaaaggttacccattcagaacagagcatttcagcctcagggcacctacttagcctctaagatgagaccacatctgaaccagccaagtcagcctgggatgaggttggaggagaaaaattcatgtgataagtcagattacaattaacttttttgttattactttttgagtgaccacaatgtgtgtgggacttcgaaatatggaataatgatgggttttattatttctttttgagaaaaatccagtcactttttttttaacccgaggaagttgaatcctgaagaaggggagatttatctctgccctttgaacttaaagcccataaagtaaaatatatagtttaaaacaattacatgttccccccatctcaccgccgcccgacccttcacagatagtgtttgacaaaacactatttaggaaagtgcctga

SEQ ID NO: 8523 - DNA, 1032 bp, Homo sapiens
actggttttctttcctaatgagtgtggtcattattagagttaagcctttccctgcatggcaagtgtgaacatgtctgcagaccctgaggacaccagagcggcaggctttgaagggagagcagtggacactcagtgacggggccactcacagtctagctctgaccccaccagatcctgtaggttcctggttcttgttcctggtgaattcctgactatcacctttacacagtgatagagcctttatttccactctgcatggaggcatattgcatttgaaagattgaaacccattgctgtccccattgacagggagcatgttaagggtaagatgctgcatttcactcattgctgggcccccatttctgaatctggacttgtgtcttgtaggcattcaagaagtagcagttggaagaatgtcactgatggaattgatgtctctgtgtacacacccccagatcaaagaccatgcttcttggtctagccataggaactctccacccttgagactcagccaggacgtggggcccagcctttctttacctccctggtagtgccctttttagagataggcataaaatgacagtgctgcccctcaagtctaaaggagggggcaaaacgtagcgtcctgtgcttcaccactgggggctggctgggccactgttaaggtctgtggagacttctgtttgcaggagaggttgatgaaaacccttggctttagctgtggccagaggatccaggctttaccttgtatgctccgagccctgtgcctggcaagtctgccacatggttatggaaatgttcctgaggcatgaaggaggcctttctggaccagccgatggggagtgggtgaggaggtgtggaggaggaaagaaagaaaactctttccccattcttttttttttttttttttttttttgagatggagcctccctctgtcgtccaggctgtagtgcagttgtgcaatcttagctcactgcaagctccacctcctgggttcaagcagttctcctgactcagccttccgagtagttg

SEQ ID NO: 8524 - DNA, 1025 bp, Homo sapiens
tttcagcactggggtgcatgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactgaggtccttttaggttttcagaagactgagaattcttaggaacctagacagggcctctgttaaggctgagcaagctgcggtctgccttcctgtctcttctgttgggcagtcacgggggtgctgatgccaggtggcttgtgagccttcccactttgcactgtgcctgcactcgggtggctttttatcaatccgatactgttgcactcacgtcccactttgaggctggatgaagtcaagctgcccgccttgctgccaccctctctcattccagtgtctctgaccacactctcactaggccctctggaaatcccctgtaggattttggaggagcattctgagaacggttctcttgtatacgctcttgttgtcaggacacttgagccaaagttgttggtcatttgccccaggagccccttttcttctgcacgctctttttccaggggatttcagggtaggttcaacactttaagttaccccgccccctttttggtatttgtagtggcttacacgccccaggtaactgaaaacttttgttggcttattaggggcatttccacattggagctgtaatccgtggagatcaggaagacgttttctttgggtgacttttttctcctggtgatgcagtgggccagtgcaaggaggagggtgagtttagttgctatacacaagccaggtacaagacttccagagtgagagggataatttacaccctgtggctatttatttagcacatcttttgtgtgactctccagtgctagggacagggatctcaagatgagtaagacctggttcctgctcttaagatgctc

SEQ ID NO: 8525 - DNA, 1049 bp, Homo sapiens
tctccttggcttgtagatggccgtcttctcattgtgtcctcacacggcctttcctttgtgttcacgcatctctggtctctctttctctccttcttcttccttcttccttctttctcccttctcccttctcccttctcccttctccttctccttcttcttctcctcctccttcttcttcctcctcttcctcttcttcttccttctcttcctcttcttccttctttcttccttcttcttttttttttttttgagactgagttttgcccttgttgcccaggctagagtgcaatggcgcgatctcatctcagtgaaacctctgcctccagagttcaagcgattctcctgcctcagcctcccaagcagctggtgcctgccaccacgcccgctaatttttttgtatttttttagtagagactggttttcaccatgttggccaggctggtctcgaactcctgacctcagatgatctgccctcctgggactcccaaagtgctgggattacaggtgtgagccaccgtgcccagcctaatctatgggattttgaagacaatactgtcacttaatgacttacaacacatcctcatgagacctaataacagaagttctgggttctgtgttaatacgggacttccttttgtgaaacttgtaatacactcaggagaaatgtgtgacaaataggattctactttttaggggcatttggagcactgtattgtccttgggtaataatgcttaatgtggacgatgctacatggcctccaagaatatccctaggcccttgatcctttaagggagaaaaccaacctttacttttcgattgtgtaattgtgatcagaatagcctctgagatataaattccaaatatatctgaattggttttctttaattaagaatacttttggattcaaatcatactggcagcaaattaaagacatgtttcatgtgtttactaaatgttaatgatgggattactttgaagataaattttaacattttaagtaaaacgttcatgtaaaacaaaagtttattatagattggttttaaaatga

SEQ ID NO: 8526 - DNA, 1061 bp, Homo sapiens
aggtgagctccttcattcatttattaaaaccatttattgagcgagacacggaaagaaaaaaactatttcatgatctcacttatacgtggaatcttaaaaaaaagtcatacatatacagagtagagaaaaaacaacaacagaggatactaagaaccagaggaggagagaggaaacggatatgtaggtcaaaagatacaaagtagcagatatgcgtctagaggtctaatgtacaacataaggactatagttagaattatgctagacacttttaggaggattttaactattgtcgtcacacacaaaaaattactatgcgatgatagctatgttaatctgtttcactatggtagccattttattatctatatgtatctcaatatcactttgtaaacttcaaatatatgcagtaaaatttattttttaaaaaaatggctgggcgcagtggctcacacctgtaatcccagcactttgggaggctgaggtggacagatcacctgaggtcaggagttcgagaccagcctggccaacattgtgaaacccccttgtgtctctactaaaaatacaaaaagttagccagacatggtggcgggcaactgtaatcccagctacttgggaagttgaggcaggagaatcacttgaacccaggaggcagaggtgagctgagatcattccactgcactccagactgggcaacagagcaagactccatctccaaaaaaaggaaaaaaaaaaaactatttattgagcacgtacttaatagctaccagatctggggtcacagagaaccagacaggtgctttaccatggagcagtcactattctaggaggtggatgaatagtctgtagataagtaatggcagtgcagcagtagcaggggtgcatgctcagtacttgaggttacaaagcaggaaatgactaactcagtttggatggctcccacagacattggggaggaagtgttccaggtagggtatacaggaatgaataggactttgcaggtaaaagagaagagaaagaacatgtaaggataggtggttccacaaaggcatggaggtatcttt

SEQ ID NO: 8527 - DNA, 1033 bp, Homo sapiens
aaaagttactctcctgaaaatccgttagaataaattctaaaggtcagctttatgcttctactaattggcagttgttctcaatgtgcttgtttgtggactagatcacccccaaattgtgtagacttaaattttagtaaagaaaaaaattgttctagtgaaagtctaagatttctacgtagatttgaacttgaaaagcataggaatgattactgaattcagtccagtggttttcattgagaacctaagtgtgttctaggtccttttgtagacgttgggcacatagaattgaatccagagtttctgttcttgaggaacattgaacttttctgttatttttccagtagatatccacagctagggggctctgcagtagaaattaaacaggatagtgcagaggctgcccaagtgaaaagaatgattcattctgggagtgagggaattaaagcttcatggagaagtgtcattagaactaaacatagttgaaggcagagaatttccataaagttgggactatctgggggaccatgaagagcatcatgtaattggggacatgcggtgggaggtaagactggaggagcctaagggaagggccctcgattatcccactgaggagaagggattcatctgtgggcctaggggcatacatggggttcattcaaatttaccctctggaaagacctcgccagccaggttttgcaggatagctaataagagggaggccaagctggagtcagggaggctaattcctgggctgctttaagagtggggaagagagtcacaggctgggaccaggggccaacccacaccccctggggctgctccgtggcacttagcactcatccttggctggctccctgctttggtgctctctgcctgctctgtagtctttcctactcattgtgtttaaagaataaattataagttctgtccttatgaagtctgaaaagtgttgtgtgccagaacttttcagaaagattttcaatagcagcatttaaaaatcaacttattaaaattgggttctcttaaagtaatg

SEQ ID NO: 8528 - DNA, 1025 bp, Homo sapiens
gcaaacattattctgtactttttcctctacccaccctccgtcttcaaccaaaattaatcttcctttctttcctaccacccacaatgtattttcttgccacttacttcccttagaaaatcaaatccagtgaaagctctctcttctcattttgctcctagatttttgcccattgtctttttctttttcttttttttttgagacagagtcttgctttgtcgcccgggcgggagtgcagtggcgccatctcggctcattgcaacctccgcctcccgggttcaagcgattctcctgcctcagcctcccaagtagctgggattacaggcgctcatcacgacactcagctaatttttgtatttttaatagagacggggtttcaccatgttggccaggctggtctcgaactcctgacctcaagtgatgcgcctgcctcagcctcccaaagtgctgggattacagacatgagccactgcgcccagccgatttttgcccaattatctaccatgaatttgtgcaatagccattggcaccaacatgagacttttcctctggaatttttagcagcttaagatagactcggccaacaatttggtgaccttggatacagaccctgactgcagaggagagatacgaggttcaggacatataggggatggttgaactagaaagggaataatgcgaggagacagtgaaccaggagcagagaagctgggagagtagagacaaagcgtcagtagactgaagctgagattcaagagctcggtaagatggaaaaaagaaaaaaaaaaaggcatttgtggccagagcacagtgattttggaaattaaatttatacattcagagttgtggggattttctcccccgccccccccggggttggggcattttcaaaatatctaggacaaggctgggcacggtggctcacgcctgtaatcctagcacttcgggaggccgagatgggcagattgcctgagctcaggagttagagaccagcctgggcaacacggtgaaaccccgtctctactaaa

SEQ ID NO: 8529 - DNA, 1034 bp, Homo sapiens
ctttcttgctgttttcagaagctcacggtagccacagccaaggtctgggaagcaccaccacactgtgggccatctccatcttcccatgaagatgggccaagccacctctggttcacttctcgagtgtgtttaggtgagtgtatgactcgggacaaaactaagaggaaaggaagtcttcgccgtgccctccgctcggcaggaatacatcttaggcagtagatgtattcacgtcaggctctggatgtgtattgaagaaaaacctgtacttgctgacattgcatcatcccagtagagcagaaagagacctgagcccctctgattatgtccagtcgccggtgactaatttatgagctacatgtgctcccccggggccattttcttgttctcgccctggtggcctttatgatttgatttctgaacaggccattctttccaaactgctgttccttccaataggcagagagcttaaagttcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgctccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatataatctttcctggcatttcccaatcttcagggggagttcttttgcatttatgacatatacgctttctcctcaaagatatttttattaccttgtttttaatttaactgaacgaaaactaagattggagacaatttctcaggcttcagttggaaccacttgccaacagtgtggtgatggagaaattaatgatgggagccagggcactgaatatgtagataaagataattctgtgtgaactgagccaggtctggattttctttataa

SEQ ID NO: 8530 - DNA, 1060 bp, Homo sapiens
ctctgtctgccatctctctgttcccagcgtcaagccttttgtgcagcaggcctaccccatccagccagcggtcacagcccccattccaggtgagtgtccctgaaactcctttttgggagcacagccccacacagctgacagctgggtctggcactttgttcccagagtcaagagatgctcaactttgccacagccgcacattgcccctgacttgcaggatccttgggtagcctgtagctcaggagggccacagggtcccgattcccatcagtcatctcccaagagcttttcagatggtttgtttaagaaacaggaagcctcctcactttcactgaagacgctggattatcctcagaaggcgaagttgctgcagcatcttcctcaatataaactggccaaattaggcagtctaagtctcaaggccagatagggtttcattcaccctttcttagataagtagatttcggtcctgctacctttctttaaaggagagagtacatggaagctcaaagtggaaaacatgaatctgtctagcctacctgtctccttccccacaaggcgcaccccccatccccacctgtgtgtgtagaattactcctttgcactacttgaggtgtacagtataaaagtcactgctctcccttatggattccccaaactgaaaatgctttcacgtattgccctgtgcccgagtgctacggagcattcagagagaatattctatagtgctagtgaccacagtcttaaggaagatgggcaaacacaagaagtgcatggcatgttcgggtctcacaggaagtctttggaagcattcacttctcactgtcctgtcattcttggcttggtccccaagtagaccccttggtgcaggattagatgtcctcatactgcagcccttaaccttagctgaagttggcttaatgaggaacacatgctttgtgcttatttgactgtttaccatcactggggccctctgccagcatctgtcgtctgagttatcctggccagagccggtggagagggggctgttggcatttccttctgggtcatctgtagagcc

SEQ ID NO: 8531 - DNA, 1050 bp, Homo sapiens
tttttcatcagccatgtatggccttgtagatcttctctgtgatctgtaccccagtcctaactttgcactgacagtgacatattgagcagcccttatgtagaagttttggattggttactaaggggactggtgacaaagaggctcagcactcttattcctgctggaagaaggaagtgggtaccattgctcagaccactgtatctacgctgtcccaggagagttgggacaagaagtgcattctgggttatgacatgagctaactgcacacagatttcttattgggctccaaagagtatcactttcattttcagttgggtcaggtgaaattgggtaatacaattgtttcttggtttggtagctgggtaacttaagctgttgttattaatgtgtccgcaaaaaagccttttttagatatttcggaaaatatatgcccttgtcagtaaaaagcaatgattgtctcaaccctaagctataatcgcttttctaaacatactcatcatttcaaaagcattgatcctggactggaaggcctaattccagaattttggtactactgctctttatccagttcaagatggatgagttccaggttgatcaaagagtttgtaatgggaatgtttctgttggtttcttacagtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggtgagtaagacattgctgtgatttccgtggtttttgtctgaatggtcacatctcttacatgagcacagtgcagcacagctggctttggatttacactgagtgcaccttcatgtgcttctgcacaattgccaagggagcacggactcacacctgtgaactgtcctcatgccggccttatgcatccacatggtgcacctgggtgacattctctgtccctgccaaagggcacaagggacaag

SEQ ID NO: 8532 - DNA, 1104 bp, Homo sapiens
ctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatccgcccgcctcggcctcccaaagtgcggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggagcaatacggtgcctcacacccgtaatctcagcacttagagtggctgaggtgggcagataacttgaggccaggagtttgagaccagcctgggcaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctagacgacagggccagaccctgtctcaaaaaaaaaaaaaaaaaaaaaaaaaagtgccaaaccgcacaaaatataaaatctcatttgagtgtcagatccacgtacctctgcttcaacaaccaccacggcagtccacatttatcatctctcgcttggactgctataatggcctcctagtatatatatatatacatactttctgctctcttccggagtcttctccgagccatggtcagaggtgccttttggaaggcagagctggttgtgccctgtcactgttccaggcctgtctgctcactgtgtcctttggtctcaggatatttcacctctccagctctcctgccatcctctctctcttgctttctctttagcgcttctttctggctctgtgccctcttctctcttatggaatgcttctcttgcctaagcctcgtcttctttcttgggatctgagttgcatcatcattagaagtgtccctgaccctgggggcc

SEQ ID NO: 8533 - DNA, 1049 bp, Homo sapiens
gatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaa

SEQ ID NO: 8534 - DNA, 2053 bp, Homo sapiens
atccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatg

SEQ ID NO: 8535 - DNA, 1034 bp, Homo sapiens
tacaccttcctgaaaactcaacagtggacttcagcttattcaaaagtgtgtcacttggtcacgcctagctgcagggcagggtgcagaaacaagtgtttatagattttccagcctccctggtggagacaggcaagagagaaggggcctgggaatggtgttgggaattggcttccccaacagtgtttgccacacacactttccagagccacatgcatttgctcgattccttccagaagtgactcccacaacccaatatagtgcttcaactgtggtctgattggcctgaggttgaatgggactagtgccttccttgccaaaaaagccatctgattagtactgtatcatttggggcagctgcagtactgcctcctcccccttctctcctgaatatgaattattgttaggtcaggttttttacatcttgtataggtgcttttttgaacttaagataggacttctctttcatttctgtcaaaacctgtttgttgaatggccccacagtccagcttgtcattagtgacccttggaatctttgtgtgacttgtagatccaatacatgcctctgtgcctttcatccttgtttattcataaattcaacaaacatttttgtttacttactagatgcatggcattgttctaggaacatccaaatcaatgataaacactttagggtgggaccaggctcccgatcaagtgagtgatagtcttttggctaccactctcaggacacagttattcaaacacccaactttgcccacctctccatccttttcgtaaagatgtccgtgttctcagagaggatttgctgaggttaaaatatgaccgatgcctgtagcatctcgagagctgccgtcggtgccagcttcatgggcatgtgacctctgcagtttcacaaggccccatgcttggtttaatgccctgtcaccatcttgaaaacgtaatttttgaacaaggatccctgcattttcattttgtactgggccccacaaattatgtaactggtcctgattcccatactggtaacagatctgcag

SEQ ID NO: 8536 - DNA, 1050 bp, Homo sapiens
aacagaggccagcctggggactggtctcctgtaggattcacaattaattggtaatagacctggaccaaggacccaggtgtcccaaatttactgctgcctactgctttccctcagaatatgcacaggctaataatttttctggctactagagacagccacaacatgctggaaaaagagacagcctcagctgtcttgtggcctcagctgctgcagcttctggcatttggttgtcctgataaaaaggaggcagcaaaaactagaagccttgcactgaggtttagatttataccacattttaatctaattaatgtggttccttttttaaagacagatctcagtctgtcacccaggctagatctagtgcagtggcgagatcttggcttactgtagccttgacctcccgggctcaagcagtcctcccacctcagcctcccaggtagctgtgaccataggcatgtgccaccatacccagctcattgttctgtgtttttggtaaagacagggtttcaccatgttgcccaagctaatcttgaattcctgagctcagacaatctgcccaactcggcctcccaaagtgctgggatgacaggcatgaaccaccatgcccgactggttgcaatttttaaagccccctcagatttgatttcttgtgataatagtccctttacaaaggctttgctctgtttccctctatttttatagccttgattaaattcagatgcctgaaaaaaagagagaaagatccacacagtgagccctctgaaaatccatccagctcttttgcctgcagctttgaccttgctctcataggctgtagcagggtttatccattgcaaagttgcaattaatcatctgaatggctttttcttctttaaatattcctttattcccttttagggcaacagctattttggcatatttaccacaagaacttctaggcacatcgtgttatgaatattttcaccaagatgacataggacatcttgcagaatgtcataggcaaggtaagctaggatgtatgaaagatcttaagttgaaagtgtccccttg

SEQ ID NO: 8537 - DNA, 1035 bp, Homo sapiens
aaccaaaatagcccagcgctaaagagaattcttgagaagacttaactttcttatggctcaaggagcttctcagtgcggatagatgtacctttactttacaggaatgcaggagtagagctgtgaactatcagagtgatctggaccttaacaaaacattcactttttttcaatcaaagagctgcccaggattagtactagaaaccaagcagatcagctagttattactagctgtcttgggagagacttcctttccatatgaaagagaaggagcttagaagcagtccacctgggtctgagtcctgggcctgtctctctacctggctatgctgagacttacttaacctcttgctctctgttgatttaaaccataaaaagaaagcactatttcccaagaattgtgttaggattgtgagggcactcaggaaagttccaggaacacagcctgacatatagtgagtgcttaaaaattaattaaatctgtctttaagagcagtcgagagggaagcagttatcataagtctgtccaaatttggggaatagagaaggtggtaaccagattcttcagaacgaaacttaatgtaacataagaaaaggaagaaaacactgctgccgctggattctctcaggagaattagaggctggcctgttttccaattggccataaaggggctgttatccccctataggtaacacagctcttttccaaccccacaggattagtgggtgtgacttctgcatcaggaaggagacatgagggtagtgtgcagtgtaatcaggttcaaaccctatactttgcatttgcataccctgtattttgcttgagaccatccaagaacagtatcaaacagtccttgacctcaagaattttaaaatcttttataagtctattttctttatgataacaggaaaaagggagggtgcatgggccaaagcaagcaaaagaggaaagatttgaacttggccttagccagggtttgcaataagagtggatgttccctctagaaaagccagggctattcttgagtgggcatgtga

SEQ ID NO: 8538 - DNA, 1049 bp, Homo sapiens
tctgtttgaggataggacaaaaggtttgtgaagagttatagagtcaaggacagaagccaaagagagcatttgctgtgtaacatgtttgcttgttaaccagatcagcaaagcattttaactaatggaccattatttatgatctagaaacaattttgtgaaagcgatttcttagtgatgctgtttactgtgatcacatttgcccttagtataacaatacctaagtgctgaggcgacttgcagtagagaagtaatctgagtggcgtggagtgaatcagggaaggtttcctgaaagaggtgagttttgagccatcatgtgaactagaagttgggatgtgggttattacaagacatgaggatgacattccagtagtttgtacttggtataagcaactgtggacaagagtgacaaattaaaaatggtttttaaggatgattgaagattcgaatgaagatttaggggtttggaaatcaaccaaggctatgttgcagcttagctgataaataattttttatgttggttaggagagaaaattaacagttgataatggattggagataggtagtaaaggaaagagcataaaatatttgatagttataggagaatgaagtgaaagtaaggttattgagaggtaggtttaacagtcaaccatatatcataagttggaaacatttttgagtcctgtgctagagtatattgataataatagcaaaatttattgggtgctactttgtggcagacactgttttgaaccttccaaatattatctcatcttctgattatctgtattttatagatgagggagataagactcagagagatataacttgcccaaggtcacacagctaggaggggacaggtcaggattggcagaatcagtcagtaaatgttaattgagcatctgcttgatgccaggcactgtagtaagtgctgggtgttcaatattgacaagaaaattcaagtcagacctcatctattttctagagattgtcagtttatgtaagaagagccagtgaagaaagaaaaagattagttggagagatttctgtag

SEQ ID NO: 8539 - DNA, 1017 bp, Homo sapiens
aatgtttgtgaaatggttactatgtcttaaatgtatctcaaaattgatgaagcatggcatatgcctgtagttttcacacataagtatcttaccaatttgttgtgcactttttcttcccagccttccccatcttatcctattatttttttaaatatgatttaataaataattgaaatatatactaccaataaaataactcattctctttcattagttaacattacagtgtacagaaaagcattatgatgtagaaaattcaaattgggccgggtgcggtggctcacgcctgtaatcccagcactttgggaggccgaggtgggcggatcatgaggtcaggagttcgataccagcctggccaatatggtgaaaaccccatctagtaaaactacaaaaattagccgggcgtggtggcgcccacctgtagtcccagctactcgggaggctgaggcaaaagaattgcttgaacccgggaggcagaggttgcagtgagccaagatagcgccactgcactccagcctggacaacagagcaagactccgtctcaaaaaaaaaaaaaaaagaaaaaaagaaaattcaaattgaactgtgaatcagcagatctgagctttaattttggttttgttagctacttgatgtgtaacttgctaggcaagtcacttcccctctatgggctttagtttcctcatctgtaaaatggagggggaggagaaattttaagcccgtcttccttgaataggttgtatgccttctttctaattaaaaacatagatgccctagatgcctttcttaaaaactgtattactgcattttacaatattttcttttaatcttccttctttcccttcttaatttagtagagaggataaattatttttggtatcctacatttaccaggacagcatatcttaggaagcagggacccagaaaataatgaatgagtgaatatatgttttatttgagctaatgaaaaattttttaaataaagtaccgtcaaaaagatgttgaagtttcattgaa

SEQ ID NO: 8540 - DNA, 1018 bp, Homo sapiens
actagattattggtaaattggctaagaattccctgaaatgttataccataatgtttttactttgccatcatatactccttccatctttaacataataacccatagttacaagatttattagggtaggcgtgttttaggagcttaattccattccacagttggaaacagatattaagaatccacagttcttaaaacattttcctcatgcttttttatacctttctaggatgatctttgcctaacagcatttagttgcaagctgtgtctatgaacttggcaaagttttaaaaataaactaggaaaagatttttgagaagagagtttgttatgggatttagtcatttaaatacattcctaaaagctgttttttccccactcaaaactagacactggaaggatcattgacatccaggttcaaagaagttactgcttacatgactgatcccgattctgagttcttttgccacatttggttcatgtggaaaggctggctggggctaagacttgcccgtacattagcgacatcatagccagagtgaggacccttagaacagtgcctgtcaagcttttttagtcctagccttttggctgagtcattctttagctcaataatttctactttctaatggaataataacacttgtcaaggtataagcattttttgggaagagctatatggatggttcctaattgaatcacaaaaaatatgcttgtcataaagtctagactaattagaaaactgcaggcctcaaatcctagtgatggaattgtatcaatatattctctacagttataataaaataaccaaaaactaaattgataacgatgagccaaacctaatggtaatttaattaaaaggcaagaataatgacaattgaaaacgaagaccaactaaagacaacacagtttcactgatggcaagtgcccctcttgaaagttacggacttctacgttttgagtatgcatatgtggtaggagcttgcagcattgccagttgcagcaactggatatactagtg

SEQ ID NO: 8541 - DNA, 1047 bp, Homo sapiens
aggatcttgtctttaattatccagaagtttctaaaattaatgaaacaacatgattagccttccattaatattagggcatttattaagagaatacaatcatgttacaaaagtgcaggtttatattgagtggggtgttaccttagaagttctctgtgattctccatttgtggtcatttcaggctcttttggcccatgagacctgcgtgttcttttgcaaatgaggaaacaggttcagagtagtagctttatcttaggatctcatagctgctaaattgcagagtttggacttgaactcctagcaagtaaatatatcttaagtagctttgtattatgtttctcttagtgcatttataaatgcaaatatgtgataattttttttacagccactaggaaaacccactttgtaagtaagcctaagtgaattccttgaaaataatggtgatacatggtactcagcattttgctgatcttcagaaagattgcttctttaacttgagtcaaaagataaggtgtgttttgaacaaaatagctagctacgactgctaggtgctatttcctaaagcagctcaagaacagtgaaaataaatgtaaattacctttcacagtcctgtcgtccccttccccaagtgtgtgggaatgctaatgctgcagcttttctcatattgcagtggtgcagctacttttcaacagatgacaggcgcttgtagatatcttgctgtgtagcaggaatctgaacagcatgctctggaaggattgtcagcattcctttcatggcttttgcttttctagttgcttctggccactctggcaggactgtggaagataggacaagtctgaacttcccttaaaagaactctcatttttattggctttgccaataagtttgtagggtgaagtgtattggttgaatggggaagccaagaatacatttcttttcaaattagtgcggctttcctttgagccagaggcagagtttaaaaatatttagtgcttgtcatatacaccatggaatactatgcagccataaaaaatgatgagttcatgtcc

SEQ ID NO: 8542 - DNA, 1120 bp, Homo sapiens
atttcattttttctatatggataattgactctgcaccattctcttcttgtcccaataccacattcctgtagctttataatacatctcaatatatggtaatgtaagttctccatctttgttatttatgtttgtcttggctaatcttggccctttgtatttccataaacattttaaagtctcagtttccatattaaaaaaacagcgtagattttgattgggattatattgactttaaggatggtaaattgacatcttcagtcttccaatctaggaatatagtatatgtctccacttatttaggtgttgtttaatttctgtcagtatttagtaggttttagaatagaggtcttatatatcttttctatccttttccaattcttgatggttttttaaaaaataatttattgagatgagattcacataatataaaataaccatttgtgtctgttttgtgctgctataacaaaatatcttagactgggtaatctataaagaacagaaatttatttctcaccattctggaggctgggaagttcaagatcaaaatgtaccaattgttttggttgtctgatgagagctgctccctgcttctaagatggcacgttgttgaaccctctatgggaaaggaatgttgtgtcctcacctggcagaaggcagaaagaaaagcaagagagcaaactagcacaatgttgagtgaagccacttttatgaggcccttaatcccattgatgaggaaggagccctcctgcccttatctcctcttaaagaacccttctcttaatagtatcacattggcaaaatctgaattttggaggggacacattcaaatcatagcaccatttaagtgagcaattcagtggcatttagtacattcagtgttgtgcaactgccacctctatctagttccaaaacatttcatcattcgaaagtaaaactccttaagcagtttctctatactcaactattcccctatgccacaggcacaggcaactaccagtttgcattctgtctctgtatatgtatctgttatggatatttcatatgaaaggaatcatatagtatgtgaccttttgtgtctgacttctttcatttgatatatttttgaggttcatccatgttg

SEQ ID NO: 8543 - DNA, 1045 bp, Homo sapiens
ttctattgcttttcattttggtctttctttattttgtaggtatttttcaaatatctggtgatccgtggttatctgtttgtatttataatggaatagggtggttggttttggtagctgatagtggcttcctctagttttttgaggtctgttttctcaaaagagcttttccacagatggtatgattgagaactctgcgtgagtttcctttaaggtggggatatccaagcttttggcttccctgggccacattggaagaagaattatcttgggccacacataaaatacactgacactaacaacagctaatgagcttaaaaaaaatcacaaaaaagctaatgatgttttaagaaagtttatgaatttgtgttgggctgcattcaaagccatcctgggccatgggttggacaagcttgcattaaggccggcagcagaggctgaggacttaaaatgtattctgagcgctataaatgcttttttcttttgtttgtttttgtttgctctctcctgatccactgcctcctccaccttcgtttgtggatgtttggagcaaccatcaggctcaattccagttctcttttgtccctagtacccatgctggatgctcttctcaatcagatctagatactaagcctgggagccaaagtttatgcagaaagtaagactgtcatgagtagctctgctgttctgtgagcaatcttttaattatcttgatttccttatgatttagtccagcttttggatcctgaccttgatgttttctcccaggttccatttaggagattggtaaaaagagctcttgcctcattatagtcctttcctgtccttgttttgcttgggttgctgtttcttctggtatggctattctaccaattcagtcttatctgtttcttctagaaattcttctgtttcttttctttcttcctttttgtttgacttggtttaatggagctattttttccaggttgttatgaacatatattttttaattatgaaaaatttggacataaatcacatgtatctactccccagcttaaataaaacataa

SEQ ID NO: 8544 - DNA, 1050 bp, Homo sapiens
cctttggaaaaatattactaagaaaaaatggaaatgagctagaataaaattatttcacgatcataagtttgtgaattctctcaaaatgaatgaatttatctgacatttactaataaatagtaagttgaatcggaaggctataagctcaattttggtacacataaggaatctgactgcaggcatatctcaaaaaggaatttcaagtagagcatttattttacaattagaataacactcatttgaatatctacattcgtataggcctcttaaaaaatcctgaaactgtagcaagcctcttcatagcaaccaaccagacttttgactttgaatgaacttcatatacctttatagatagttctttggaattaattgtcatatcacatcagcatttgtttgacaccatgcaacagatattcctcattatgttggttttattttttaatgatgggatgtaagattctttcttagaagtttaaaaattattattatacttttaaattattcaaattagtctacattagtctcccttaatcattttttctctctgattctttgctgaacccttctggaatcctttgcttcccttaaaacctacaaggaaagagtcatcaatggggctgtaaaaccacaaggcttgttctaagtaaaatgtctacatgtatgttttattgctgtctctgccctttgtttactcatcttggcatttttattatgaaccacttgtaattggtatgttttaatttttctcctgatactcctctccccccagtgaggggttatttgttcttactcactttttattttttagataatatttattgtgcctgcttagtcctgggcacttgacttgttgtagggggtggaattcagggataagtaagatacgttcctggctttttagacagtttttaagagggaaggaagagggagtgatagacgtgtcaggagtagataggaacagatatttaagctgatgtgctggccagaattgagggtctgagtaaaacatgaagaagacttgggcatcttcttcggggtcttcagagcagt

SEQ ID NO: 8545 - DNA, 1040 bp, Homo sapiens
ttggaaaatgaggattagaacaagtttttcctctgagttaatttcaacaggttaactagattaataaatataccatttctgtaattcctggtactttgtcctagtttccttcaaatcatttgtgtcagtttgtagtatcaacaacagtgtattactttgccatttttgtcactaatattgagtatttaaatcttttcgtttgtttgtttttatttttttaattgacaaaggtatatatatttttcatttacaacatgttttgaaatatgtatatattgtaatggtcaaatgagctaattagcatattcattatctcacatactttttgtggtgagaatacctaaaatccactctttttgtaatttttaaaaataacaatatattgatattaactatagtctatgttgtacaatagatctcttggtcagttttttaaaagctgtaaacagaagtttaatagaaagcaaatctatccaccatctcattaccttaaggaatatttgttgactgcctgtttggtgactatgttagaaatactgctaaatgtttgcaagctatttgtttaattttataccagtcttagtaggtaggtttcattattgttcccatttccaggtaagaaaactgaggcctgagtgcttcagtttatgtcctgataagtaggccaagtcaggatttgaacacaggtctgattccagagccttgtttttaatcctgcttcaaaaaaatcgtatgtattcttttggtattattcatacaaatgtttcatatttttatagacttcaaataattattttagtagctatattctttcattgtgataaaatacttactttattgagtcattccatattccatagtgaatatttgggctctctaggtttttattaattacatgatgcttcattgataacttttctgcatatatacttttgcttttgtggaattatttacttcaagtaaattccaagaagggaatatatagattattttggggtcttgcatatgccttgtaacagatgtaccagttttattataat

SEQ ID NO: 8546 - DNA, 1027 bp, Homo sapiens
tcctaagtgaaaattaaaagctgtgacattttcttaagtcagaggagatttggtttgtttcttagtagcaaaaagaggcagaccttccaggaggtagaccccttcctctgtagatcacaaagtaaaaaaggtacagggtgttagggtatttgtgaattcctggaatgagagaaagcagaaatataaaccagttgggtcaattgatttaggcaaaacctaggtctgtgtaatggtagtaagtgatagcatctgttgttgctttgacaattattctatttttctctgttttattcataattttgaggaggatttaccattttccctaatctcaggctattgaattagtaaatagcataaaatcaaacttgaacaagcttaattttgtaaaaatattcaacaatataaaccctcttttataaatttctctttgcagagagttaatggaagagtagtaggtagccctttgaaaatgattttactcaattatttttgatcccagaggaagactgcttctgtttgggactggtagaaatagtctggcctgaatctagtctgttttttagtttttagaagacagctaccaagtatatatttggggttgtagagttcaaataataaatctctagcttcataatgtttctaagcttctctcccttttaaaatttttggtattagggatggattgataactttaatggaccaagtggtctctttattgcggtaagtaaaccttttgatttatttaatattctatacatttttctgctttttgtatatctttaaatatatatacactatggcttatatatcttaaggtgttgtttttaatttcaacaaaggcagggaaaggaattcttcgaacaatacgtgcctccaacaatgcccttgcagatcttgttcctgtagatgtagttgtcaacatgagtcttgcggcagcctggtattccggagttaataggtatatgaggtgacaatgtcgcttattaaatatatagtaactgaaaagggaagacatagcttttgagta

SEQ ID NO: 8547 - DNA, 1063 bp, Homo sapiens
gggactggaggaactttgctgtggagggagtggtaaaggggggaaggggacagagtagctggggtggctgggcatctctctctctccagtagtgtcataccctctccatgtggcctctccatatggactagtttgagcttcctcgcagtatggcagcctcagggggagttggacagcatacacagtgactgaaggcttcaagggtgagtattcagtgagcaagacagaaagctctacacctttctgacctagcctcggaagtcacatcatgtcacttccacctcattctgttggttctaagttattttcaactctcattgagaagacagtcaaggtgacattgtattgtaggtgggcatgtaggatggagataatatcataggcacctttggaaattaatatctttcctaaataggaaacgttaaggaaacagtcttcttaactgaggtttgtgctgtgtgaggctttctaagtatcaaagcaggacagatccttgacctccgggagcttataatctgaatgcaacaaggaatataaaggtttttttacttagacaattttgtaaatgttaaatacaaagtcttataatttataatatttcatttgttcagaaatttattgagcacagtaatagactttacaccttatattggggccttactatgatgcctaattctacattaaactgatgtcagtcatgtcattcatttcatccagtttacttgtttacataataattctgaatgtgagctagataagcatctgacctgacattttttaaaaaatggctccatgatcttatgttttggttaactagcataactttatctagcttaacttctctaaaccaggtatctatttttaatctgtgtacttctcagctggagacatttgacaacatttgcaggtatttttagttatcacaacagggggagggctgctaccagcacctagaggccagggatggtgacaagcatcttatagcatgcaagatagccctccacacgaaagaatgatcagacccacaatatttatagtgccaaggttgagaaaccctggacta

SEQ ID NO: 8548 - DNA, 1077 bp, Homo sapiens
actttttaagactttcacattattatccctctcatgcctcataactctgtgcgactttgcagggcagccagttctatagatgaggaaattgaggcttaggaaagttatatttgcctaagccatattgtattgagtggcaaagcaaactagaatattgatctttgactccatattcgaacctcttttctctacatcatttttcttacattgccgtcctatcttgcactgcctgctgaggtcagtataatttatgtaacattattacatctctaaaggtttgtatttctttcaaacaccatcagaaacatcaaaattttttgaaacatgagctgaaacatgagagtaacatattgttactctttgagaaaagggaggatcctcctttatcaagttaatgccatgttttatgcttggataagggcttatccacttggcctttgatcttgtgactgtcacctgtaactgaaagagtaagttacttgtctgacaacttgtaagcaactaaagatgtcaaaaaaaaagtttgctctattttgtctgtactgtgatgtatgtaatgaatgaacctttttagattagatgggaagctctagaaattcaaggtacatatctgttttacctacagtatacttaatgcctatcataagtttcaaattaatatggatttgagctttgattaaaaactcagtattaattagctgccatctaacaatatttttttctagaaaatactgtctaacatatctcttgatttgctttccaggttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattt

SEQ ID NO: 8549 - DNA, 1047 bp, Homo sapiens
acatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgt

SEQ ID NO: 8550 - DNA, 1043 bp, Homo sapiens
taattccagctactcgggaggctaaggcaggagaattgcttgaaccctggaggtggaggttacagtgagccaagattgcgccattgcgctccagtctgggtgacaagagcaaaactccatctcaaaaagaaaaaagaaaaaaaaagaaaatgagcaaaattaactcagcagtgaggcccagtgctcaaatgaacaatttgatccaggcaaattgctttcattgtgagttctgcaattgattactaatatctgccatgggccaggaactggggagtggtggtacccaagttatgtatttatcatccctggttagccattcctgctttcttggcatttctttctcaggcagattgtaaatgttggtccagaactttgccatggcatacgatttgtatacagaatggcgattagattttagtcctctttcaccttccccctacacattcccttctttctctcatgtgagccctccaagtaaaattcctttttcagggtgaacaatgcaatattgtacctgacaatgtcgatgatattgtagctgacctggctccagaagagaaagatgaaggtacgttgttttcttttgttgcaggtggcaacataaattgacataaccctttgagaaagcaatttgctaacctgttttaagaaccataaaccatgtgctttgacttggtaatcatatctctgaggatttctcctcaagaaataatcaaaaacaaggccaaggttaggcccaaagcataagggaattggtgaagatatgacatcagaatatatactcaacaacatcaggcctttaaaacaatcatgtaaatctcattttaatgggcttcgcaggattcagaccactctctgcttcgattctcaggccagcctatgaggcaggtgtggatacattcactttcctagcaagcaaagaaaggcccagatcctacaatcaggagggagcgacagagtcatggttcaagctcaagttttcttatgggatctggagccagacaacctggactctcagtagacatgtgatcttgggcaagaag

SEQ ID NO: 8551 - DNA, 1040 bp, Homo sapiens
ttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatt

SEQ ID NO: 8552 - DNA, 1048 bp, Homo sapiens
tacatacacatatatacacacacatataattatttccaaattcacctacagtagaaagcattccttttgtatattttatttatacctttaattcattcctatcacattaatatactcttcttatactgtcttaattacctttcagttattagcccccttttttgagcatctcagtgtgctaggtgctgtgggggaaatataaagatcaataagatatggttctatccctaaggagtttatatctagtagactcagatgtgcagactagctcaccatgagacacaattgtgtaactgctgtgttccagtcgagcacctcattgtggaaggcaaatagtgatcagtttttcgggggagtgtattggaagtctttatagaggaggcatttgaaggacatattatataagacttgattaagtagagacaggcgttgagactggtaaaccatgtgatggtaaaattcatgacattgttgtggaaatcagaatggaaagctagtaaagtgaggagtgtagagttagtgtgggaatgttactggaaaagactggaagattggttgagagtaatgtatggaagatattgaatgccatcctaaactttttgatttattcagtggaagatgttggaagattttcagaagagaagagacattttctttatttagtttagagagattattgacaatgggaaaagtagatcagagaatgaaaatattgggagcagggagcccgttataatcatttatatgagagactgagaacagtgggagtggaaaagccctggtgattggaaaaaaggaggtatgaagatgcttaaagtcttagtgactgaaagtttactggtgtcattagctaatgtagggaacattggaagatgagctggtttgggagaaatgctaaagagcttgactattgattaatgcatgttccagttttcacatgtgaatggttgatacctcttttacatctctaaatgggatgtaaactccctgagtgtaagaactaagcatttctgttttgtatttatcatttacattttggagttcacaa

SEQ ID NO: 8553 - DNA, 1022 bp, Homo sapiens
agagtgtagatatgattaaaacaattaaggacacagtgactttgggaaatacattatgtaggtttttaggagaaagacaaggactgtgggggaagtacctatgtttggtgattggcatgatgaagagtcagtgaagaaaagaggttcagagtgtcagggatttgggggatttatcattaagctaattaaatttaagctccaggtttgtcacttacataaaatcctttcaagtctgtaggaggaaggttttcacatgggcatatgtttctgtaggatttccaaaagtaaggcatttcaatattgccatttctttcattctgacttaccctcatgtcatatggcattagagtggctgcaggcatttttgggatccagctaaggggaagttgaataggatttacatttagtttgggaggcatgtatttatgtggtcatgtcacttctgaatatagactagctgttctggtataggaaggatatcaaggaatactggtgttactcactgtgttaacacttagtgttatgacacaaagatggaaggctagagatcacctggtgatatggacgtgtcctataatgcatcacattagaagtacgtggtaggataagagaaacaaaatttgaaatacacggggccagaagctagtctgggaaaaattcttccaaatcgaatggtttataaatgaaagaaaatatatgagtttctctaaatttgacaatactaaaagtttatgacattaccagtagtagtttgtgaacagtttgtgaagactattttgtaaaatataaataacaatttagtcttttgaaaattaaaaagatatttatagaaaaccttacatataattgccatatgaagaggtgataacaaaagttatgcaaaaaatatgtagaagtatactagaagtgtgtcagggagtttattgataacattattgttattttttctggattcttgtgatgtttatgatgctgtgacttttttttctcattctcagtaagtattcacctttgtatctaat

SEQ ID NO: 8554 - DNA, 2021 bp, Homo sapiens
agtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccc

SEQ ID NO: 8555 - DNA, 1050 bp, Homo sapiens
atctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattgtctttgaagcaattgtgaatggcagttcactcatgatttggctctctgtttgtgtgttattggtgtataagaatgcttgtgtcttttgcacattgattttgtatcctgagactttgctgaagttgcctatcagcttaagattttgggctgagacgatggggttttctaaatatacaatcatgttatctgcaaacagagactatttgacttcctcttttcctaattgaacaccctttatttccttctcctgcctgattgccctggccagaacttccaacgctatgttgaataggagtggtgagagagggcattgcgacactattaacagtagcaaagacttggaaccaagccaaatgtccaacaatgatagactggattaagaaaatgtggcacatagtgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatactgcgcttttcagaccagcttaaaaaacggcgcaccacgagactatatcccacacctggcttggagggtgctacgcccacggaatctcgctgattgctagcacagcagtctgagatcaaactgcaaggcggcagcgaggctgggggaggggagcccgccattgcccaggcttgcttaggtaaac

SEQ ID NO: 8556 - DNA, 1054 bp, Homo sapiens
agttctgtcctgggtggaactaggctagttgcagtttctcaaatttcttcaatgagatgctttgcttttgtgaaaataagtcatattgtccactgccacctttgtttacttctccattttatcccctcttggttacagaaattagctactacaaataaaatgccaagattttataattttctatgtttaaatttgcaagtaaaaagttctgttgaaacatttgtaagatcaaactaatgtgagataaatatgactgatattcagaagttgattaatctaactttcagtactgtacctattacataaagtatgattaatctctatgtgcaagtatataaacaaattttgagtataaaatcataatctaaaattttgttttatatttaatggagtgttcaaatactttgtaataaaaacaatggatgactaaaatgattgaataagttatcaaatagagctttgtaaactagggttcatagttgcaaataatagaaatcaactctggatattttaagaactaaaaaaaaaattgaaacgttactgagaagcttacagaatcactgagagggttgtagaactaggctcaataaaaggatcagaataggagaggttaggcagcaaataggaccacaaccaaaatcacagcacatcagtctggtgaatacatgcatggctaccaccaaaaatgaacactcacttgcccctcacgttagccaatgaatgctgtctcttccactgctatctaagaacctcgatgttgctaccatcagtttccagaatggattctctgatactcccctctgcatcattatctcccagtttaaagatgggtgtttctgagtagctgacctaaggtcacatactaatactgtaactacaagaatagttgggaaagtgaggattggatattttcagattgtgtggagaactaagctctgtggtctatcaacactcctcaggtaggtaatttctaagtgtaggaaagttcagatgttgggtggccaaaaatgtacagatatccactacatttccttgtgatagcatctaagttctt

SEQ ID NO: 8557 - DNA, 1077 bp, Homo sapiens
tatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctacct

SEQ ID NO: 8558 - DNA, 1035 bp, Homo sapiens
agcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgag

SEQ ID NO: 8559 - DNA, 1034 bp, Homo sapiens
tgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttattttcaaataaggttataaatctgcctgcatctttccagatatacccacactgctttagtttgaggcactcagcaaagg

SEQ ID NO: 8560 - DNA, 1054 bp, Homo sapiens
agctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagaca

SEQ ID NO: 8561 - DNA, 1086 bp, Homo sapiens
cagcctcccaagtagctgggactacaagcactcgccatcacacccggctaattcagattacactctttaaagccttgagcctagttgcaaatttgtgacatcgaatacctagtttagttgggtaaattcttcttgtcttgaggtctcaggataacgtgggggctcctgggtctgtaagaaagtgacattctttacctaccttgggccatgaaccctgtacaggtatgaggccagttagcccaatgggcttttttttttttttttttttgatgggtcttgctctgtcacccaggttggagtggagtggtgcaatcttaggtcactgcaacctccgccttctgggttaaagggattcccctgcctcagcctcccaagtagctgggactacaggtgcccgccaccacatccagctaatgtttttgtattttaatagagatggggtttcactgtgttggccaggatggtctcaatctcctgatctcgtggtccacccaccttgacctcccaaagtgctgggattacaggcatgagccaccatgcctggcacccaatggggttttattggctctacaagtcaagtttgattcctaagaaaaaaaaaaaagcacaccattccagtcaaatctttggtaaaataactggcatctccaattgtgttctgttacaaaagaaaacagattcttattacacttatgaaaataactatactgccataagttgagtatactcacaaatagtttctaaattctggagaaatcaggtaagagagaaaatgatatgctctgagctttgtttacaagagtatactttactcaatcgctaaaagttgtaaatagctcaaaaggaaaaaagttctcttaattctgaaaaataaaaggattagcaatgtttaacatatcagctctccatgagagtcttagaagttttttttctctattccaatagcacaatttctaaagttatcagagacctgtattcaagagtacccatcagagttttctatcagattataaaccaccttttgaaaagaatcaaaacaagacaacaattatctgtgggtgacaaaattctcaggacgaccatagt

SEQ ID NO: 8562 - DNA, 1034 bp, Homo sapiens
caatgtgtccaaaacagaatttctgtagttcttcatcctactgaaacctggtcctcttcaggtattttagatttcgttgaatgactccttcgtctgggtagctgcacaaggcagacagacctggcagtcatcctcaacacctctctccctcaaaacccatatccaatccgtccccatatcttgttgatattagcttgtaaatatctctcaaatctttcacttctttccatctccaccagcatcatcctagttcatggtaccatcttcacatttctggggtaccacaagagccccctggtacccttatatccacactggctcccctccaatttgttctccacacagcagccagagcgcatttcaaaacacaactctgttcatatcattttcttccttaaaagtacattagttgcctcctattgatcttaagataaagaccacactccttaataagtcctacaaggtcttgcttgcctggccctgctgccctctcctacatctccctacccagcactccctccctggctctccctgccacactggcctcagctgagtctcagtctctagggcttgttaggctccctcccaccataaatctttgtatttgctgttcctctgcttagaatgctcgttcttcctgactccacctaccgaattcctgctttactctcagttctcagctgagttgtcactttcataatcttcaggaccaggtccaaccccattttataaagttttaaaacatgtgcctccttcaagcctttatcatagtttcaattttacatttatttatgtaatcattaatgcttactttctctatatgatgatgagctctgtgagtgttggaaccatgtctggttttgctcgttactttatcctagcaggtatcatggtaccatgttactgacacatgccacaaatatatgttgaacaaatgaatgaatgaagatttatcatctgagtaaccagatagatgatggaaccattcagtggaataaaaatgagaagagaagtagatttgaggaggaaaatga

SEQ ID NO: 8563 - DNA, 1074 bp, Homo sapiens
gtataacattccagatctcttgcttacattatgccaataggaattttggttaggaccctgtcttctggatttctatcccgccaaatggctgatttttcactttgcctgaattatatctttcactcctttggtcttttaagagatttatttatttatttttttccacagaccatattgcctaacaaaatccctcctattttcatggaatcatatggggatacaaagtggtgtcataatgtcatatccattattatattttagtttttacaacaaatgtgccaggtaatcaaatgtatattattatccccagtttgcaaatgagaaaagaggccaagagaagttaagtaacttgactaagcttatgcagttagttactggcagagctggggctaggctgaaggtttcttctctgctagtctgtgtttggttgtatcactttttggacttgggaaggggcatcataaggactgcatgggatagggcttgtgggattcaccaggtgacagaattatcaggatgagagaacctgccaccacatacctgtaccatgtaaggttgaaatgttcttagtctggggtagccctcacccacctggacccagaggtgagggggtaggctggcccctgcgcccagctatgcaaagattagggctgcagcaagccctctgtggcagcttttaccgacagtccagccctgctgtctgctgtgttagcagggtggtgggtatctggccagtgcctcttagttaaccttcccttcttcattttaagaagcttttttatctgcttggtcctggagctaggctggctctttctggctgcagaaaggggcttttaaagtaaccctcttagtttatttctctctgggccaatccagccagatctttgcttggggcaagagggaacctcaagggtagaagtatgtgagcaagaaggagctctcccctcacataccagtcaagaacgactggacattttctgcctccccaaccccattcactttctatttgtaatttgggatctgtgtgtgagagctctgaataggttgccccccatcttcccctcctttctcatt

SEQ ID NO: 8564 - DNA, 1090 bp, Homo sapiens
gacttcctatggtaaaccactctgaggtgctggtgggcctgttcactccagccaggcaaagccttatttggatttcccatggttggaatgaggaagcctgtgtgcatgtcccaggtgtagcttggcttgctgtgtgacctcagttggtgtcttattcttttttttgatttctttctttcttctttttttttttttttcttttagaggtagggtcttgctcaggctgaagtgcagtggcataatcatagctcactgtaaccttaaattcctgggttcaggcagtccccccacctcagcctcccctgtagctgggactacaggaatgtaccaccatgccccatctaatttttctttttctttttttgtagagatggggtcttgctatgtagcccaggctggcctcaaactcctggcttcaggtgaccctcttgcctcggtctctcaaagtgctgggattgcaggtgtgagccactgcacacagcctctgttcttcttttgaacttgtctctccattgtccatgttaacccgtctgtgcttctggctcctcatctgaaaaatggagataacaatagtgaactacctcatggggttattttgaggactaaatgtaaagcatttagaacagtgccttatacacagtaaacacctaagaagtgtttctccctgtctgcctcctcttcctcctcctcattattattattactacaagggggtaatctctaaggcccccctactagttctcatactctgagagtataatgtgagctcctccaagaaggctgcctggacattgcccaggagctgtagtcttagccctgtcaagttgatggacatatttgtgtagatgagattcctattgccttctaggtgaggcctaaaaggtagatgtatccaattaatcaggtggaggcttgggaccttgtctgagctttgttgaaactattttggctccagaattgaggggcggaacaaaggtctgggtggggcccgctctacctgatgcaagtcgttctgggctatccagccagggtctcaggtcctggagaggattcagccctgctctgtgagtcctgaggtctgttctgccta

SEQ ID NO: 8565 - DNA, 1033 bp, Homo sapiens
tctggctgtagttttttagaggaggtaatataagagtcaggtcttgcagggtgagtagaaacttgccaggtagagaagaagaaaagaggtttctaatctgagggagaacttcatgttcaaggctgcagaggattgtgaaagagagtggtatgttcgggaaatggggaggttgaatttatctgaggtgtagagtgtgtttgtggcaggggcgctaggagttggggaagatggacaagggagatgtgtgagaagggaggctggggccatatcacggaagctctctcatcttagcctcaggagttttgacttatccagggaacggtggtatggggggcgcaactgaaggatttaagcaggggagaaacatattttaatatctatgtagaaagccctaatacattcttgggggaatgtgaagcattggggtttttgaaagtcagtgtggcaacatctattgaattacaattcagaacatatgaatgagagtgttgaatgttgcattgtttatagaggtcaggagctgaacaaaaagtgaatgcccaggaatgggaaaatggcttaataagttgtggaatatacgcaatatggaatagtgttcaaacattggaaagagtgttttaggattctgctggaggacttgaaagatttcaaagttaagtaagaagatcaaaatgcagcaagatgtgtatatactatggtcatatttacaaaaaaagcaataggtcagaaaaccttataaatgtatatatacttagataaaagtctgtgtaagaatgcatgagtatggagaaaaatataaaatgatacttactaggttaaagttagttggctgagattggaaggggtgggcaaatataagggaatggtaataagatgcagaagattagaagttgtctgcaatcaaaccgtacatgagatgtgattctacttaatataaaattaaatatgatttcataaggatatatgggcagtagggtgctgtgatttttggatttaatgggtttctctctctctctgtgtgtctgtatacata

SEQ ID NO: 8566 - DNA, 1005 bp, Homo sapiens
tgtctaaaggtgtggtcactggtaaatttcagttgattgttaccatgtgggaaaggcatagacttttaaagataagacaaaaattgtaaacttcatagaaaatttctcaatttataaacattatcaaataaacaaaagtacatgtagtccaagtgacctttcactattgtcatgtattcattcctgcttcactgcccaggctgggtttctccctgagccaaggggtcttcctatttgtttcatcctgatgaagatgcattgtatagtccactctgagattcagcagatatcttctgggcaggaagccagagctctgttctttggtgggaaatagccctccaacttcttgccattccctggaaacatttataaatgagtcactggaatcctcaatttaatcttcctaacacatcccaggtgactcagactgtagttcaaataaatgtgcagcaaaattaaaaggcacttaggtggttgtgttaataattgctgtgtcggcagcaatagcaactgaatgagaatgagggggagtgttaggacctagaaggaatcttacagcaaagtgggccactgagctctgcagactcacccaaaaccatggatatagggaggtggcctggaaggggctggggactccagtgattttcccaaaatcagaggataaggcaatcattggataaagggaatcagagttcttaataccttggctaatctgtttttccagtcctgggtggttggatcaagagcttgaattatctaatggtcaaacctgggctgtggggagcaacattgcccagagggaggcattaccctcctgatagaaccaaaacccacatctgtggaagcattgctgggaataagtcagaggctgagagaccagaagcaacttgtaatgtagaaagaatgggaactttggagtcaggcagacctggatttgattctagcctcaaacagttacttactggccataagaccaggagcaaatcacttaacatttgaatcctc

SEQ ID NO: 8567 - DNA, 1028 bp, Homo sapiens
ctagatattcccccactctttttgcttccaggggtgggagaggaggggcaccttgttccctgctgtgtatatgctcaggaagagggaagaaattaatatttatcaagcacttagcatgcattgtctcagttaactggtaaacaggtctaggtaggtgcacagctcacatttagtttcaggttgctctatcagcagatctcaatattaaagcacttcgtttattcatttcttttcagccaacatttattgagccctgtgccaacctctgtgttgtctgctatagatacagagaaatagaaaacaagatccttactctcgaggagctcagagtctagtgtgggagataaatacctaaaagctagttatggccaagtgtgagaagcttgaggtcagcccaggggccctggttgcacaggggagggagggatggactgtctctgcttcaggataattggggaagccttcatgggggaggtgacaataggcaggagcaggaagtcacttcaagtcacaagtaagagtatgagcaaggaggagggggtatagctcagaggtagagcattgggctgaagattaagaatatgagcaaggacacatggacacaaaatagaaatagcatactcattgctcattgtgtggggagctggggagtgattttattctgccagcacctctctttcctgttcatcccccttgccaggtgttgaatttctcagtagcagaatccctgtctacttttacaatatgttctccctctcttttcctcttttttccatagtgctttctatagcaccttgctgaatttatggatgaatgaatagttcttgctgttctaaggttactctagggatctggaaataataaagaccattattaagattattaacagctttcagatgacatctatcttagtgatcaaggtgcaaataaagctagctgaccaagagatgtggttgctatgttgaccaggtgaccaagatggtgactgagatgccaagtggctaacatgatgatcaacccaaattgtc

SEQ ID NO: 8568 - DNA, 1048 bp, Homo sapiens
ttatttggcaaatgatcttaggaaacagtgagacactgggaaagtgaacaaggtaagcagaaaagccagtggaagttgcattattgtgtgtgcgttactgctgtgggcacttgggcctaaaccccaccaggaccgtctgggaggttgatgtatatgagaacacaggtaacctccaggatgggctgaggggataccagaggggcaataagagcttatcctaccctcataaactctacagtggcagaaatcttgggggatcaaggtaagaggaagcactgaagtgagggatgaaaatgggcaacaaaagtcaaacttagcttttggtaattttgcttgggccacccttgggatgtctgatggaatcgcagattctcagtgctggagtgggcattaccagtcatgggatttgacctcactcccattgaggagattccctttacaataacccatgtcctcagatttgtcctcagggttggtctacagccactgcttagatacactgcctgctgaggctgactgttttattgctgtacacctctaatcatgaaaaagatctttatgttgattcaaaatttgacttgttgggtcttccacccaggagagctagttcttttccttgagccctcattcttccttaagagatctactttggcttacacattgcttttagctttgcaatcccttcctgtccctgccctaaaagctgtggctctttggaaacactgtatccagctcccatggggctcctgtttataatggtctaggaagtaacttaagtggttttagaatgaaatatagctgaactgttaggggcaatttaagcatatggaacagaaagaagaacatctactcaacaaatgccaaataagcactaactttgtgtgtcagatctgtggccaagagtctgttagaagatatggacacacaatgataaactacaatgtccaggataaaggtcttgaaaggccatttctagaaggagcagaatgaggtgtgccatgcttaccaaagcctgaaggactacctgctctgagcattgcaatttcat

SEQ ID NO: 8569 - DNA, 1116 bp, Homo sapiens
agttgaatatgagtggtaaaaatgggcatctttgtcttgttccagcttttaggggtaatgctttcaacttttctttgttcagtatgatgttggctgtggatttgtcatatgtggcctttattattttcagatatgtttcttctatccctagtttgttgagggtttttatcatgaagggatgatacattttgtgaaatgagtttttctgcatctattgagatgaccatatggtttttgtccttaattctgtttctgtgatgaatcacttaacacacatttattgatttgtgcatgttgaatcatccttgcatttccgaaataaaactcacttgataatggtgtattacatttttgacatgctattgtattaggtttgctagtattttgttgtgaatttttacatttatcttcatcagcattattggtctgtagttttcttttgttgtgtcctgtctggctttgatatcagggtgatagtggcttcacaaactgagctaaggaagatttcctcctcctcaaatttttcgaactgtttgaggaggattggtaccagttcttctttgtatgtctggtagaatttggctgtggatccatctggtcttcagcttttttggatgggagattttaaattactgactcaatgcaactatttattattggtctgttcagaatttctacttcttcctggttcaatattgggagtttgtatgttttcaggaatttaaccatttctctaggttttctagtttgtgagtgtatagttgttcatagcagtctctgatgattttttgtgcttctgtggtatttgttataatgtctccttttaaattttgattatgtttatttgagtcatctgccttctttaatttttgattgtatttatttgagtcttctctcttcttttttttttttttttttggaggaagtcattttattcaaaatttttacatactcactcaggccaacaaatgtttcaagaactttttacctgccaggcactatgctgagtaattaggttaacataagtgagacaaactgacatggtgctttgccctcatggggtttacaatcttgtaaaaagacaggtttaaatcaaataatcatacaattaagtac

SEQ ID NO: 8570 - DNA, 1080 bp, Homo sapiens
aggatcagctgcttaagatcacaaatgatgttgcccttaaaagtatgtttgagacaacttcacatctccatacattctggattaaagacaaagtggaacatcctgagattgccacgaaagcactggaaagcctgcttccatttccaacctcctgtctttgtgaaacagggttttctgtagtgacagcagccaaacaagattacagagtagactggacataagcaacacacttagggtgtcactgtctcccatcacccctagatgggaccgtctagttgcagggaaaacaagctcagggctcccactgcttctacattatggtgagttgtacaattatttcattatatattacgatgtgataataataaagtacacaataaatgtaatacacttgaatcatctcaaaaccaccaccacccccctccatggaaaaattgttttccacaaaaccggtgcctggtgccaaaaaggttggaaactgctgctttaaacttttaagttgctctgataaacttgataagcaaagaaaggcataaagaagagtcagtacatgaccattttatttagccatttgctgaacagaagtgcctagcttttttcactgtttttgttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcaggggaagaagacaagaaaattaatgaagaactggagtctcaatatcagcaaagtatggacagtaaattatcaggaagatatcggcgacattgtggacttggcttcagtgaggtagtaattaacttattttcattgggaagataattagttt

SEQ ID NO: 8571 - DNA, 1031 bp, Homo sapiens
gcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctgtctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttggattttttttttttttttttttttttgagacggagtctca

SEQ ID NO: 8572 - DNA, 1048 bp, Homo sapiens
tagtaaaatattgaatcactttatagtagacaatacatatgacatttaacaaatacttggtttgaaaaagtttggctttattcaacaattttagtttgcccactgattttcaaatgtctgtgggattgcttataactaagtagaaagtgaagactgatttttacttaagaatgggatagagatgagttttatggtttttaaaagtattttcagttcattatttaaatgttgggttgttgatatggtcttgtttctgataaggaaataggagcaacttgttttaaaataactacactaaaagactttcttcatctccgtatagagaaatccagatttcaattaattcatttattgggtgctaacaaaattcagggttagagtaaatttaggtctgttggtccatgtggcctggtttcctagcacccattaaacataatgctatcttttaagcctgaacatgtgggttttttaaatcaaattggaaaaaaattagacaactgatgtcatgctgtcttggtatccatactaaaaaagtatcaggaaaatagattatttttgtgctgtgaaacactattcagtggaaagtttagtggcaacttttccatatcattcatgacttaatacctgaaatgcacttttaaatgtttgccttatatccaagtgtttacttgtatccatgacctaaccgtctattgaaaagaatgtttgcagatgcagattgcaatgttgtttgtattcataggcaaaagtcctcttctctagtataattttttaaatctgagagaattgaaggtacagaaaaaaattctggagtgcctgaaccacagtttgagagcacaaaggtcacattctttcagtaaatttgggggaaataaatttcagctacctggttagcttcagtgactacttacacacagggctttggttccattacttgtttccaccacagccacatcctaaatacttggaatatccgaaaacaacttctaaaatcactcaataaaagtattcacttctaaccaactcctcctcctttatacctgctctg

SEQ ID NO: 8573 - DNA, 1087 bp, Homo sapiens
tcccagagattctggtatgttgtgtctttgttcttgttggcttcaaagaacatctttatttctgccttcatttcgttatgtacccagcagtcattcaggagcaggttgttcagtttccaagtagttgagcggttttgagtgagtttcttaatgctgagttctagttggattgcactgtggtctgagagacagtttgttataatttctgttgttttacatttgctgaggagtgctttacttccaactatgtggtcaattttggaataggtgtggtgtggtgctgaaaagaatgtatattctgtggatttggggtggagagttctgcagatgtctgttaggtctgcttggtgcagagctgagttcaattcctggatatccttgttaacttcctgtctcgttgatctgactaatgttgacagtggggtgttaaagtctcccattattattgtgtgggagtctcagtctctttgcaggtctctaaggacttgctttatgaatctgggtgctcctgtattggatgcatatatacttaggatagttagctcttcttgttgaattggtccctttaccattatgtaatggccttctttgtctcttctgatctttgttggtttaaagtctgttttatcagagactaggattgcaacccctgcttttttttgttttccattttcttggtagatcttcctccatccctttattttgagcctatgtgtgtctctgcacgtgagatgggtttcctcaatgcagcacactgatgggtcttgactctttatccaatttgccagtctgtgtcttttaattggagcatttagcccatttacatttaaggttagtattgttatgtgtgaatttgatcgtgtcattatgatgttagctggttattttgctcattagttgatgcagtttcttcctagcctcgatggtctttacaatttggcatgtttttgcagtggctggtaccggttgttcctttccatgtttagtgcttccttcaggagctcttttagggcaggcctggtggtgacaaaatctctcagcatttgcttgtctgtaaaggattttatttctccttcacttatgaagc

SEQ ID NO: 8574 - DNA, 1029 bp, Homo sapiens
tttttaaagctataaacaataagcgatgctaaaaacgtttaaggaaaattatttccggccaggcacggtggcttatgcctgtaatcacagcactttgggaggccgaggcgggcggatcacttgaggtcaggagtttgagatcagcctggccaacatggtgaaaccatctctactaaaaatacaaaaaattagccaggagtgatggtgggcacctgtaatcccacctactgggaggcagaggcaggagaatcacttgaacctgggaggtggaggttgcagtgagccgagatcgtgccattgcactccagcctgggcaacaagaatgaaactccgtctcaaaaaaaaaaaaaaaaaaaaaaagagtcaaaatatccggtgtttatcagcaattcaaggggggatacagaataggcagatgcacacctaagtctggagtccaaggagggtctgccctggagatatgaatttgagtgtagtagctttaaagatggcatggaaagccatagatgagatgaagttacaggagttgagatgaacagaaaaaatgaggtccaaggactgagccttttgttagggactgctagaggcggtgtttcccacatcctccaaaagggagcaaaccaagaaagaggaagacagaagataaggaaggaggaatctgacactggagacagaatattcagattggtggtgaacggggattccagaactacaggtctcagggtaagatgtctaaactggcactagaggatgaagcatcctgggagggtatcaccaaggaaaaacaaaaagagcaaccctgtttgaatatactgagattaaactatggctcaaagtttggggatgagatagaaacaggaacacagaactcttaagcacatggaaaaacaaggtaattactaacatttttttgtagatatatttacagaattgtaaatatggaatcacgtcaacactgtatataaaagtcatagaaatgtaaacacagaatattgattgaaccataaacgattacagaattatgaggat

SEQ ID NO: 8575 - DNA, 1029 bp, Homo sapiens
tttggtggagacagatctatatacccccaggttattattccctgccaccgagcctgggagcagtttctggatatacggtagtgacccggtgtatggacaagaagtagatgcagggaattgaccaggaattactgggaagagggattcagtggtgtgaactggtcaccccttcccataagcctgatgattgaaaaaggacaatgagtgaccaggcgtggtggctcacgcctgtaatcccagcactttgggaggccaaggcgggtggatcacctgaggtcaggagtttgagaccagcctgactaacatggtaaaaccctgcctctactaaaaatacaaaattagcctggcttggtggcacatgcctgtaatccagctacttaggagtctgaggcaggagaatgcagtgtgatagcccaaaaagaaggcagaggttgcagtgagctgagatcgcgcccccgcactccagcctggccaacaagagagaaactctgtctcaaaaaaaaaaaaaaaaaaggacaatgagaaaataaatgaagtaaaatttgtttctgtgatatctgagataatcttttagatgtgtttctaacatttccccaaatgaagtaaattattacacaaaattacgaagttaaagcaaatttggaaaaaaaaaaaacagttacaagtggacagaagtctattttggcattctgagtgtctgcagctttgggacaaatgagaggcaggatccctgggcaggatcagcacactcatggtagcaagcgctcctcattctgcccccagttctgcccccacagcttcaaacatggtgggctgacaacaatatggaggtcggagaagaagaacaatttcagagcatgtctgagacaacccaaggtgctgaaaaatgtactgaagctctacagtgatggaggcatggatcagcactatgcagatagaaacataaatgtgacatcatttgtaattgcagtctgaatgagttagaaaaaaattaggatattcttacgtggaagctaaatcttaatacca

SEQ ID NO: 8576 - DNA, 1032 bp, Homo sapiens
cttgtgcctaagcctcttgaatagctggaactacaggcacctgccactatgcccggctaatttttgtatttgtttagtagagatggggttttaccacattgggcaggctgatcttgaactcctgacctcaggtgatctctccacctcggcctcccaaagtgctgggattacaagcaggagccaccgtgcccggccaacatctttgtttattccggtttttgattctgtttatttcatgtatctttctcccctccttaatggaatatgatataatttagtctccttccacatcataaaaatttggcacttttcacattatgtgacaaatgcatacactatcatgtaccattaccactgtaaaaagtctaaattttgtgattttgtgtcttttatttatttatttttatttttttttacatttagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtaagtactcaataattgcatttggttgcaaagaaacatgactatcactaccaccaccaccaaaatacaaaaaaggaaaaaccaaaaacgaactcacagatggcttaaacatgcaatatttattttttatataaaataataattgaaatagcactctaggatgggtatagtggctttataaagtcatcagagacttaagcttctttcagttcttttatcagtgatccctaagacattcttgtagtactggttcttgtatgtccaagatagctgccagagctctaaccatcactgtcatgttccaggcagcaaagcataggcgaagaaagatgcatcctcttcctttaaggagaattcctgaaccaaggctgaggctataagaaagcagggaaatgtagctgactgcatgtctgccctctataaaattgggcttttgttactgagaaggaaggaa

SEQ ID NO: 8577 - DNA, 1059 bp, Homo sapiens
agtctcgctcactgcaacctttgcctcccaggttcaggagattctcctgcctcagcctcctgagtagctaggactacaggcgtgtgccaccatgcccggctaattttttgtatttttagtagagacagggtttcatcatgttggccaggttggtcttgaactcctaacctcaaccaatctgcctgccttggcctcccaaagtgctggcattacaggcgtgagccaccacgcccagcctcttcatacccttttgctagagattttcttccaagcaccctatattaattttacaagctttacaagcttggtgctggtgctttcttcatcttatcagaagatgatgacaggaagttttcagattcatagtctttcctcaaactctccttaaatgattcattgatgaagacctggagggctggccttcatgaatcacaccaacttgtattacttttcaggcaacctattctttattcagatacacgctctcagaatgtatcaagaactaaactaataaacacacttgtcaggttatgtagtgctcttcaacattcaaatcagatttagctactcttcctttagctcagccaccatccatcaaccccatacttcttaaaaatgcttaatataacatcttgggggaaatcattttataatttaatgtttaatatggcaacaacttttggctgtaggcatttacagcaatgttacagtgatttgttattttctgaccattctcgtatcaatctttttaccacctttagcattaatgtagattttgaggcatgtaaaagaacatcaggattttgtcagaatttcctgttgactaaactcagctttattttttccttaaactatactttgctggaagttgtgcagcttctgttcagtattttcaggaagttcctgacaaattgacatttgcatgagtccatcaattcagcctcatgttccttgagtttttttatttattggaggcatagttggtttctgctatcttcatttgcattgtttggctgctgataggtaatcctgttgtgttttactaacaaaacgtaacat

SEQ ID NO: 8578 - DNA, 1050 bp, Homo sapiens
cgtccaggctggagtgcagtggtgcaatcttggctcactgcaacctctgcctcctgggttcaagtgattcttctgccccagcctcccaggtagctaggattgacaggcgtgtgtcaccatgcccagctaatttttgtatttttagtagagacggtatttcgccaggttggccaggctggtctcgagctcctgacctcaggtgattacccacctcagcctcccaaagtgctgggattacaggcgtgagccaccacgcccggccctaaagctaatatcttttgaaagaaattctttttataatattaaatttatctaaattagtcaaaagtatttatcactaatgtattgtaaccctgtttttaagctgttgcatttgtctaaaaatggaatgtaatagataaaactaacttactaattttgttaacagagtgggaggctaagcaaagaactggatttagtaagtcaccatgtgaggacaaaacttgatgaactgaaaaggcaagaagtaggaaggttaagaatgttaattaaagctaagttggattcccttcaaggtaagtgctaaacaaaaggtaggattttttttttcttttttccttttgaaacagcgttttaccctgtggttcaggctggagtgcagtggcacaatcacagttcactacagccttgaccacctgggctcaagtgatcctcccatctcaacctcctgagtagctgagaccacaggtgtgtgccaccatgcctggctaattttttttgttagttagacagggttttgctgtgttgcccaagctggtcttgaactcctgggctcaagcaatcttcctatcttgaccaaagagctgggattacaggcatgagctggcgggcctggctagaaaattttaacatttggttgttgaggtcagtttatattagtacgtgccatctatgttcttctagtcaaaattttatgttagtattgatttggcttctcttaatttttagaatttaatgttttaaatagataatacattttatatcattcaaaaatcagtataataagccata

SEQ ID NO: 8579 - DNA, 1063 bp, Homo sapiens
attagagcttattgaataaaacaagaagccacgagtctacactgatataagtagagggagagagaaggccgaattcttttgcaaaattgcttttcaaaagacttacgccatttatatttccaccattaaaaacgtgtgcactctttaaacatatcagagctgggcacggtggtgcctacctgtaggcccagctacttaggaggcaggaggaccacttgagcccaggagtttgagaccagtctgggcaatgtaatgagaccctgtctctaaaaagaaaaaaaaaatttttttaaaatactttgagaatatgtgaatgtattattgttgatgtccattgatgattctagctagaattattactgtgatggttgacaaatggagattttctaacctgatcatcccttctacatttgttagttggctttctactgtaatgaaaaactattccttcccctcgaccttctacttatatcagtgtagactcatggcttcttttattcaataagctctaatctttaccatcattatttccatactcaaattgtcccagacttggccagtgagagtttcttcagactggcttttgtgtccttctgacatgtccgaatgattctttggggacttccttacttttagtatatcaggatgttcaaggcttaccttattctttccctgacccaacccagaatgacccatttttctgagaagccctgcagaccaagatctgggccctggatgttccccttgctactgtagtgtcattgcttccaaggtcttgtcagatgacagagcaggggaattaaaagaatatgtatataatatggatgtgtatatgtacatatgtacacacatacatgcacacatacacacatatacccacctatatacattaatattcatttctacatatctatcaatatatattaaaactcatgaatttacactgatatctccagttgcaatccaacaactcttgatttcctttttttcattttaattttttgaagttcaggggtacatgtgcaggtttattatatagtttatatatatataaacttgtgtc

SEQ ID NO: 8580 - DNA, 1026 bp, Homo sapiens
tcagggccagctggagaattgaagtttgagccacgtgtgtaattttgtttgattatttatttaggaaaataaattattttatcaattgaaatccacatttattacaaatataatttcaaatcattaagatgttatgttattttttgtgtattttttgtggtattagagcaatttagattatagaaaaatgaaaatgcctccaaaagttttatgtagcagcaaattttaagtgctgtatcatttgtataatttgataaccatatttatggtaaaatgatttatttcaactttatttgtaattctttctaattatattaatcttaccagagaatatgttttttaaaattgtgatctatgattagctaagcatattttttaaaacaagtatatttgtatatgaaggaacatttagaataaaggaagatacttttaaaataagaacttttttcttttttccaacagacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaattctggaaaggccacagtatttccctgtgtttcctggtaacgtttttctagttttggcaacctcaactgctagaaattcttcacctgaatcacttttgctaccacttcag

SEQ ID NO: 8581 - DNA, 1034 bp, Homo sapiens
agaaatgggaaattaagggccaccttcaggcgtttaactgaattgtcctggggatttaatttgcctttcgacttaatgctaaatttttgttgtttttggtttttaaagtaatgtaagtttatcgcgccaacggtaagatgtcgctctggacgcgtgcacctgctctcgcaatcaccgactgcggtcagcatcttccttagagcagcgccccgggccacttggatcccggtctcaatttactaagcgaacccagaggatgccccgagtcctggaccgcagagccgctcgcgagaggcaccggggctgtaaccgcgcaacctcgtgccgcgggcggaggcgagggaggattccccggccggtgcccgcccccgggctaaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtagggggcggctggggtgggctggggcgggggctcctggcgccagagggtcctcgcgggtcggctccctagcatcccgccaggggacctcaacttcctgggggctgagagctctattttcttttctatttcttctcctttttttttttttttttttttgagacggagtctcgctctgtctcccaggctggagtgaagtggcgcgatctcggctcactgcaagctccgcctcccaggttcacgccattctcctgcctcagactcccgagtagctgggaccacaggcgcccgccaccatgcccggctaattttttgtacttttagtagagacggggtttcacagtg

SEQ ID NO: 8582 - DNA, 1023 bp, Homo sapiens
attgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagtctcacaaatggtccagcaggactgatgggtcctggggctcaactccctggctccagtggctcagactgctgttactacccgggagcaccaggtgattctggagttcgaagggaggaaggtagacttctttctggacactggagccaggcttctgttttcctctccaattcaggccttcgttcctcccatagcacaaccatgatgggcatctcaggaaagactttaacttgatatttttctcaacctattagttgcagtcagagggacctactgtttacacaggcctttttagtcatgcctgaaagtcccactcctttattagatagagatattccagcacgtatgggggccaccatccttatggctccaggacaaactccgcctccccttagtggaaaccagtattaacccagaggtttgggcaactcagggaagaagtggccggactataaccactataccagtctggatccacctcaaggatcccactttttttcctaaccagagacaataccctctgaagccagaaagtagaaaagggctagacgccagcattgataacctaaaggcacaaggcctccttaggccttgcagtagcccttgaaacaccccaatattaggggtgcaa

SEQ ID NO: 8583 - DNA, 1054 bp, Homo sapiens
ctcgggaggctgaggcaggagaattgcgtgaacccgggaagcagaagttgcagaaagccaagattgtgccactgcactctagcctgggcaacagagtaagtctccatctcaaaaaacaaacaaacaaacaaaactcaatttatcaggtggacctttctcatttagcatgtaaaattccaaatggcatcgtgagtgactatcctgagtatagatatccccatcccaaagatgttcctattacatgcaggagggggaagcttctaagatatgagaaagatctgcctgtgtctctcacaagctacaacttagaactggcccttcaggggacagggctttatttcctttgtggctcctggctacacttaatcctccctaggcactggaagggaacctgcactatcgtggcagtggttcctgacctgttatctttaaattccactgatatggcagcatcatctggggacatccctagcctagcgtcttttctagtgagtgtgctatctcagatgcgctgaacaaagaggtctatcatttccatgccctcatatggagacttaactgaaagagaagattgggtaggacctgcacatgacaatcctatctcagaaaaaccatggataggggattctatagtcagaggcctattctggtttgctggtattcctctccttgaaaaatcagtacttaatatttctattatgatgccacaagggtagaagctaacagtaggagccatagaagcacaacaacaattcataaactctttagcctcagtagttatgcaaaatagacaggccctagatatccttatggccaaagtagggggtacctgtgcacttttaaaaagaagcatgtcacttctagatcaatacctctagtcaagtagaagagaatgtacaggtgcttaaagatcaaattagaacattgacagattaagagagaatgcgggctccagtcccagttggctacaatccctcttaaatggattccagtcttctttgtggaactggttagctcctttattaggcccccttttgctcgtgtgttttgtact

SEQ ID NO: 8584 - DNA, 2243 bp, Homo sapiens
ctttatgatcagctggatcctttagttgtttgcaaagatgactccaatcctacacccttccctgaatccatgtccattgctgtgtaactttgtagtgcctctaactgtgtgacctctttcagccaacttaagaagacagcagtgaaggcgtgccagttccaagtgtaagccccaagaggtcttgtgtgtcttcatttgcttcctcgtgtgcttctaatggtgctgggagaagaacaggtcgagactagcctgctggaggatgagagatgctggctaccacatccttgttgctccagtggaggccaggctagattagatgacagccacctgactccatgtgagcaaatctgagatcagcagagctggcagagccaactctcaaatacttggaaaatacttttaatatgtaaaacattttaaatattacattaatatttaaaatgttttttaaagccactgttttatactggctttgttacacagcataagctaagtgctacaactcctcaggaagctgagctttgaccaaaagaagtgtggtagccacagagatgtgtctgagacccccttcgagagagagcctgtgtgaggagtgcagtcagctgatgggctccagctacagatctcagggatctgcatcagtgttccagctggtgccatgctctccccagactgcttctgccactgactgagcaaggcaggagctccgtgttgggagctgatgctggaatactgaactatatcccgagatctccagctgctgatctcggggatctggggtggccaagactttctcagagtgtatattaggtgctagaataacatcattttatttgatgtcattttgttatcacattgatgaaaaaaaattcagttcccaacctgagccactgtctgtgtggagtttgcatgttctgcatgggttttcatcaggtactctggtttcctcccacatcgcaaaaatgagcacttccagtaaattggggtgtctagatggtgccacagtgagtgagggtgtgggtgtgagcatgccctacagccagataccatcctctccagggttgatgcccacttagtgctctgagccactgggataggctctggccacccacaactctgaactggaatcattgggtgagtaattattatttgtttttagtaatttttttttttttgagacaaagtctcactctgtcacccaggccagagtgcagtggcacaatcttggcttactgcaacctccacctcctgggctcaagcgatactcccacctcagtttcctgagtagctgggactacaggcgcatgtcaccatgcctgtctaattttttgttgttgttgttgttgcgataaggtctcgctgtattgtccaggctggtctcaaactcctgagctcaagctatcctcctgccttgggctcccaaagtgctaggattacaggcatgagccactgtgcctggcctagtattggtcattagtattagtaatcattcctaaatgtatatgtaaacatttatttcagtgttaaatattgaagtgtttggtctttatttagaagtttgatgttgtgttttatgaccagaaatatgctgtgaacttaattctttcttatagcagttagcctatgggaaaattggttttgttctacattattttatttaaagtcataatttccaagatcctatcaactccattaagtgaggacttactgtactgtagcctgaggctcatcttagtcttccctcatcccccctgcctttccttcacagtcagcctgcatggtggtctgaggccttcccccctacagcctctcccctttatctttcacggtaatcacccctcattactcgtacttctaactccatcttgaaagctgcttcctggaagatccaaacggacacaaggagggactgaaggattagaatgagggaagtaacccatgcactgcttatttgagatggggaaccgaaggactttggcagttcctacacagagacagatggcagagatgacaaggtttctcagagaatgcgtgagtaactggaatggcttttcctgatgacccagacagcctgctcaagagcacactgttgcagctgccctccttggatggaactatggaatgatttttattcttctacttcccaggtgaatgggaaaccaaggacacagtcagcatttaacaaaaaggaatctgcatctcagtcagaactgtattgcatttgcttctctctggattacctt

SEQ ID NO: 8585 - DNA, 1054 bp, Homo sapiens
gatgccatttttcatttggtgttccttctttccttctcaatcttctggttatagtaactatcacaggctatgatctatggcctcctgaatgcattctctctattccattgctttactagatatggggaacaggggagggagtaaaaataaaaataaaaacattcttgttacataatgatgaatcctgaataaccatagtctgtctttgactgcagagctctagctgcctacttgacatctcctctcaggtatttcaaagacatctcaacttcacatgtaaaatggaatctttgattcccatcctcataaacgtatctccatgggtattccctctcttagtaaaaagcattacaatttgctcaagccaaaaacctgggagtcggcgagtctccttgattcttcctcttcttttttatgacgggctcactctgttgcccaggctggagtgcagtggcacaatcatggctcactgcaatcttgacctcttgggctcaagcaatctgccttaggctcctgagtagctgggactgtagcacaggctaccacacctggctaattttattttttgtagagacagggtctccctatatttcccaggctggtctgaactcctgggctcaagctatttttccacctcggcctcctaaagtgctgagattacaggcgtgaaccattgcagccagccatgttttcctcctgttatgtccagcattcagtgtatcaacaagcctcgtacaatacacctctcatctgtgggatctacacaaacgcttacaccctttcatgtttacggtatcatcatctttggcctgtttgcttgccttagccttctaacctttatttttgctatcttgtcttttatagtttattctcccctagcagtaataattataatataggccgggcgtggtggctcgtgcctgtgatcgagcactttgggacgccaaggtgggtggatcacctgaggtcaggagtttgagaccagcctggccaacatggtgaaaccccatctccactaaaaatacaaaaattagccgggcctggcggcacatgc

SEQ ID NO: 8586 - DNA, 1277 bp, Homo sapiens
cacaccacgcccagctaatttttgtatttttagtacagggtttcaccacgaccagactggtcttgaattcccaacctcaggtgacccacccacctcagcctcccaaagtggtgggattacaggcgtgagccaccacacccagcacatatgagtttttttttttttgagacggagtcttgctgtcacccaggctagagtgcagtagcaccatctcggctcactgcaggctctgccccctggggttcatgccattctcctgcctcagcctcctgagtagctgggactacaggcgtccgccacctcgcccggctaattttttgtatttttagtacggaaaggatttcaccgtgttagccaggatggcctcgatctcctgacctcatgatccacccgcctcagcctcccaaagtgttgggattacaggcgtaagccaccacgcctggcccatatgagtctcatgatctttctttcacctttttagcctcaccaattcctggaccaccgttattagtgtattgaaccatatacagtctcatgacacaatatgtactacattgctgctttgcttgtgttttgttttatttttaaatagagacaaggtctcactgtgttgccaggctggacttgaactcttcggctcaacagttcttctgcctcaacctcccaaataatcaggaccacagtgcctctttgcctttgtttaagcagtttcctctccctgaaatgttattgtctccgatctacttggcaagcaccagtttatcttatggttctctgtgaacctttttcgaaccctcttctccagtaggattgattagtaattctctccagcccagcttcccactaactagtatttaagctcctatggcatggggtcttaatcaattttgtatctacatggtctagcaagtagcgtgcactcaatacatgttttaaaatataatctcattttattctcttttatcctactttatagagcttggaaaagtttatcttgcctagattaacgttagaaaaagaatttgactctttatctttctgaatccatagtcagtgtttttctcactatattctattctttttatttacttttttttttttttttttttttgagacagtctcactctgtcacccaggctggagtgcagtggtgcaatctcagctcactgccacctctgcctcctgggttcaagtgattctcctgcctcactcagcctccccaacagctgggattacaggtgtgtgccaccatacctggctaatttttgtatttttga

SEQ ID NO: 8587 - DNA, 1067 bp, Homo sapiens
ttaagaatgtatttcctggggaggggcatgggatggtctctgggcacagtcatgacaatagcttctttaaaaaataaaacaactggtaccataagagtgtgtatttgtggggtacatgtgatatttcaatatatgcatataacatgtaatgatcaaatcagggtaatggggctatccatcacctcaaacatttatcatttatttgtgttgaaaacattccaaatggtctcttctggctattttttcttttcttttcttttcttttttttttttttgagatgaggtctctctatattgcccaagctgatcttgaactcctaagctcaagtgatcctcccaccttggcctcccaaagtgctgggattacaggcatgggccaccacacccagcttcttctagctgttttgaaatgtacaataaattattaataatcacactcaccctactgtgctgttgaacactagaatttattcctatctatttttgtacccattaaccaactgcttttcattctatcccccaaccgcagcctgtggtaaccaacactctactctctacctccatgagatcaactttaaaaaaaaaaaaaaaagctcccacgtgagtgagaatatgtgatatttgtctttctggcacataaatctggggtgacttggctggctgagatgataaatgacagtcagaagaaatttatggatatataaacactatttgggggttacatgagtaagaatatgtgatatttgtctttctggcacataaatctggggtgacttggctggctgagatgataaatgacagtaagaagaaatttatggatatataaacactatttgggggttaccaaaaatcacatgagggtgagaaggcaacctgatagaagtccacactttttttgtttgtttgttttcgagactgagtctcgctgtgtcacccaggctggagttgcagaggtgctcactgcaacctccgcctcccgagtagctgggattacagacatacgccactatgtctggctaatttttgtatttttagtagagaggggtttcaccatgttagccaggctg

SEQ ID NO: 8588 - DNA, 1071 bp, Homo sapiens
acttgaggtcaggagtttaagaccagtctgggcaacataacgagaccagtctgggcaacataacgagacctatctacagaagaataaaaaaatcagcagggtgtggtagtgcttgcttatagtcctacctactacggtgggtcaggtggtagaatcacttgagcccagcagatagggctgtagtgagatttgatggtgccactgcactccagcctgggtgacggagtaataccccatctcaaaaacaaaacaaaaaaggcttaatctttctaacctacaaagagaaacagatatgtgcaattcattagaaaaacaagtagactatgaaaaggcaatccacaaaagagaaaatatggagagccagtatacctaacaacaacaacaacaacaaacaaaacactcagactcattagcaactaggggagtacaggtgaaagataggatgccatttttagccatcaaagtgtcaaggttgtaaaaagattgataatattcagttctgggaaggtttgtagggagaaagaacacgtatatactttgctattgggactgtgaattggggagagtatttggtcagaatctatttatgtttaaaatgcacgttttttgactcaacagtcctactttgaggaatcaatcctatagaattagaatgcccagggtgttgattgtgtatagatatgaaaggctgaaatcaacctgtgtctctaaccaaaggggagtgttgaatgaattatactagatctatatacaatggaacaatagtgaaatattactgaactgcaggactgtacatgatatattgttacatgagaaaagcaagttgaagaataatgtatataatgtgatactattctttgttcaataagtataagaagaaaatgattaaaaatgtggatgtatgtatgtatatagcacaatattatatatgttaaaatatatatacataatgagggaagatgcacccaattgttaataatggttatctctggtggtacagtattgaagaggaaagagtccggattgttaaccctgtattcacttctgtattgctagatctttaaaattaat

SEQ ID NO: 8589 - DNA, 1051 bp, Homo sapiens
gttcatgttctttacctacattttaatggggtttgtttttgtcctgtaaatttaagttccttatagatgctggatattagaactttgtcagatgcatagtttgcaaatattgtctcccattttgtaggatgtctgtttactctgttgatagtttattttactgtgcagaagctctttagtttaattagatcccacttatcaatttttgcttttgttgccattgcttttggcatctttgttatgaaatctttgcccattcctatatccaggatggtatgtcctaggtttttttctagggtttttatagttttggattttacatttaaatctttgatctatcttgagttgattttttatatggtgtaaggaaagggtccagcttcgatttttctgcatatgactagccagtaatcccagcaccatttattgaataaggaggcttttccccattgcttgtttttatcagctttgttgaagatctgatagtcataggcgtgcagccttgtttctgggcttcctattctattccattcatctatgtgtctgtttttgtactgacatcatgctgttttggttattgtagtgctatagtatcgtttgaagtcaggtagtgtaattcctccagctttgttctttttgcttaggattgccttggctattcaggctcttttttggttccatatgaattttaaaatagttttttcctagttctgtgaagaatgtctttggtaatttgatagggataacattaaatctgtaaattgctttgggtagtatggccattttcatgatattgattcttcctatccgggagcatgggatgtcttttcatttgtttgtgtcttctctgatttctttgagcagtattttgtaattctcattgtagaggtctttcacctccctgattagctgtattcctaggtgttttattctttttgtggcagttgtgaatggggttgccttcctgatttggctcttggcttgatagttgttgtattggaatgctaacgatttttgtatgttgattttgtatcctgaaactttgctgaag

SEQ ID NO: 8590 - DNA, 1043 bp, Homo sapiens
ttttttttttctcttttgagacagagtctcactctggtgcccaggctggtgtgcagtggtgtgatcttggctcactgcaactgcctcccaggttcaagtgattctcctgcctcagtctctcgagcagctgagattacaggcatgggccaccatgcccagctaatttttgtatttttagtagagacggggtttcaccacattggtcagggtggtcttgaactcctgacctcaggtgatctgcctgcctcggcctcccaaagtgctgggattacaaggagattgacttttatccgcagatactctaacctgatcttttgtcatatcttcaatttctttgctcattttgttaatgttttcctttaaatacttatacatacttatattagctgttttaatgtctttttcagctaattttgtcatctttatagtttcaagatctggttcttttcttctggctatggatcgcatttttcttgcttcttggcatgtttagtgagttttgatttgatagtggactttgtgaatgcacgttgatgagtatctggtatttgttgcctgtctttaaagactattggatattgtttggcaggcggtaaagttaatgttgctcaatttgagtcctttgaagtctgattttaggcttctctagagtggttctggtgtagtctttattccagatatagttcatccctacttctaaggtgtggccctctgatatctccactgaataacccaagggatcatcaaagagtctccgctttggctgatcagagtttgaacatcttcctgctacgtataaactccagtaattgttcagtttacaaatctccattttttgcctatccttgtcaagtttccctgtatacattacttgtcctagtactctgcaaagactcagtgggcctcctgtacagattttttggagcccccttttttctggttggctcacttctctcttgaaatgtgcccacaactgccagctatctcagcctctctgatctcaaatttctgtctcctcaatttagcaaggctgctgggctcta

SEQ ID NO: 8591 - DNA, 1050 bp, Homo sapiens
tcagtagcaatggtcctctgcccactacaagtaacaaggtccatttgtgccttttcagatgacctttgttttatgaacaaaatatgtaatttggattttttgtaatagtaagcatcttttctactgaacagaattaagataaagaaaatcttccttaggatacactttttttttcttttttttttgagacagagtctcactctgtcacccaggctggaatgcaatggtgtgatctcagcttactacaacctccgcctcctgggttcaagtcattctcaggatacacttctaaaactccaaaaaatgtaatttattaatatagatattgttgatagtagcaaatgcttcattatgtaattgagtgtgacattaattctctcatgctttgtcaaatgactcttactcttcagtgcaggaatcacagccatggcccccaccctccaggatttggtcgatatggcatctgtgcacatgaaaacaaagaacttgccaatgcaagagaagctcttcctcttatagaggactctagtaactgtgacattgtcaaagctactcagtaagtcttccaaatgctttggtttatccttatgttctctagaattaatagtaatatatgtgtagttcatggagcttcatatgtttacctctcttaacttcataatagtagttaacaccagcaccagtatatttgtcataccaacaccacagtacttagtacagtgtacctgagctgtttatgtaccaggacgtcccattagattgtaggcaggttcttagcaaaagcatgtcttcatctttgtagctccagtgcttttgcacagttccttcttgtgtaaggtacccaataaatgttccttgaatgaatggatgattttaaatgacactaagccaaactctttatttgaaacacaaatctaagtcttttaaaatatactacaacctgaataggtagatggaatgaaaaatactgacttacacatttatagatatttttaaaaatcatttatttcttgagtactttccatgtgcttgttgtgctggactaactag

SEQ ID NO: 8592 - DNA, 1087 bp, Homo sapiens
gaccttagagaccatgcctggttgatccaaaagggaaaattagagataaagccaagggggccaatcataaagtttagaaagtaaaagtgaacattttttaaaaaaggaaaagtataataaactttttcagaagagaatgggaagtctcatctagtttagaagaagcattgaaatattttacattttaataccacgaagaatagataggtaggagatttaaccttttaaaaaaactaaatatggaatatacttttaagtgggcatgtattggattgtataaaatatttccccttcataaagcactactgcctacccattgtttcttttaaacagcttaacatgtaaaatgtacatgtgtatgtgaatgtgtatatattttgtgttataggattagatatttaaaatcctcaaagtttaagaaatttattaaggtttaaaatgttctaacacacatgaatactcacaggcaaactcctcttctgtggaaataaactggcatggtatttagataatatgatgtatgaagctcaactttgaagtaatgagactaattcctataaaccatagaagaaaatcagtcttattaccttatatgtccaccttatacagtgcctctcatctccgtaccctaaatacagggcaaaacactcaaaatgtctaacttttccaaaaggattttaaattaattctttactacttacttttaaaattcattcccacatagtaattctacttttaaactgttgaaggtgacataactttacctttctccttccagtcaagtaagaatatctgtctgatcctaaaccttttgaatataaacaatttcaagagtgctgcggtagttagactatgcagagagtagttatgatgtatttgatatgtaagttataatggaatgctaattacagcaggactaattacttacatcctaaggatgtttcatcagggatttgtctgattctgccatgtgaacctttcatatttctatagatctgggtgttttagggattattactatcataatttgttctccaacatatttattactatgaaaaaattagtattttctttctcaatatgaagc

SEQ ID NO: 8593 - DNA, 1034 bp, Homo sapiens
gcaacaagaatgaaacttcatctcaaaaaaaaaaaaaaaaaaaaagattgtttccaagatgtacaatctctcaaacctcaaatttatcaatcagcaattttagaggaaaactttgtgttagctttgttgttgtattaattgttattatatactttggaagtagttcttatattgcactattattagatacttaagaggtaaaatccataaagttctaaaattctgaatctcttaatagctcttcctgctgctgatgctttctgtgattaccatgtgggctattggatacatattggacttcaattcagattcttggcttttaaaaggatgtcttctagtaacactgttttttctgacatctttgtttccaaggtgtgtatgttaatttttgcaaggctggttattgtgtttctgattttatttcttatttctgttgttggttagctggagtcacagatttttatcatgctgtaaatattacttaccatataacagcatcctgcgggtggatgggaggaaagggctctggtagcatattatttggctgaaagcaagttgctcaacccagtaacttggttgacttgacaactggtggaaaataaatatcctgggtcacgttttaattgttatttttggtgaatgatggggagatttttgtaatcatttcataattattcaagattttgtaatcatcttgaagcatttttgctcatttttcagaaattttttcctttttctaaatttattttaagctagttatttttgctgtcagtcatttttagttgagttaaattgtgagagattataaaatagtaaatatggtatggttttatttttaggacagtatttatacatgattatatatagttaatggttaagagtcagactgcttgaattcaagtcaagctttaccacatgacagtctgacattgaacaagttgctataaaatgagggttaacttgtgataatgcctgcctcatggttaacacatataaacacatagaactatagctgacacatagtactcaataat

SEQ ID NO: 8594 - DNA, 1109 bp, Homo sapiens
agtggtgatccaatgattcccctgccatttgttttgtaagttaatcaaaataggagccgaaaattcagtcagctcagcgtgcaggatcattgcattatgaaactgaacgtatttttgagaactgaacgtatatattttgagtcgtgtgtcgatcaggatttcataaagaaattatgatgtgattctttcacaaaggatcttgccctatgtacctttaatagtgtctttctgcaaacatgtatctaatatatagggaaatacttttatttggaatctctgaatcaagagggttgtttctttgaatgattttgttaaaatgatcaaagaatatttttctagatgctcacaggagagccacaattacaccattagagataaatttatttggtcttgagtgtcacttttcaggatgttcctcataagttgcaactattcctatcaagtatttaatatgagcttcaactaataaggaaacattaattattagccaagtgggaacaaattccagtaggattagaacataggatgggaagagatttaggggcagggacatgtgtgcataaggaaggtgagattcttaggtgccaatgatgaaatttgcttacatcataattacattatttttaaaggaagtttggtgtattccttaacttggctttaacatttagcaggagcccctttctatttcagtttcattttcagcatagtagcctttctatactttttctataagacttgggcaactgatccaggcttcactaaggcttctgaagaagaaaagaaagtggtgagatttcttcgttactgatatttttaataggagggtttgtaaactttagaaagtttatatgcacatatgcagatgtgttgctttttgttacggctgcatgacatgtggggtgatatagcaaaaattagatttccactcttacagttttttcatttatgtatatgaaagttttaacacatatttttattttctgttgaaataataccccaccaagactttttcagatgtgattccttttaggaatatgatctcctacttccttgtaataacattttcataatggtcatttagcttacatttccccactaaataaatggag

SEQ ID NO: 8595 - DNA, 1065 bp, Homo sapiens
gatgcccctcctcctcctcaaatgtgaagttgtcagatgacatggcatgttttccgttgctcatgaatgtttagaagttggagaatgttgtctttgttacctaaagccagtgttcctgaaagacccagcccttggtgcttgtaactttcagttttgatgtatactggtgggtttttcttttttaatgtgtgtgtatatttgcatatttatttttctctagcagatcataactgggagatgattgccattcacagagatgaggtgataggtgggagtggtggggtggtataatttttatgcatcctaatttattagctgttggttgaaaatgcaaccttgaagagtcacatcatttcaagcacagaatgatttggtggcaagtattccaaattgcttttctaactacttcagtttggagcgagaactgtgagaatggtgtataaccatgcataatacattttccaataaaatgtggtaataggtcaaacttcatgtctttcagaatatcatcacccttgcagaaactggctctctggacttcagaacattttgtacatcatgtcttgtgagttttttcatataatttttttccgtagtgaaagcaaagtcttggtaacgttgctgatgtaagcatttgtcagatcttcatggtatatttatacacctttgtttttacccatttctaattttacattcctgtctgaacagctttctgtcttgaacatatggcagaatgatgtttataatctcttgaagttgtctctggttacatctctccgtgaattatccattgtgtgttttatttgcttttctctgtcatgaagcatatattagaactaacgtcaaatcagaggctcataatgaccttagaaaccacttagtgaaacctctcattttgcaattgaggaatcaagggaggaagtaaattctcccaaattattggtggtgctaaaaatggaacttgggtttccttcccttggttgagtgcttattttgctctgtggtactgcctcatttctgcttagccagtgtgaacaggctctggaattcagatcccacttagtg

SEQ ID NO: 8596 - DNA, 1037 bp, Homo sapiens
catgttcttatctattactagaattagtcaatgcatcataatttaaggttttgtatctagtttattggctctattagtaaatatcacctctcttgtgcttcactttcctgtctctttgctcccagcacagagatttcttaattgcttgaagtacaggcccaggcatagaattggatttggttaccacttgccaactgtcttagaatctgaagactccagctctagttcccgactctgacacctactagctctgcaactttacggaaaccacttacctctctgagcctcagtttcctcctctgtgaaatgggctggtaatatctatggcataaacacttcattgatggtatgggaccagctgaggctacaagtgtaaaaatattgtttgaaaatgttaattgctatttgattataaggacatagtcttattaatatgatcaaatctcttgctagcttattggttttcatagtaggagatgtcacttgctgtgcgatcttggacaagtcactgaactcctctgagctgcactcgtctcccctgtaacatggggagtgtagacttgattacttaaatctcccgacatcgtacaagtctatgctgatgccgagctttccttgaaaactggaaaaagcacaggctttgaagtgtgatggactggggttaatcccctgcttcacagcttgctttctttttgtctctctgtacccataaggattatctcagaatgatctgggtatttttgaaaagtaacagcagcttggctgaaagacaattttgtccataataagacatcagctgtgagcagagttctgcagtggcagaaaacggatcaggcagagattcaggttataatttccaaactccagtggcccacttggtagaaccagtttgcatttgtatgttgaatttttgttgactaaataacagtgatccaagagctgagatggtttattggtcctcttggggagggctgtattgctgtcaaggtgtggataaagcatttcaggcaggcctgccgctggcccctggcccagtg

SEQ ID NO: 8597 - DNA, 1030 bp, Homo sapiens
ctgaggcaaagaccagtttggtaactttgtgagtagcaaaggtagaattagaactcgggcagtctggcactagatcccatgtctttaaccatgatattgtacagggagaaacacagagactgtcttagaacttgcaggccctgatttataagaccattgctgtaaccattgagctagatgaggcttagcaaggtacagccacttgctctcggtcatccagggtggcagggcagggagtccagcaaggttggtctggctttgaggcctgcggtcttcccactcttcattgctttctttttccatcctgctctggcagatctacgaggcaaataggacatggcctgggccttggggattttataatctagttgggaggcataactgatatacacagggcaacagggcacaacacagggaggcctcagaggcatgcttggggctgggtatccaaggtgctcaaaggaaaggccaagatggctggagaagtccagagagcctctggaggagacagaagatgagctgaattttggagatgggaaggacagactggtggggaggagaggaagtcagaatgaatgtgatagtggagaatgaagagcaaggtcatgcagtggtaccgagcagttgatgttgcttcatgcaacaagtcattgctccagatctgacatcttccctttcaaaaggtgatgaagagaaagaacaaaggctttgcagctgaaggattggatttgcatgttggcttcctggtggatcatcattctgaatgtgcagggtagttgtgagaagatccggagagggtgtccgttaaggacctgattcagattcataacagatcattgggaaatgatggtgattattatttttagcttggggttcagaatattcaacgtggtagttacaggggaaaggaggctattctgacaccttgttttattatgcagcaactttcttcagccagtgacatcccattgcccctaagcctgctcttcatctccatcaagtgtgaaaagacctaacttagccagcaagt

SEQ ID NO: 8598 - DNA, 1025 bp, Homo sapiens
ttgtgatcagttggccattaaggtgccccaaggcatggccagctgcccaatggtgctttaccaataaccacaggccaaattcaatgactattctgtctcttggtcacatttttcaaagagatggacaatgtgttcctagaatggcttgggcagaatgggccatgtgattttgggaacaaaacttagctaggctttttgtgctttaatctacacaagacaatagtgagtgacacaaagttttttgcaggaacccccattcgcccacacagagccagagaatgactcatggcttagtgccccctttcccagggaatacagatcctctcttgtgttttgcaaacaatgggcccccagcctcagaatattttgcctcttcttccaagtgaaacctcaacaccttcagtgaattttgggttattccaatccttccgttcatcttggtgggacagaggatagggtagaaatggggtcttagtcaagataattgtgatcccactttcagcggtctttggaagactttgaacaaaattagctactcatggcaatgtggcactttaaaaataattataatactagtcacggatatcgattgagcacagcctctgtatcagcataatgcatagcaccagatatgtatcattcatttaatcctcacaacatcccatgaggtagatgctacttcctgaagagaactggaaatgaccactctaggacttagcaactttggttctaattctgtctctttagtcaccttgctacatgaccttcaacaaatcacattttctttctgagcttcagtagcctcacctataaaatggagaagatagtacctgctgtaccttctttgaagttactatgaagattaacacaggtaattattgtgaacaaggcacctgtttaagcatcttacactttaggtagcccttgaggaaaccagggctgacagaggtgaagctacttttccaaggagcacagctggtaggtagacccaaatatttgaacgcttatctgtttgacctttgaag

SEQ ID NO: 8599 - DNA, 1123 bp, Homo sapiens
gtccttccatccatctatttatccatccatccatctgatagacatttattggcacttgagttgacatgaaacttacaaggggatatggagataatgatcatagatcctgctgttagagaatttaacatgtgaaataggggataagacatgtaagaaactggatgaaaaagccaaggaaaacttgggggtgaagagtggcattctaacccagtgcttttgagaaacccgtaggatcccagtttatgaagactgtgcattcccactgcaggagtaaaggcccagaggctggaaagaggtgggtctttatgaggaatcaccagtagttgaattgggctgaagtgaaagggaggagtgggaaatcagggcacctgcttaagtggcagttcttgaaagtcaagttaaggaagtaggacttggttctgtaggtgcttgggaatggtttcgtggcaggggtggccaaaggaagactttctggccctcatttgaatctggatgcatgctgacagattctgacaggtcttccaatttttaaagattaagtgtcagctgagagatgaggcagtcttaatgatgggtgatggctgattcagcaaagccaggcatatgtagcaccacttacattttcttctctcatggcttctttcttttcagacctcttcttatttttagtttttgtcacttttattaacagtttctccactgtcacaggcattcctctaagacctactctccagcctcacgtctcagtcctctaggaatgagaattttgagatgggggtttggcgtccatggcttcttctatctttggaatctgtcccttggctataaataaggctgttgcttagtgccagtattgatggtatttgcagctgtcctctgggagatggactcagacgaataacccattttcaagaggacatggccattaggtgacagctatttatggttcctattgactagggccaaacctgaactgtcactgacattaaaatttcatgagctgtgagctgcctttccttatcaggctgtctctttccatttatttgaaatatctaaccatgtttatctaggttcttcaaaagataatcttgaggaacgcttgtgttgtggctgctgggacttt

SEQ ID NO: 8600 - DNA, 1021 bp, Homo sapiens
ttcatagggttattgtgaggagtaaattaggtgatgcaagtacaatacttagcatagtgccttttacacagtatatacttaataagttattaaactgttaatgattaaaatcatgaagagcaaatgaaaaggaaataaactaatgtttttggtatatgtaccaaaagccagtaacatccaccatttaactggaagataaattatcctattcccaaatatcttccaaggctatacctgtcattttcagtaccagatactaatgttcagcaatgcagcccaaagcatcacagggttttcagttagacccaattttactaagaaagagaaatagaataacatgcttttgaggaaaaaaaataaaatcagtatgcattaatacataaaagttgctgttgctgttaactggcttaaatagaaaatatggctaactagaacatctcttttcagtttaaaggatttccaattagtgtctttgcagtaacaactgtgttaaattgatctaatcgtgtctgtctaacccttatgcatgcattcactcactttatcaaacaacatttattctgtatcacatactggagataaagagatgaatgaaacagagccccaggctttaaggacttgatattctggagcaagggatagcagactttcttttaaatggctggacaataaatattttggacttcgagggccatggggtctctggtgcagctattcaatatgtaaatgaatgagtacggctgtgttccaatcagattttatttacaaaaataggtggggagctggatttggccttcaggcccaggcttactggccttcatcctagaggagtgagttaagtctgtagcaggctactgataagtacagagggccaaaatctgtgaaggatagagaatggggagatgagaagacaatgggttaggaaatgggttatggaactgggggtactttgagaagtaaaggagaacaactaaggccaggaggaagaaatgcatggctatcccttgatgcagaagcaggc

SEQ ID NO: 8601 - DNA, 1053 bp, Homo sapiens
tttttaaagattctacatggtttctccttcttttctatttttgtaattgttgtattttaatgtctctgatacattgtttgcttaaagttggataattcttgattctttcccataattgggaaacaggctatgggatgaataattgaaaacggtaggtatttcctactctctcctgcactggctgtattaacggtgcaggtgtctgttaagatttgttaagacctgcatgctttcacgtggcacatgccaccaaaatgtgatggggttggggggatgtgaactgtgcagtatggaaagcaggaggaagtcaagccagaaattaaaacctaaccacagataatccacaaagtgggcaatggagctatacggcatttgggttgggagtgattggttgtgtggccatggctgaccctccctggtcttcagtgcaggtcaacaagtatgattcaggcctcctctcttctgtctctgcagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggacc

SEQ ID NO: 8602 - DNA, 1049 bp, Homo sapiens
gatgaaaaattattgaatgtgtagaattctttacacgctgtccttaggaatgttttttttttcctccagttttattcaggtataattgataagtgaaaattgtgtacatttcaggtatacaatgtgatgatttgatatgcatatacattgtgaaatgattaccataaccaagctgattaacatcatcacctcacattccatttttttatttttgtggtgagaacagttaagatctattgtctgcaaatttcaagtatacagtgcagcatttttaactatagtcactttacaatagacagatgcccagaacttactcatcttgtagctgaaagtgtgtaccctttgaccaacatctcctcatttccaccaccattccactctctgctgctgtgagtttttttttaattccacacaagagtgagatcacacagtatttgtctgtttgtgtctggcttattttgcttcacataatgtcctccatgttcattcatattttcatatatggcaggatttcccttaagcaatatctgaatttaatacctgctacaataaggacatgggctaggaggtggctttgtgtaatgggaagaacgtgggctgggaaggcaggtttgggtttaaatcttagttcctccataaacagatatataactttaggatagtcacttaatttctctgaaatttattttttccttgcctaaaatagggataaatacatcttaactgtgttttgagaataaaacaagatgtaatgatgtactggaaagatacctgctgatcaataaatattaggtttttttctttctacttttttctttcttcctggatttggttgagtataattaataattaatatttaaatatatgttcagtttagccaactaatgaaaaacttagactaacagcatgctctttgaattcaaattaaaatagtgtagatgataaatatttattattattattattacttttaagaccgagtctcactgtattgcccaggttggagtacagtggtgcgatcacagctcactgcaacctccgcttccgag

SEQ ID NO: 8603 - DNA, 1024 bp, Homo sapiens
aaatacagggttgaagtttttagttttaaagaatcaaaatgtaggccgggtgcggtggctcacacctgtaatctcagcactttgggaggccgaggcaggaggatcatgaggtcaggagtttgagaccagcctggccaacatggtgaaaccctgtctctactaaaaatacaaaaattagccgggttgtggtggtgcacgcctgtaatcccagctacctgggaggctgagacaggagaattgcttgaatccgggaaggggaggttgcagtgagctgagatcgcaccactgtactccagcctgggcaacagagcaagactttgtcggggtggggtcggtgggggggaatcagaatgtaattatggtgtagtatgaacccagaaaaccagatatacagtgacagttttttccagtgaataaattagcattctactggtgtagtacttttcaaagtttaatgtgcataggaatcaactgggatcgtgttaaaatataaattctgattcagaagattgagaatagggcctgagattctgcatttctgacaagtatacctcacaggccttcctgttggatttgtaagctgtttgctgttgcctgagtacccatctgatggtttgccagaatgaatgtccagcaggaaagatagtagagccaattgtagttcctcttccctgtttcagaatttttatgctaggtaaccaagtaaccaacaccagctctaccttttgcccctttgaacttctcccttttatataccttatggattcctaatatgtcatgatctgagagggatctaagttttagagctggagtgggcggtgctggtgtatgtaaataattatctatttgggtctactttctgcttacataatactcccaagaaataatatggttttaaagaatattaatagagctgaaataaacgacattgattcatttgctaaaaaaggattttaaaacaatagaaataatagaggattataaaagtaatatgcttatttgttcagttgaaagacataaggag

SEQ ID NO: 8604 - DNA, 1023 bp, Homo sapiens
ggggtttcaccatgttggtcaggatggccttgatttcttgaccttgtgatccgcccgcctcggcctcccaaagtgctgggattacagacgtgagccaccacgccggcccttcatagtttttgtatttgcaaaacaagtgctggaaagcttatttaatgtttgtctaaaaaccactctgtttccagtgaagcaaattatgttgctgttaatgatgttgctttatatttctagttggatgatgcccagatttttattttattttttccttaatatgttatatagagatgaaacatgagaatcactaatcctggctagtctggaaccagttatatacttttgggcaagtggtgaatctctttgggcctaacctgtaaggtgattgtaaaaattccttctggttctaaaattctgtgggttttattacggtgagagcattatcattgtttttcttttagccatcttctcttaatacttggtgataggaataccagaggagcttgttaagaaagtaagttagaatgttccttcagtatgcttctgaatggacttgtcttataataggtaagtaaatactgaaaaggctcaagtattagtaatcataagattaatcatcaagatattaaatatttttattaaaaatgttttctttccttttttccttcccttctctctccatcccttcccagcctccttttcttccttcttttcttaatattatttcaattcacaaagctcctgtggaggccatatggtttctcagattaatttaactttgggtggtatttaatcgtgttgtcacccactcataattaatttctgtttgtagtttattgaagaaattcccagttaggtgccttctttatgcttgtgattattatctacagttaaaattcattcagttttttaagaaaaaaaatgaatcaaatttcctcatcattttataaaataatgttcattctatttctacctctttgattctatcaaattttagctaatctgcttgatcacctaattctaagctag

SEQ ID NO: 8605 - DNA, 1073 bp, Homo sapiens
gagaaggcctttatttgaaatccagctgacacaactgaatttctttccctacgtgcttaacaaaagcaccttacatttggaacttaggagtcatttccagaatatgtgattaataggaggcttctcatagcaacttttaagtgattcttcaacttacattgctgttccactcttaagattgattaatgttggccaggcatggtggctcatgtctgtaatcccagcactttgggaggctgaggtgaaaggattgcttgagcccaggagttcaaggccagcctaggcaaaatagtgagactctgtcctctataaaaagtgttttaaaattagccaggcatggtggtgcatgcctgtaattccacctacttgggagactgaggcaggaggattgatagacctggggaagtggaggctgcagtgagccgtgatcatgccaccgcactccagcctgggtgacagagcaagacactttctccaaaaaaaattttttaaatttgattaatgttggtcttttctgattagtttaaaaatttaaatatgattatataaaatatttaaatttgtttagattttattttataactagaaggatagtgttgtggttagaagaacaagtttgaatcaagcttgggatgtagtcttcactctaccatttaaccagtacttggaacttcggttaaagtacatctaacgtgttagaaatctcagttgtttcactgtcaaatgaaacttataatggctatcttttgtggttgtaagtaagatgcgtaagttataaataatacgtatatataaatcagtttggcctgttgcccagcacatagtaaatattttgaggtgcataagttctaagtaagatatacatataaatcagattggcctattgcccaccacatgttaaatatttggagcgttagctatggttattattaacaaataccaaatcagtgttaatggaaaaattgccctgaacttgtttaggtttttcatagataatggtttgtggttgcgatttttgtattggaatacacaaacacacacacacacacacacacacacacacacacacacgt

SEQ ID NO: 8606 - DNA, 1055 bp, Homo sapiens
tttaaaatttggagtgaaatgccttctattcctctgtgaatgtacttctaaaagaatatgtaggaaacagttaattgttaatatcactgcagtttactgactcattattctaaccagttgaggaggccgcatagcatgctcatctcagcatccagacatgacttgagttctaatttttctttcactacaacccctttaagccctgatttcttcatttataaaatgaggttgatggagtcttatctcataagattgttacaggaattgtatccgttatgatgctttgcaaaatggctggccctgtaactgcttactaaatgttagcagtaatgataatcatgttaattattagtagtggtcatctgtttggcttggcatcaatgcctcaaataatattttacgtttgggtggttatgtttctaagatggacatttattgcagctatcttgtcaaactgtgactacttttttgtcttctttctatttcacaatctctattctcttataccataaaacttcaagctttagtcgtactctgtactcacttgcctctcttcaactctgttcttaacttctctgatacttgtctattcttgcatattggagttttctataacatcagtcaacaaaaacagctcttctggttaacaggctctaagttgtccttatcccttctgaggcccttttctcggtcagaagtctatatacagcagaatgtcttctgttaaactccacaagcctacatctataaaaggcactttaaattctaaaagatagatattttaaaaatacatagtcttttattccttcaaacacgtgcaacttaacaattcttggattatgtttaaaataatttttggctaggcatggtggcttaagcactttgggaggctgaggtagaaggatcccttgagaccaaggagtttaagaccaacctgggcaagatagaactgtctctaccaaaaaaataataaatacctctactaacaatttttatcttttttatttaaaaaggtgatctagcatttctaaagaaatgagtttagaattggatac

SEQ ID NO: 8607 - DNA, 1024 bp, Homo sapiens
tgacagagcgagactccatctcagaaaaaaaaaaaaaaatcagtaaggccaaaacataaatacagagaaaattctccagaacaagagagttctttttataatggcatttaaatggattgcctttctttttcaaaatgtgcccattttatcactttattttctgcaaccatttcaagatatgttcccaatctctgtcatgaacctggctagaatttttagatatattttaccctgcagcaattggctgcaactttctatgattgcagtggctttgtttttttaatgactactccaggttgaatatcccttatctaaaatggttgggacctgcagtgtttcagattttgtgttttaggggggtttcggagtacagtctttgcattatacttactggttgagcatgcttatctgaaaatcggacatctgaaatgtcgcagtgagcatttcctttgggttcatgtcagtgcttaaaaagttttagaacatggagcatttcagattttcagattagggatacataaactgtaacatttaatgacttaaaaacaacattatacatcatttgttgaccatctactggctgccaaacaatatactctaccttcatttatgttactagacataatcctcacaagagccctttgagattttacagtctcctaaaagtgtcctggatgacacatattaaatggctaaaccatgattttttttaaactcacatctgccagcctccagtattcatgttctttttactaagccttgttttcctactaaaatgtattttttaaatgtgattattgccttgacgttctagggaagatccaagtaactgtttccagacctgcctgacttgatcttattgaggaactgacagcaacttaatacatttaaattgaattctcactgaaattcattaagaacttacagcaatgtgaacaatggcagagctatttcttatcatcagagggataaagtggaggttcatatatctagctctttctatacttttatatagctaatatta

SEQ ID NO: 8608 - DNA, 1044 bp, Homo sapiens
tctttacagttgtttcagttcattttgattcagtgattattttatatccaaataagtttaacaatgtactttgatgttttgagggaatcttcttttagttgaagttggttttataattttttaaagtttaaatatccagatttaagtttaatttaaatatccagattaaagtttaaatatcacaaataaagatttgtgactttggagcactcattatttatttaattaacaaaaagcaaaatttgattcatttcccatgtattttctaattctgctttttagtaattgaaattatttttgtcaattgaaattaggctaaaggctaactcctagactttcctttttgttttgatattattaatacatgagggttgaaaaaagaccatcttgattaatgaaaattgatcaatcatctataaaggaattcctagaataaattgtcatgtcaccagtattaaatatatatttcacatatattttcagtgcctatcacatgaatcaaaatagagcagatgtaaaactctactgaagatgtcaaaagcttgtgcatatttgtgaactctagaaaagtttattgactttcattgaaatgttctttttttctagtttattggtcagggttcttagttttcgacaacagaatttaaatcggttggtttaaactgagagatttgttagagggaatacaatagtttccagacacattgggagacctaaaggaacagacagtattttcaacttctagaaacttctagaaccacacctttgaactggcctgctacagagctgcctgttttaaatagcctagcactgtaggttctatttaccttaattcccctagcccactccgtgttagccaccactgacaaccccagatgaacaaaaccctttactaccatcctggttcctggtcctctgtcctcccaacccaggtaggccatgttctccttccaaatcttcattcagcatatctgcttggtgaatctaggtcatgtggggccctagctgtcagtaagttttggaaagcagttttagctacagttt

SEQ ID NO: 8609 - DNA, 1627 bp, Homo sapiens
gtgaaggctgcaaaacagcaaagatggcagcctgctccttcctctggaagctccatccctgcagggtactgacctgttcccagcctgaactgcacccgtacgaggtggctagagaccccttttgggaggtgtcacccaggtagcaggagtgggatcagggatccgcttaaagaaggagtctggctcctttttggtagtgaagctgtgctgtgctgtgggagaccattccttgtccagaccatctggactctccagagctggcaggctggaatagtcaagttgacagaactgcagagatggcagccgcccctccccctgggaatttggtgcttctcaggcaaacctctctgactggaattccaagccagtggggcccacagaattacactacttggcttcctggattcagttcccctcctaagagtatctagggacagatctctggccttgccaggaatcctggggccagagtatgcaaaactcctgagtctctgtgtatgccccagcggctgctctgccaggactctatacaggtgctatgtattggaccgaaggccctggtggtgtggcttacaaagggatctcctaggtgcaaagatccatgggagaggtgtggtttcctgggcaggatcgcacaatcactcactgcttcccttagctgggactgagtgttcctttggcttcgtgctgttagaatgcttgttcttcagtactgcaaggaaaaatcagcatttagacaaaaagttctctcagcgaggcaatggtgctctttgcagatagaacaatggcaagagcacacttgaacaaaggagggaagcaatttatgtcttttatgcagcttgtcttttctactatgtcttgtttccattggctggagccagacctcacaatctaaactaaaacctgactggctaataattttaaacttttctaaataggtgaaagcaatggaaggacaaaggaaaagaggaagttgtttactaaaggacttagaaaagtaataacattcttaaataaggaaggggtaggctgcaagctgggacatgcctgtgagcacatctactacaagtatcttggttaaggtacaaggacatagaatgtactacttgcctgtgagcctgtgtaacagctacataggatagggcttaacaaagggttattagcacaaagcaaggaggcttgaacaaacttagtctttaaaagaaattattatttctaacatttattattatcctttaacaagaagggaaactttgaagaggaacttctactttctacagtgccgctcccagttggttcatcaccccaccctgcttttcttctttctctgtgggttgagatgtttgcccagtcagtcccaatacaagaacctggatatttcagatgaagttgctgaattcatttgccgctttcattcttctctgtgagtgctgcagactgcagctgcttctaattggccatcttggcccccttagtattataatcttatgtgaccaccattgtatatgcagtcattgactgaaacattgttatgtggcacatgactctgtttttacttaaaaacctcttaaagtcctttattttggattctgtcaaacttcataaatttgaatagtgtcatgagaga

SEQ ID NO: 8610 - DNA, 1031 bp, Homo sapiens
atgaatgatgaacattttaatatgaatgtaaagttttagagatacaccaagcgtggtgtggtactgggtttctggaggaaaaatggagttaataaattttacggccaacattccatgaggaagtgaaaaactttgcccctcccaaacccaaaataaaggaaaagcttgaagtatggtagtcacttcataagttcctttgagataatttttttcacctactttttaattcattatttcttttttacattctttctgctgttcatttttagccaataaatatttttatttcagatatcttttagttgtacaatttctattttcatttttagagtttttttatctctttaaccagtttgatccatctttttatctgaattccttgacatttataatcattcttttaagatgtaatttgctaattccccaagtgatctgcgattttgcttctcttcccttttaagggtcacatttttcagtttgttctcatattttatgctagacattgtataaaagaataatacggactagagtaggtaatattttcccttagaagaatatctcctagctagctagcgggaggggtcgatcccttttgatttcccgtgtcttaagcacaagatcaagcccttccctgtggccaagttcttgggaagaccatcaaaataaagctgagtttatggtttattacagtaaggatgaccactacattgacagtcttaatagcatctcagaggaaggacgtgagaatatttatgaaattctcagcaggtctttcagtgtgtgcattggagggaaaaggtcctgattaggatttggcatgagttgagaactggtagacacatcaaggggtgggttttaaagtgagtcttggccgggtgtagcagctcacggctgtaatcccagcacttttggaggctgaggcgggcagatcacctgaggtcaggggttcaacaccagcccagtctctactaaaaatacaaaaattagccaggcatggtggtgcatgtctatagtcctagctactcgggatg

SEQ ID NO: 8611 - DNA, 1053 bp, Homo sapiens
tcttttttatgttagagtgagggtcttttgcaaccttctacatcctaattagaagtcatccttggataaattgctttttaaagcccaaactggaaaataaatctgggcctacatatttagaattttagaaagttcagaaataaagttaggaaaggtaaatgaaagtaaacataagttagtgaagtaaaggtaaatttcatgttacctttcagttctcaattcagttctttgatgatctacttgataggagttgaaggctgcagcaagcaatgattgtaccactgcactccagcctgggtgacagagtgagaacctgtctctttaaaaaaaaaaaaaaaactacttgataaatgatagagatatttaaaaggtaccaatatttagctttggatggaatcaaaacaagtctttcagttactgagttttttaaggctaatgcaattgctattaaaagaaactttaaaatgtttacagttcaaaccagtgatctcttagtcataatactctgttttcattttactttttaattaagctttaaatttttctaatggcttaagaaaaaacttcaagattagcccatttatttgcaattgtgttctttaaatcttataatgcttctggaaaatctctgacagcagaatcctactaattctaagcttatttctaggtattaaattagctcttagtactttttgttgtaagttgacctaattttgaccttacaaagctaatcagctaacgaaactaattattaaaacaattattaaaacacatctgtgctgcttagaaatagtaagatttgtcttgaacttgcatcataggttttaatgggacatctggtgtatattttaataggcttcattaagtaaattttatgtcttgggggagaacatttctcattatgtgatcccacctctacagttggttttaggctcctccttgtgaatgaccatgtggtctaaagtatggtcttgaactttctactctgctctgaaacctgaacctttgtagctgggcttaggtggtggtgcgaacatttaaatctcttcgttt

SEQ ID NO: 8612 - DNA, 1305 bp, Homo sapiens
tacaaatgccaaaaaaaagttaaatgctatctgtttgaagttaacaaataaggaagtactactaagccaagactcagaaaagaaggtaatctgaaaaatgagactaacaattggggctgcttttgccctataggcatttaccaattcagaggaaggagctgaaagacttgtgtagcccttttgatattgctcacgtggataggaatacaaagtgggaccctaatagttttgcaggactttgcattgggactgtaaagactgtgcccaagaataaggtatgagagaagtaaatgaacacttgcatggactacagcacagcttcaagtcatctgggtggtccaggaagtctcaaaccctgatattagattaagatctcggtttgccatgcccccaggttccttgcagaaacaaaaattctttctagaagattattacaggtttcaaattattttcacaaagtttttcaaatattaatgttcaaaacatattcagaggtaatcagtcacacaaggacacaaaacaacatgaatcaagaaccagttgaagcagtagacaataaaaacagagctctaggtgctccaggaattagttatagcagacataggttttgaaaaactatgcttactaaattcaaagagaaaaaatactgcaaattttaacaaatggaaacattttttaaaatacggtttggaaaagaattgaacagacattctaagaccaaattaaatatgatttgaacagcagatcttcatgtattagtgtagagaagatctgcgaactggattttagggcagaagaaaatgtccagaaagaagcctggagacatgcaagaatgagacagagggaagggcaagaaataacgtagatacaagaaaaggtctaattacatatacatgtaaatgggcatcccagagaaaaggaggatgagaatgttacagtatttaaagagatgatggctaagaattttccaaaacagatgaaagcaacaatttaagaagtcaacataacctaaatagcataattttaagattgtatccaaatgtaggtgtatatctaagagaagtgaaaacatgtccacgcaaatgtttatagcagcattattcataatagctaagaaatggaagtaattcaaatgtctatcacctatagaatggataagtaaaatttggcatatccatgcaatggaatattattcagctacaaaaaagaatgaaacacgatacaacatggttaacccttaaaaacattacgctaagtgaaagaaaccagtcacaaaagaccatctcttatatgattccatttaga

SEQ ID NO: 8613 - DNA, 1269 bp, Homo sapiens
ttttatattactatgtttcaaattgaaggggtttttttttttcttaatctcttttaattaagagttagtagcatgcaactgttgtcccagctactcaggaggcttaggcagaaagatcccttaagcccaggagtttgatttcagtctgggcaccatagcgggactccatctctaaaattaaataaaaatttttaaaaataagaatcacacagaaaagaaaagaaaaaaaggtaacaccacaaaccctgtctctttaaggggcattctagatcatgttggtgtttgagggtagacacccattttaaaaccagaaactccctttgtttttttcagagcagcaatcttccactttctcaactgtacgaatgctgtctagtgagtagatagattatctgcacacagtttgaattttaggtgaattccttcctaacttctcctcatgcttctgctttctgtttaatgtgtgctgtggaactgagtattactgtaaaccaaacctcattagaaatgtgactgtgcttgaagactcaaagatactgtgaggcatttcacatagatgcaatttcagatatttgtcatagattctttccagtgcttacaactgaagttaactatatctgtcatttttctttgtcttaaaacttattttttggttacccagaacttcccagtatttctttcactatattattaagggctggaaatttttaactgaaattcatacacagatttggagattgattaataagcatgtgtggctggacgtggtggctcacacctgtaatcccagtgctttgggaggccccccaaaaaatgtggggaaaaataaatcctagtaagctaataagagcttttgtgaaaatttgggtttaaaagcagcttttgtgacatcttcagatacatgaagagaagcatttctaattctgattaaaaaaagactggcaataaatataacagttatagaagtataattacagaaagatgagaggctgttacatgagtttaaaacaattttaaaaggtacactaaaaattttgaaaacaaaaggatgttttagaactatgggttttctgttcttgttgttccagtttaccttctgaagaacttcttttaaaatgtttctagaggaagtctattggcaatgaatttctttacttttccttgacttgaaaatgccttcattcattctgtctagatatagaattttaaaacttttttttctccatcagtgtctttttcttttccatctggaccaccaatgacacgtta

SEQ ID NO: 8614 - DNA, 1050 bp, Homo sapiens
attaatgataaaatagaaatatttaatgtattgtaaagtttttacactgtatgtgaagcagttaagtatgtacattgtaaaccctaaagcaacagctaatgaatttaaaattaaaccacaaactatagctaataatttactggtggagacagaatggaatcctgaaaaaagtacccaattcaaaagaagataggggccaggcgtggtggttcatgcctgtaatcccagcacattgggaggccaaggcagcaggatcgctgaggccaagagtttgagaccagcctggggaacaaagcaagaccctgtctctaaagaaaaaaaattttttttaattagccaagtgtggtggcacataactgtagtctgagctacacaggaggctgaggcaggaggattgcttaagcccaggaggtccaggctgtggtgagctatgattgcattactatacttcagcctgggtgcagagcaaggtcctatttctaaaaaaaaattaaatttttttaaagaagaagatggggaaaaggacacaaacaggtgaacaaatagaaaacaaatggtgagatgatagacttaaattcacgcttaaatagactgataattacattaaacataaaggatctggaaaatgccaattaaaaggcagaaatagactgaataaaactaaatgctgcctccaggaagcacactttaaatataaaggcactgaaattccggtcccaggtaatgtgataacagcacattctatccaatttttcccgccaaatgtagctataaaaccagagtatatggagcagccatcaagatctctgaaaagtaatagcaaataattgggaggagaagaccggaattctaagtaccagcaaacttgtggtaaatttatgttttcttccaatatcccccagcctggaatccagatagcctgaaacctaggcagggatcagcacagacagcgagagctcctggaggagcaatgaatgattgaacttgtgatttaaaaaacaataccatttacagcagcatcaagaaaaattaaaaccttaggaataaatt

SEQ ID NO: 8615 - DNA, 1065 bp, Homo sapiens
catcattctgatttctgcttttatcttcacactgccttcttctgtgcctctgttccctcttcttttcttaggaggacatccatcattggatttagggcccaccttaaatccagtataacttcatctctagatcattaactaattacatctgtaaagactacatttccaaattaggtttcagtctgaggtttgagatggacatgaattttggtgtaggagagacattagtcaacccctacaataggtcaatatcaagtttccatataataaagtgtcttgttctgggctctctgttcagtttcattcgccagtttttctatcgtatttctaaaattatggtcactaacttgaacttaaagtgctaacattttatgtggttcccattgtgatattttctccaaaaaaaatatataggaagtttttgacttaaatatatcttagggctttttcaagttggaaccactagaaaataagaatttcagttctgtatttaacttttttagtgtcataaacttacttgaacatgtattttagtgcaaacgactaaatgcattaccattacggagctatctgtatgtcgggaaagtactctggcctgtgtagaaactggtagtgttctatatacaagctgtctggtttgatttcaggaaaataaggtgagagaatatgaaatctcatgtggtgagaactaaaacatatgaatggacaccctattgggtatttaactctcagtggttttgtggttataggttgataaccacattgatcagagttaagtttatttctcagtaattgagattgtattttacacatcagtattttatgcttttcctgttataggcagttttaggtaagacttcttttggagtctgttttaaacaatttagctccgaatcatcttgtatcttttcttctagtattttttctttgaattttttaattcattcaattcctattttttccttacacagacttttgaatatgttctgatcagtggctaatttaacatgtttttctctttcttatttaatttaggggaaaaagtcaataagcatatagactact

SEQ ID NO: 8616 - DNA, 1066 bp, Homo sapiens
ttgtgtctagaagtacatcaaggattctcgttttgcctaagactattcttagtaagaaatgagacaatgacatactcagcaaaatgaagaagtaatctaagttattttattttacattctgcaaagtgaagatataaccccatcttttgattggaaatcagagcaaagatttttcctaaaaggagagattgtaaaatgactagcctggttgcttttgaatatatggttttcttctatgcttctgtaagcaaaacaactaacatttctctaggataattggaaaaacttatcaggagtcaatataaatgaaactataataaatttgtttattgtcttagcagaaatgtagctgcacagcatatttttagaggctactatttcagaattgagtgatcaagatactcattcacttcatttgctatctgttgtatttagacgagctagtggaattcattcaaggtccacaagtagatataatcacatataagtggattctaattataactgtattttaggcctgtatttactcacagattctcagtcttcccacaacttttcccaccggtttcagtattactttagtacaatagattgcattatcttgtaatttatattaaatatagtggtatgaaaattgtacattttcaaaattatctttcattctcttttaaagaacacagagaaattactgcttttgtggcacattctgttactttacttttgtagcattaggtatatttccaaggtgctctttgagtatgttgtaaatatgtctgttacacattttatctgctattttgaaaactgatttgcccagcattatttgggcataatgagatactgattgtgatttttccaagaacaaggtaagtgaattacaatctggacatgaatttccgatcatttctgttggttgatgtctctccatagtattatattgtacctgtcactagagactgctgagaagtcattgggtgttatctcaggtctgtgtcctgtggtgtgtggaccatcgtgtaacctaaggaattgggaatccaccatatacagagggaggcatccctat

SEQ ID NO: 8617 - DNA, 1060 bp, Homo sapiens
tgagatcaatttatacatatattcatttcatattttggtatgtttgcagcatttttgttgtatgtgcatgtagttaacatgcttatcttcctcctgagtcattattgcttaatcttttatatggaatttcactttataaaacaaagcataatctgttgctgaaaactctggttatttgtcttgatttgactaaattataaataattccttttgtgcttttgccatttcagaataaaactataatttacaattgtgtcatttatgtctcctgcagtttcaaaaaaatcagcaaagcaaagattctatcttcttccgagatgggattaggcaaattgattttgtgctttcctacgttgatgatgtaaagaaagacgcagagttaaaggcggtaagtgcattataacagaagtgggaataataaaaagaagcacattttataatttcacatggatatctggattgaattatgttgtaaaagtgagaggccctgaagtgttactgaaaactgaaactgaatgagataactgtaaagtaggcagcctaagaatagacatgtaaagtcaatgttatctttttggatattttgcatactaacttatttttcttcttcttccaagtaactgattctttttatagctcactttagatattaaatgtaacatccaaaatttgaggtatgtgtctgaatataataattaccttttgtatgatattttcattttggaaatgtatgactaatccattgctccaggtatagcttttatattgtactctattcctgattctattttatttgtattacacatcactttatgagcttatttattcatgtttttacttgtttgctgtctccaacactataaattaagtttatgaggccaagcactttgtcttgttcaccgttatgtacccaaatcctagaacaatggttggactataatggatactcaataaatactcaatatttgaaatcataaattaatccatttttatacacatatatgtgtgtgtgcatacacacacatttacttatgtacttacaacataaatgtcatataaa

SEQ ID NO: 8618 - DNA, 1035 bp, Homo sapiens
agttcaaggccagcctgggcagataatgagacacagtctctatgaaaaaattttttaaaaattatccgagtgtggagacaccttcttgtagtcccagctactcaggaggctagggaggatcacttgagcccaggagtgtgatgctataatgggctgtgatcacaacactgtactccagcccgggtgacagagtgagaccctgtcactacaaaacgaacaaacaaacaaatgaagaactaagcacccaagtggttattttcagtaatgacctatagttaaatgtaagtttactttttgctaagtgaagccattttgtccttcaggattaaaaagtcttgatgacatactggcttaaaattccattaaatgtatagtttatttgaagagtattgatctttgtaatagtgaatcttttcaacttggagcatatgtctctctgtttataaagtttttttataatttatgttattcagtaaagttttgtacatttcttcagatagaggctctgcatatttcctggtgattattcctggatatactgcatttttgtagttgtgaattatagtacaagagaaaagcagtacctgacattcagatggagcatttttatatacaaccatgggaggggcagagagccatccagagtcacagccattgtatattgaatctgtcaatactgagcaaataaaacaaaagcattctgcataattctgttgatttttttttgtcataggaaagaagaaaagagtttgaaactaatctcagaaaaacaggtcttgagttggaaatagaagacaaaagggtaaatgtagttgataatttatacaagcctctttaatttaagtgttgttttctcctactctggcctttgcctggatagactctgtgtttgggggcaatacaatagctcttttggctacagatatgtgcaccgggatgatagggcctgtggtcttacaggtaagtagatgagtactgtgaatatgcagtaataaatggaacactttataaattgacacagtttgcattcaggat

SEQ ID NO: 8619 - DNA, 1032 bp, Homo sapiens
ttgagatgattttatgtttttcacctcaaaccagtcaatgtgatatatttattgatttgctaatttttctttcttaaaaagcctctttttaaaaaaagtggtacattatcataatatatcatctttttatatagcatggaatttagttggttaaaattttgtttaatgttattccatttattttcatattatgtaagtcatttcctattatagtcaatttcatatttgtttgaattttcttctgagcatcatgacagcatcaggattagtaagtggtcttagtggtaactctctcctccacttattccttagccaaactgtctctgagtaaatatatttctctgagcagagtaaagattgtctcattttctcaatcaccctaataaagaactcttgacttctgcatgtgtcatgaaaagaacaccagattttgacttgcgctttggctggtgtcatttctctttgctctgtgatcttaagttatttaatctctaatttctgccagtttccagatctaacactctgattctctgatcgctttctttttggtcctatttcatatattaacttttatcacttccaacagcttggctttgaattggtggagacgccgaaaagctcggacaaactctgagaagctgtatagtcgatgggagcaggatcatgaccttgaaagttttggaccccttgggcttttctatgagtacttagaaacaggtaatttttaaccactgttttgaaacatagagttggcatgaatgagtggtttttcagctccagatacttctttctgccttgcacatggtaggtgttcaataaatctttgactggttggcaaaaaagatgagtggagggatataaagaaaatttgttccctatttccctgttccatcaaatagactgcagaataaagtttagcttcaaaacaccaatctcagagacataattcctgttaattgaatgttaatattgttgaaccaaatcaagtaagagtcattttttaacacccatctcaaattcgctttgatggct

SEQ ID NO: 8620 - DNA, 1027 bp, Homo sapiens
acttgggaattaattctaatgaatttgccaagcatgtcatgattgaggaaaacaaagcacagctggctaaatcaacactctaatcagtatagtgaggaagcagcaggtgatctgccttacttcactttatcctctggttttagggccagacgccagaagccatgtgtcaattttaccctttcttttttttttttttctttttttttttaaactcaaagtttttatacacttttatagaggccaactttgtgatgttggaaatgtactacttctctgcttcattgactgggccctctccagatgttgttttctgaggtgctgtaaatgactgttgaaagtgcaggtagaatcagaatactgggaaattatggagtcttgcagtttagtaagaaacactggccttgggctgtcccatcactttccagtgcatctatttatttttgtggtcttctcttgggttatttgatacctccttccccattaagaaaaatgttggggcaaaaagaaatggatcaaagagactgactgagccctatatatcctatcattttaaaatatgcaaatgaattgccaagatcagatgacataagaaaactcacacattaaggtgttaatgtatcatagcagaggtttattcctaacacattcaactaccatcagaatcccagatagttcttcctggtaaaggcagaattccttttctcgagactgaaattttgggtttcaacataaaacaacttggttcttagagataataatttggttataatagtttcaagactgatcttatctggaaagcaacattatgaagctgttagattgcttcaggttctcaagcaaagacacaatacagaagtaaatgtgttttcttagtagttaatggatgcaggacaatgtatattgattaatttgttgattttaatttagaaaattgttaaattatttcttaaaaatcacttttcttctggaatgccaatttcacatcatgaagcctttttgtataagttagatacgagttgtttatgat

SEQ ID NO: 8621 - DNA, 1042 bp, Homo sapiens
tattcgtcactttcctgaaaccatgctaaccaaaatcagtagccaaaccaattcagatagatgtgtctcatctaattaaacccattggtttttatgggagggctgcattaagagcacccaaccaccacatgtaagttgataattaccagcatggcaggtgattttatctgctgaccaagcgcatagttttgttttgttttcagaatgttctagggaacatttgagattttatgtgaaataaaattttaagtgccaaagccaaaaaaatacttaactcttttcaaaggccctctttcatccttgccttcgtcaactttcctttgcacacaggaagcaaaatctacttcaagacatttattttagaggaatccattaagaaaggattgttttacttaaatgaaatgctgtcttatttttgctgtgtcttttgacacctcttagctttaacattcttcttttaaccaagccattatgcaaagttatcaaagaagaggagaaggaaaggaggacagatgaaagtgacgggaaatgagaaagaagaggagtgaggaaacagttatttccttatgaatcctgtgtgtttctttggaagaaagagctgttccgaggaagtttggtccagctgtggttgataagaggtatatctcttaaaaaagacacctaatgaaagtgagagaaaagctaaagaaaatttcaatgtgaccactattatgtgtcaaaataaaacttagattccaaagtggttttgtagtgttgggtgctatgagtaggtatggatctctgttgattgactccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccagccttacaagtcagccacaatgagtcggtataactactgtgttattctttttctagacaaattttgactcttctacttttatgtgtaataattc

SEQ ID NO: 8622 - DNA, 1044 bp, Homo sapiens
gaaaaatatcaaattaacaacctaaacttctatcttaagacacttaaagcaaaacaaactaaactcaaactaagtagcagaaaggaaacaacaaaagttagggcagaactagaataaaataacgatacagaataggaaaacatagaatataaataaaaacaattgagaaagatgatgaaaccaaaatctggttccttgaaaagatcaacaaaattgacaatgctttaactagactgaccaggaaaaaaagaggaattactaaaatcaggaatgaaacgggacatttctactaaccttacaagaataaaaaagaatattaggaaatactataaaaatctctctctcttgccacacacgcagtatatactatatataactgaatgtatgtcatgtaacttatctaatttgttgaaaaatatatttgtcacacaattcacgtcagagggtcaccatgtaaattttgattcaaaaactcgagtatggcatgaacatttgtattttctgaaaatataaaggtttttgtgagtgacatgtactttttgttgagaaccattgatctaccacatggaaggcataaaaattgtggaattacaattaaatatgcatcaattagaattaggtatagctgcatataaacacaaaaatccaggctgggcatgttggctcatgcctataatcccaactttggcatgatctcagctcactgcaacctccgcctcccgggttcaagcaattctcctgcctcagcctccccattagctggcattacaggcgcctgccacgacgctcagctaattttttgtgtttttagtagagattggatttcatcatgttgaccaggctggtctcgaactcctgacctcaagtgacccacccaccttgaccttccagagtgctgggattacaggtgtgagccaccgcgcccagctattcccagtattctgggaggctaaggcaggaggatcacttgaggccaggagtttgagatcagcttgggcaacatagcaagaccctgtctctacaaaaataaaaaataaaaaaaat

SEQ ID NO: 8623 - DNA, 1072 bp, Homo sapiens
gtagcacttgaggtgggaatttgaatcccttagctcatttttttttttgtaaactactttttccagtgattcagtgtcatattccttagttttccaaaagtgttcaaagctaatatatacagagttactaagctccttgcatcttagaagtgtttgattaggaatatccatattttgtatatatctacagtttgtgccacgaactgtttgcctctttactactggaaaaggaatcattatcatctttaaactgtgtcagattagaaagccaatttcagaaactgcagaatgattttttttttaaaaaaccctcacttttgaaaatctgtttctccagagccaatctcaataccaaaatctgtattagccaacgttctccagagaaacagaaccaatatgtactatgtggtggtggtgtgtgtgtgtgtgtgtgtgtgtgtatgtatgtgtgtgtagtcatcccttggtatctgtggggtattggtttcaggaccctctagtggataccaaaatctgaagatgctcaagtcctttatgtgaaattatgtagaatctgcatataacccacataatcctcccatatactttaagtcatctctagattactgactatctaatattgtattgcttagggaataatgatgtgacaaaagtctgtatatgttcagtacagatgcaaccatccatttttttctgaatatttttggtttgcaattggttgaatctacagatttggaacccacagatacagagggctgactagagaaccaataaaagccagtggtataattcagttttaagtacagaggcctaagaaccaaagaaccgatgatgtaactcccagtctaagtccaaaggcctgagaactagggtggttggttggggtggtggctgatgttagtcagtcctagagtctgaaggcctgagaacaaggagctgtccaagggcaggagaagatggatgtcccagctaaagaaagagataatttgtcctgattctgcctttttgttttatgtgggccctcaatggaatggataatgcccacccacataggtgagtgtgatcttcttta

SEQ ID NO: 8624 - DNA, 1030 bp, Homo sapiens
attcaagtgaatatgaaatttccactgccatgaaagagtatatagtgctcttagatctccgaacaggaggatttaaagtggtaagattttcttgagtgggaagtaatcataaggacaaagaatctagacaattaaataggttaagaggagggtaaagaacatttcaaagaggaaagggaacatgtacaaaagttctgtgctgggaaggagcttggtaagaatgaaagattgtaagcaagccactgagtgagtgtgctgaaaatgcaaagagggagatggtgcaagatgaggctggagaggcaggtggaggtgagagatgattaagtctgctttttaaaaagataattctctctacactgtggaggatggattggtccagattacttatgaggcttttgtccagacaaaagataatgagtggtaatagttgagacattggagaagaatgggcagatttgagggagatttaagaggtaaaaagcataggacaaagctgacatttattaaatactgtgtgagttcaggctgctagaacgactaggttgcttaaaaaaaaatggacatttatttctcacaattctggagaagggaagtctgagatcaaggtgcccacagatccagtatctgttgaggacctaggacttgaagaaaaagattgttttctggcgccatgaagctggagtgaaaggtaaattgtttatgatactttcaatacttgggctattttcttaatatttattcttaactttttccttgctattgttaatcatatttaagttccaaaacacccacatgctgatccactgtatacacattattttatttcatttagaaacttgtatctgtaaagtgactttaatttatttgaaagaagcattttattgctattttatgtagaataagcattaccacatagaaccaattaatactgttataactattaatctatataaaattatataaatttttctgtgtaaaaattttatgtaaacttttatttacatgaaagtataccaaagaaatcaccccg

SEQ ID NO: 8625 - DNA, 1032 bp, Homo sapiens
tttcttgcatgtaaatttccattgaatgctctgtgggcattttcatatggcaaccgttttagccaagatagaaactttgtttccctatttatgtattaatggtgttttataggttgggtaaaaaataaattaaggatagaaaaaaaattaaccagaaataacagtataatctctagattaatgcatgttgctgttaggtactatatactacattcatattctataagaatgtttaaaataatcatataaataataatttagctttaatcaatataatgctagaaattgaaaatagtttgtatgagaaagacattcggggagtacagttttgtaaatgtgttgtttgctgaaaatcaacattatgtatgtatgttatatacatttattttcaagcttcttaaaaattggacatgttgtagtttctatagtttttcctcaaaataattttaatgctagtgatagaaacttaaattttttacaatggacattttatatgaatctttcgctgtggttttattttgcaatgttttgcgtaaaagttgaaaagtgagcggaaactatgcaatcactctttttccctttgtagaattcagggatatgggatttgctgtaaaagtgtgagtagggaaactaaattctataaaatgaattttatgatcattcagatttagtacttaagactttattatttaattagtcttaggtgatttgggatattctgaccatcaactaaattttttagtctaatctaaagtggtactaatggtgttttaggagagtacaaatacattaaattcactatactgtataaattagcctttgatggttttcctctttgttaggttaatttattctaatgactcagactgggggatccttttattttttatttttttaatttctaacttttttgtttacatggtccttttgttgctggatttctcaacttgtcctcataggacatgatggagaaagtcctcataggacatgatggagaaagaaacatgttctaataacatattctcaaggtta

SEQ ID NO: 8626 - DNA, 1335 bp, Homo sapiens
atgaacaaggaccctattttttttttccttaatagaagatcacatttttttggacatgtttttagatacttttcagacagccagaatagggtttcaagagtctgttttggagctcagaggtaatgtctgagcatgagacaaagatttaccagatttaattcttattaagtcataacccatgtgatacagtccttgaggagtcttatagtcaaaagaacacagtacattaaaacaacaattatttaaaaacgaagcaagttctttatgcatttctcaaaaccatgaagggactcttaattcccagcagtactctctagtattgctcttgttccctttctcatcttttgttttcatcaaatgtagctggtgttccattcttttttcaaaaactactgaagaagctacccctctactctcatccaggctagttttattctaattcatccttcttcttttgtactttgctctgtactatttacgttgatgtaacggttcctattttgacaacataggaccttccttgcagtggatgatagggaaagaagctggtagcataaagccagatgttcctttgatgccttaggaaggggaaagtcagagaacagttatgggaacaaagacgcattaatgatttttgtcatgtaactgaatgatcagcatgtaagtaaaaactaaaaccatgagtctagatgaattttgccttgagaaaagatatcttgatcgttgagtagttccatcatttaatgactcggtttaggaagatgagcatagaggagactgattaggatctcttttgacatctgactggaacttctgagctaactcttgctttaggctgcagcctaggcatttgtttctttgaaaagccttttttgacatttcatttccaggttaggttctgctccagcaggcactgattgcctattatggtccttatcattgctataattatttatttaattgcatgtggtccccaatagactctaacctctgggaggatgagagacaagttcatcattttaaccccagtaagtgtaatcttttatgtagtggattgcaataagcatttgtttaattaattcaggcaggtattctcgtttggctcattaggtttcatatgtgtatgtcaatattttctacttagcttactgccaaaatatatagatctgttctttagaaaacaacataaaatagctgtactccaggttcttatatcagattatgactttgacctctctgtcacctaatacctataaaaagtttgggggaaataaaatttatgaaggactgcagtgtacttggaccatataatattcgcagtcttagaattactca

SEQ ID NO: 8627 - DNA, 1080 bp, Homo sapiens
tttctttatccagtctatcattgatggacatttgggtgggttccagcctttgctaatgtgaatagtgctgcaataaacatacgtgtgtgcatgtgtctttatagtagaatgatttataattctttggtatatacccagtaatgggattactgggtcaaatgatatttctagttctagatccttgaggaatcatcatactgtcttccacaatggttgaactcatttacactcccaccagcagtgtaaaagtattcctatttctccacatcctctccagcatctgttgtttcctgactttttactgattgccattctaactggtgtgagatgatatcttgttgtggttttgatttgcattactctaatgaccagtgttgatgagcatgttttcgtatgtttgttggctgcataaatgtcttctcttgagaagtgtctgtttatatcctttgcccactttttgatggggttgtttgtttttttcttgtaaatttgttgaagttctttgtagattctggatattagtcatttgtcagatggatagattgtaaaaattttctcccattctgtaggctgcctgttcactctgatagtttcttttgctgtgcagaagctctttattataatttgaccccatttgccaattttggcttttgttgccattgcttttggtattttagtcatgaagtctttgcccttgcctatgtcctgaatggtattgcccaggttttcttctaagatttttatggttttaggtcttatgtttaaatctttaatccatcttgagttgatttttgtataaggtgtaaggaaggggtccagtttcagttttctgcctagggctagcctgttttccctacaccatatattaaatagggaatcttttctccatttcttgtttttgtcaggtttgtcaaagatcagatggttgtagatgtgtggtgttatttctgagggctctgttctgtttcattggtctatatatctgttttggtaacagttccatgctgttttggttactgtagccttgtggtatagtttgaagtcaggtggggtgatgcctccagctttgttctttttgct

SEQ ID NO: 8628 - DNA, 1031 bp, Homo sapiens
tatgcacgaatgagttaatctctatttttatactaaatcactgtcaaacacataccttcatttccttaatcacataatataaaataactacagtgttaatatacttataaagaaacttcttaaaaatataaaagcaatgtttttcttcatgagcttgattaaactggaataaccttaaacaaatctttcctggaaacttcttagaagtaaataatagaaagcttcaaatttctgtgagatatgatagctatttaaaattaaaaattagtaaatataaaattaactaaatttatccagtaatccagaagttgttctgaacaaaagtaggtgagtttgataattatcccagtgctatggccttctctgaccaaataaataaatcacagctgagctttgagtatctttgttgttaagttgctagagatttttagaatgtttgaaaattcatcacttatgaagtgcttaaattcaatagtaagattgtacattggtataccatataacttttaaaatggatgaggtagatctcgtaggggaggtatgtgatattaataatgtataactcagggtcattaagaaggactgaaaaggggaaagcgtattggacagtacctggtacataagaacacaataaatgtttgtgcttttttttttttttttaacacggaccgatgtccatcttatattaaaataatagaaacatagtcaccacatacttgcaacactagacatatagtataattttattttgttatctttatagggaaaaatatatgtatgcataaatgaatatgtttatgtttgctcctgtatagaacaaggtatgaaaaagaagcacttctaagtttatattgggcaggctggatggaggagatgaaaattacaatgaacttttcattgttatttattatttgaaatgttgcaaatggtaacaacaaaaagtattctgtaatttcaaaagaaaatacattttatttttaagaaaataaaaattttctaataaatttcctaaaaaataaatttttaaaatg

SEQ ID NO: 8629 - DNA, 1034 bp, Homo sapiens
tagattaagtgacagttctgttgtacgtgacttggactatgattaaatacatcctatgttacacataagagtgaaagctatttatcacaaagaatgataaatactccaattatttaatgtaattgaaggacatactttaaaagaagagaaaataaattttacttttatgacaagtaaagatttattttgtgaataggaaaggatttaagctacaagaggaaacatttgcagaattaggcagaatgagtcatcatagtaacaccaatacttctgataaaatgggaagagatataaatttattgcaatgcattaattgttttgtttgttgtaaaacttttatgtgcttctgagagttttttcccttttgtataagcccatataatagttaccaataaaacaaagtaagtgttagcagacagatacttgaccgagcttcacaagacaataataaatcaagggttttggtaggagaaatgtttgttaaaaaatgttagctaactataaggttggacttctgtgttcacagttacatgttctaatttatttcaggtctaacaactatatcaaatgtgacagatttctagttgtcgacatgttagacagaaaacatgcagagccttagagaagtcagtaatatagtcttgagtgattcagcacacaatggtagaacaatagcttgccttagcaattacaaacatttcaggggcattatgaactctttttagtgattttttttttttttaatgtccaaataaacttgtcatactagctcatccctctcttaacactgaccttactaattatgtcaaaggagcatccctctgttgtcaaatatttgccaggttgaccttgtttggaggcgcaatattcccaaaggctgaaccccatgaattgtatatacagtgaaggtaatttaatttatttttttgttttttacatgaatcaatgtttttgattaggatgatcttttaaaagtatacttagaacttagtgtttttaagcactgttacaaaccaaccttcttgatcttactg

SEQ ID NO: 8630 - DNA, 1115 bp, Homo sapiens
aaaacataattttgctagtgaggatgtgcagaaaaggatactttcatctattttgggtggacatcttttaatataaaacacataatcttcttagaatcttttccatctaagtaaaagaatatctaaggaaacatgtttttacatttcctacaaactttatatatacatcgcttgtgtatatataatcatggaaaacttgaaaaagacaggattaacaatggagggaggttcagggaaagataaaacaatgactaagaaaaacccagagattttatgtttacatctctgcatatttatgcaaaatagaaaattcagagttatatataatttattaatatccacatatgtagtaataaaatgaagtatgcatgagaaagaaaaacacaaatttgtgtttgggagtatttgtggcaataatggatcgatcaatggatagttggttgaaaggatgcatagatagattacatatcttcttaaaaatatttatgtaattgcaacctgtagtagggcacagaatgaaacagtttgtcattttagagtaaacaccttttgaagaaacatagtaatttttttcttttatttattttgctgttattctaaaagaggagttaagtttctcttaaaaaatcccatgtcctttactctgtcaaaactaagtcagaaatagaaactaacatttttacagaaaactgagcaattcatgggaaggctgagttttaggctaacccattttagctctttcagaaaagatgacatgtcagatcacctgttgtttgaagactgaaactttttgctgttgcctctgaagactgtataagaggaaacacatttaacttgcagcaatgaggtgttggttgactttttaacgtagtggaagatggatattggaagacaattttaaaaatcaaagttttttatcttctgaattttggaataatacatactatgtatactaagtttagagaatataggtatgtataaagaaaataaaaatcattccatcattttactataattttgtttctaaaaatataataaactgttattttcaacattttataaaagaagatatgcatactggggtaaatttataatatgaaagtataaactcaccc

SEQ ID NO: 8631 - DNA, 1049 bp, Homo sapiens
ttctgtcatacactgtcaaagtgaaagaattgtcacaaatataaacaagcatgaaaaaagacaacttggaaaaattatctaaaccattttgaactattgatgatgatctgttacctgttcattgtttttggtaacaaaaacattacgaaaataggatattgtattttgccccatttaatattattaaatataaccttcgctcaggagatgttagccttgtaagctgaagctgtttttttgaggaggtaaaacttgactctagtctaccaaacatagttccgaggcttgaggaatatatgtttattccataaacatgtattataccaactacttttcaggcaatctactagttttgacggttccagagggattaagacctatagtctgtgacttcatagagtttacaatgtaagcagaaattagacagaaaacagataattttacaactaattatttaattaaaattgtgatcatggctatgaatgagtagcgtatgatctcaggaatatgatatcaggatctaatctagtttagaacatctaggaagacttccagagtatttgaattcaatttagaacatgaaagatcaatgatagttagctgggtgaaggagggagggctattctggcaagagagagaattgaagtgttgaaaagagaatattcgaagatctttggcagaaatgagaatggcatattgaaagaactgtaatgtgaatggatgatagaaagggagaggaatgacagagtggtaagttagggctaggctatacaggaacttgttagggattttggacttcaccttaagaacaaagggaaagcaccaaagtttttgaaacagggaactgacatgatcatatttgcacttttaaaagaatagtcttcttgtttctgtgaagaatgagtaggaggagggcaaaattggaaaggattcagtgagatcaattagaaggctaggaattgctgctgtatctgaaagctgaggatagttgggcctagatttttgtttcctgatcattctattagaaattctactttgctttaatgatc

SEQ ID NO: 8632 - DNA, 1029 bp, Homo sapiens
atactcaatatcatatggatggatggctagatgaataaatgaatggatgatgattttttcattttctatatcaaatgtataaaatagaaattagatataatgggctgagttcatcttaatttgcattttacaatgtaaatagaacctttaaaaatatccagactactctttaaaatatgttataagtctagatctaagttctagagagaattgtggagtaaactgcagattcacttcctcagtaaatatttatgtaaaaatgttaagtgataaaccctgattagatataccatatcctatcttccagtgggctcaaaatccttattactagcttttactatggagaaaatagttttcactactatttccacttgcagtcctgtgccaagggaatctatatgggaattatatatattatcactagaaaaagatgcttagatactctatattataaataaactttatttttgaataatgctagtctgtgttcactgaatctaaaaaattcatgtttggcatgcgaactcctatgcataaaaattttttctttgaaagaaaaagtatactatataatagtaagttattaaataataattaaagatattataattcatgcaataatttaaaaagtactttttatatgaacacgtttatttattttgtgtcttctagcatttttcatatcagcaagtatattaaaaggaacatattgtgtgcaatgtgtaggcccagcataggattctctatactaaaattttgcaatgatactggttaattgctagatttcaggcacctttctaacctccgttttagtgggcgtgaaagggtttatttgtaagagatattgctgctgacagaattttatctttttctcctggaatctcaacagctactcccatgttataggcatccccagaaagctcgtcaaaggatttccacccacactctgaatatctaacagggcttgacccattttttttctcttattaatatagcagcatacacatcatgaagaaagatagaataagg

SEQ ID NO: 8633 - DNA, 1034 bp, Homo sapiens
catgctcacatctcctactaaggtatattagtgatacacatgggtaatgtctgtgagcaagggttaccatatttgagaactgcactgtccaatatagtagccactagccacatgtggcagctagttaatcacttgacatgtggctcatatgactgaggaactaaattctaaattttaatttaaatataaaaacaatacttgatttagttattggaaaacttttaagcatttttgaacaactttagcatataaattgcctctttcactgtgtattttatgaactataaatgctatacttagtatttctaaatactgtattagtatgatgtgtactagaatactgtatttctatatgctatatactaactagaatattataatatttctaaataccgtatcaagtatttctgatgaaatgttggtgtttgaattgagatgtgctgtgaatgcacactgatttcaaatacttagtataaataaagaatgtaaacaaatttgcatgtataaatatgtccatcgtggtatatctgaatataaaaattattaatgagacataaatttgttgatttctataatttttcagggggcaaaattattgaaaattgaataaatgaattgaaaagttctacatatttgaaattgtagatattgccacagttagacaatttataataacagttttaattttgttttgtgactgattttcataattccttaggacacagattttgttcatgaaaaggaatctttctgaaaaatggaggcatttatgcctttcactggtttatgaaatgaattcatactttaatgtcataaatgtcagtcaatttgcatcttttgtaatttgacccaaaaatgaagctttatgtaagttcaaaacctaagaacacttaagattgatcggtaatttaaactgagcttcttgtggggaatgaaagtaccatttacaaatacggaactaaaaactcattctctcgttattgggttgctgatgtctttgtcccataatcaacttttagtggtacagtagatgg

SEQ ID NO: 8634 - DNA, 1023 bp, Homo sapiens
catattccttaagcttggtatgtgttcttatccttgtgtctgtctagtaatttttattttatttcacacattgttttttaaaaaattattgtgataatttgagagtcttgaaggtgccttcctccagataccacttaatgttgcttttggcaggcaattcatctaagactatgttaccctaatgcaataaagcttgagttgattggaaactgaatttcagtacttgtgtaataatctattttttgttgacctttctactagtttaatcccagttttagccctttagagccccatctgaaattctggggctatttcctggtcatatccacctggatgggtcctgaactctaatatttatctcctgtatccaatgaagctgccgaaagttctcctcagtttcttcagctctcagcatccgcttgcaaataagtaggccattagtggaatacctgctccaatgttgggctcacctgttttcacttttctttgttccctcaagtcttagccgtttttatagctctctgattccttcaaatgggtaattataattgtcttatctagcttttctagttttgctctctggaagagttggtctgatcaagttaaactgctgtaaacagaaatagatgtttccaaatgtattgatttttattgtttcctgggatacaagctctacagtcattggtactttattttctttgtatctcaggtgactagaaaagtgcctgacatttagtagaagctcagtaaatatttatttgttgtttgtttttatagttgagcactggacagtcttaactcctgagatgaatatgtctgcaactcagtgatcatgggactgcctattacatattagtgagtggtaaaggtttgggacctgctagattgttattccagagtggggaaagattactccactgaataaattttaaaagggttactgagtgagagaaatataattgtgttttattatttctaaaatatattttgttaaagtcaatgtgtgagctacaaatgaatgac

SEQ ID NO: 8635 - DNA, 1056 bp, Homo sapiens
tgatcagcagtatgttttttatagatttgctaagttcaatttgtgtctccacaagtaatcagttattttacagcctcagatttagtcaagttcttgagttagactttttaaaatatcatcagcaaaccttgtatcttccatactgcaaaaaacattcaagcagtaatttaaattttgaacaacttaaatctaaccatttttcattgttttagtttgagaaaaatacacaggaaataaaaatttctttgtgaattaaagtttaaggttagtatattttgacttcctgctgccttgaccttgatgaatgttataaaccatcaccacttgccataatgatgggtagttgaaatagaaagtctatttcatttgtttaaggtttcagtttctgactttaaaacctcacttctcctagagtatgtgtgtgtgtctgactttatgtctcagtactctgaagtttcacgtcttgtcaatgagaactgatgtcagtgaactaattggctcttcttgtgcgtaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggtagcctcattaattctcaacagtgtctaagagaaaaaattatatttacatgtgtgcatgtgtttgtgtgcatgcacgcatgcacatgtgtgtgtgcattaatcccccagactccctgagggattcatttgtacttgaaatccaggatagaatcttgcctatccttctctaatgtcagctttcttttgcttttgcatgcttctcccccaaaaaacctctcccccaaatacaatttttaaaaaaatatactgtagtttgctaatttgtataatagtagatttttattttacacaggataatttatcatttgtgtctaccaaggtgaaacatggaatgatgagcaaaaggatttcttgatccatc

SEQ ID NO: 8636 - DNA, 1064 bp, Homo sapiens
tgaattgtgggggactctataaacccagtacaattcctaagcaatatctttgtttgacaaacatgtattttggcaagctataatatgcaatgactatatttaaatgtgttttctgattctgataaattcatactaaatatgttcaaaactatcaagcactctaggaaatatgcagcacagttccagacacatattaaaatccatattgatggaaatataaatcactttctttgctttccaaaaactaataattcagtaggacaaggaagaacaacacacttggaatcacacgctcagtaggatcctgtaagtcacgtgattaagctgttaattgtaaaatctaaagtttggtgcgttttgctagtataaataactacagttccagtactcttccatatcatgggaattccaaaagacaggttcaagactccaagttggaacagagcacttacaagcattgtgaattactttgcaaattatcaaagcagtaatttataagcaacttacaagagaattccaaaaacaacctgtaggatttcactgttcttactaccacacatgttcatacatatgctattcagaactactggccgtgaatcttaatataaatatttaacacatatgcagtgttatatacagtgttccctccaaaaatgattcataaataacaagtccacattttgttaaacaatgtttattctaatgttctagctaaagagttggagttgtaaaatctaagagatgaaaatggcctaagggactcatctaatctagaactagattcttcatcacctctaataaatggtcatctagctttagcctcttcatcttcatctctcctactccccattgtattccggtgaagacgagcacatttcagcctgaagttgccagttccataaatataatacaggcgtagagactttagaaaggatagatttcttagaataaaagcaaaactcctttacatggtttgcaacttcctccatgaactggctcctacctgtcttttcatcttcccctttccacataatagtctttgttccagccatattgaagttctt

SEQ ID NO: 8637 - DNA, 1028 bp, Homo sapiens
agataggtaggtaggtagatagatagatagatagatagatagatagatagatagataggcaggcaggcatggatggcaagatggatagccattctatcaatcaaccaatagatagattgatcgtaggtagatcaatagatacatagatagatggctctggctcagacttatgtttccaagctgtactccctcatttgtagtggcctgctctgtatgtctgccgaaatttcatgtcaatactttaatctcaaaatgtataatgttgaaattttcattatcttctccaccaaaatcgtcttctcttcctggcgttgttgtccttacagtaatatctggcttccatttggttgctgccaactacctggctgatcacacaaatctcgcttttgactcgtcacaaatctcacttttgacaccccaccactgttgactgacaaacctcctctttaaactgttcttggttcccagctaacttgttttttctcttggtctatacctgcccaactgtgactaactctagtcctaaccaacttctacttcatctcttactatttagtgcctaatcctattacctttcatctttactaacatgggtacctttcactttgcatttttaattattaccattgagtagtattcttttgcattgctttggggatcttggagcataccccgcaacccatggtccagatttttatcaccatcctctagccaagtccagtttccctaagtctgatttctcttttgccaataattgactgttactcaagacaaataactttttctctctggttctcgtttattttctttcttgtaaggggtaagtgtattattagaccattcaatctcctgcgttttatgatgctacaacagcattttcctagtctctgggatggaaacttcagagatatccctgggtcatttttttctgtgccccccacacacaatttttcatttgatcacttaaattctgtcctgatggtggctcttaattcagtcatctcttgtaaatatccaccattaccatt

SEQ ID NO: 8638 - DNA, 1029 bp, Homo sapiens
ttacttcctattttacatgaaaatatatgtttgttcatattcttagaatactctgaaacatatttcccagtggcccaaactctttattaggaaaatggacgaattgaatagcaaatggtaagaagctggccttccttttcagttttgatatggacatcatgttcctgagagacctggttgttggaagataaatcccctagtgtctaacattctccagacttttggcaaagtaatttttatagaggaaagaaccatcacactgatttggtttactttaaaccaccaggttctcaattctgtgattcatgtaagatattatttctttccgtctctgatctagtttccaaagaatattaatctgctatgcctgatctttactactaggtgtttagattactgaaatgtgaactaaggtgccagccttgtataattaacttttctttaagaaacatgctaaggagattaaaatgccaagattgcagttattttctgagatcttcattaagaacaaatctgtactagaaacactacttctctatgggataatactcttcaggagcatggtacaaaatcaaggaaaaaattttgtataaatctattgaacattatacattaatatcttgtttgtatgccagtggttataagcttaaggaaaattatatttattagtttatttagaaattagtaatttttgcctatctcaattattgaagtagatgggacatacctgttttgatgtgcatgttttaaaatatgatataaataatatacatgtattctgcagtttacttcttttatatattctagatacatgtcccttattagatgtatgatttgcaaattttttcccattctctgacttgtctttcatttcttgatggtgttgtttgaatgagaaaggtttttaattttgatgaagtccagtttatctaattttttcttttgttgttcacaattttggtgtcatatctaagaatcttttgcaacattcgaagtcattaagatttagccttatgttttgttctgaga

SEQ ID NO: 8639 - DNA, 1056 bp, Homo sapiens
taatcctatttatttttgatttagctgcctgtgctttttaggtcttacatgaaaaatctttgctcagaccaatgttttggagtgtttccccaatgttttcttctaatggtttcatagttgtgagtctttaatccattttgatttgatttttgagaaataggggtcttgttttattcttctgcttatggttatccagttttcatagcatcatttgttaaagagattatcctttcactattgtatgttctcggcacctttgtgaaaaataagttggccataaatgtatggatttatatctgggatacctattctattcctttggtctatgtgtctgtatttattccagtaccatgcttatttgtttaccatagctttgtagcatatttggaagtaaagtaacatgatggctccagctttgttatttttgatcagtattgctttggctatttgtgctctgttgtggttccgtatacttttttaggaatgttttcttctatttctgtgaaatgacattgatattttgaaagatattgcattgaatctgtattaattcttctaattcatgaacatggaatatttttccattttattgtgtcttcctcaatttacttcatgagtcatttatagtttactttgtatagacctttcacttctttgcttaaattaacttctaggtaatttatattatttgaagccattgtacatgggtttgcttcttaatttatttttcagattgttcactgttggtatatacaaatgctactgatttttgtatattgattttgtttactgcaactttactgaatttatcagttctaacaattttttgttagagactttaggtttttctaagtataaaactatgttattttcatataaggataattgaacttcctctttttctatttggatgcctttttttctttctctcacctaacttttctagtgagaacttacagtattatgttgaataaaaatggtgaaagtaggcattcttatcatattctggatctcagtggaaatgctttcaagagttccctgttcagtacaatgtta

SEQ ID NO: 8640 - DNA, 1037 bp, Homo sapiens
tgaactgttctatgatggtgatctactttggctgtttccccacccaaatctcatcttgaattgtagtttccataatccccacatgtcgtggggaggaactaggtggagataattgaatcatggaagcagttttttccatcctgttcttgtgatagtgagttagttctcacgagatctggtggttttataaggggcttcccccttcacttggctcttattcttctccttcctgccatcacatgaagaaggacgtgtttacttccccttccaccatgactgtaaatttcctaaggcctgcccagccatgctgaactgtgagtcaattaaacctctttcctttataaattacctagtctcagttatgtctttattagcagtgtgagaataaactaaggcagatggcataatcacatctctgaccaaggctattttcaatggttcagacactgacttgttgaattctcatattggtagtcacctctctgctattctttccatctgtttgtaaatttagagatgtccatctagctgagattttatgaatatcactaaaagatgaatctattaatgagggaatatccttcaaatttgcctccaacttctttaaaaggaactctactactgagatggtaaatggatttcatcacacatgctgtctgtatcagttcacacttgctgtgtgacataaacttagtggtcattatttcttgtgggtctactgtctggctgaaagattctgctgatctaggataggctcagctcattttgccatcttgggcatctgcagtcagctggcaagttgactagggatggtttagtctagtataggttcagctagaacaacttggctctcttctatgtgtctttcattcccttcagcaggctagcctggtaggttctcatggtagtggcaggaatcaaagagagaaggcagaaatgcatgagcaaattttcaagcttctgctggtttcaagtttttctcactcatccaaacaagtcatctgtttaagcctagagttagagtgtgacagtagtac

SEQ ID NO: 8641 - DNA, 1044 bp, Homo sapiens
cctggctcggccaggcgcggtggctcacacctgtaatcccagcactttgggagaccgaggcaggcggatcacgaagtcaggagatcgagactatcctggctagcgtggtgaaaccccgtctctactaaaaatacaaaacaagttagccgggcgtggtggcgggcgcctgtagtcccagctactcgggaggctgaggcagtagaatggcgtgaatccaggaggcggagcttgcagggagcggagatctcgccactgcacttcagcctgggcagcagggcaagactctgtctcaaaaaaaaaaaaaagaaaaaaaaagctcttccacaagggcacagaaaccatagacccccttatatccagctatcttcttggagaggagttaaatgaggcgagagaaatttgaaagattaagaattttatccaaatagagactggtaatttactaaaaaaaggtttttaatcagggaccagcaaaccttttctacaaagagctagagagcaaatattgtaggctttatgagctgtatggactgtactgcaactattcaattctacccttgtagcatggaagaagccataaacaatatgtaaatgagcaggtgaatatggtctaacaaaactttatacacacaaacccatggtgggcttttaggtcctagtttgccaccttcaggtttacattactgaatcagactaaatttcctggattcaactaaagataattttctcctactatccaaaagggtagcagctttgaagaaagaggaaataaaaagtggaaaaaactgacattttctttgcatatttttataagatatgaatacaattttggttatttgcacattgagaagggagaagaaatcttagtgtaaaaagaaataatttttttcccttttctctgaaggcttgtgaccactgggatgttgagggttgtgagaagtggatacctgcaaagtaagctcagggtacatgatggaattgggggacgtgaaaaagagcagaacttatgggtcttctgttctctttgctaggagctctggaaat

SEQ ID NO: 8642 - DNA, 1050 bp, Homo sapiens
agttagttactttaccttttgttgtgttgattttaaccattatgctttgactcatagtttttcttataaggcacattgggtaaagaaagtagcatagagttgaatcccaccctcccctgttactaaatggctttgttatcttgggttagctaactggcttttctgagtttgttagctactttgtaatatgacattaattttatctcacttgaccattcatttataatttaataaataaataggcattgagtaccccctgcatgccaggcacagtattagatgctggtgattcaatggacatcaaaaccagtcacagtcagtatccttgtggagcattaatacagtgagagcatagatatttatcaaagaactataaaaataaatgcacaattgcaactttgctgtctcctagaggaaagaggcatggtgctttgaaagcatatcatagagggatttgacttaatcaaggaggtatttgaaggcctccccaaggaagtgataattgaacgaagatctgacaaaagaagtaggtgctaactaggactgagaggattaaaaacaaggcaacagataggaaatatgctaccatttttcttactaacattactgttatttaatagagaccttcttagcgtttttatctcatcagtgaagtgacactttgtcttatgataattccaggtctggcattatttcataattccttgtctggaataaatattttcaaacttgaaggtgatatacccataaaaattctgactctcaaagtaattgccaactgtggcatgcatgggaagaatttgtaaaaaaatgactcagtgtaaatcatgattattttacatttttcttaattttgtacctatttcccattctctgcctatattatataataacttttatatcaactatatttcccatgttaaacctgagttatgaaattctttctgcatcttttctcatgtattggaaagaaagttaattcttttcagcttaatcttacccagtgcaaagcccttgtaataatgtactttatttttgaaggcttctgac

SEQ ID NO: 8643 - DNA, 1079 bp, Homo sapiens
tataattctagtttttttttagctgtttatttatttccctgttttacatactaaatggcaaattcacaactgaaattgctgctttctaactgcatttgtacttttcattcaactgtggtgtttgcttcaagcagaaaaggattatctgaagctatctcttcaagaaatttctgattttataaagcaattgattactatataatctgatgctatcactgctatactctaaaatgatgacaaaaaccaccatccatcccagctcccatggacctagaaaacaagaggagagtctgattatattttctacactatcttttccttgtatcatgcttttattagttcaaccaatgttgataaaatccttgatagctctaatttctgccaatcatcctcatatccttgaacttaaggaactcacgtgcctaggtttagtatattcaagaccactccaaaccactgagccatgtgaaaatcagaagtttaggacagtgaaaggagaacagatttgtgaatcaggaatatctttatttgaatattgcttcagatactttctgtgtgactttcagcaagtcactgaatctctccgatcctgtttccttttctgaaaataataatgcctacctcaccgtaaagttgagtacactaagttagatggtattgattaaatgcttattaaaatacatgacatattgtgaacacttgaaaaatggtagtagtaatatttcacaattaactgttattaaattaaaatttagtaataattgaaacgcttagcttccttccagtattgcataatattagtttccaggtaaacagataatcaaataacaaacagcaatagatagacacagagaatcctgcatatctttttaaccccccaaaaccaatttacatcaagagcaatctaagtggttttatattgtgcctgtgtatattaacattcacttacctatttccatggctatcttatctttctttcatagatgaaaataccacattaggtaaatgcagcactgcctccatggagatgaagctcttttagaaaaacgttaatttttctaaaactatattgttgcatg

SEQ ID NO: 8644 - DNA, 1035 bp, Homo sapiens
cccgaaacccctgtgataatgtcctagaccttgcaagcatcatggccgcgtgtgagttttctcagcttcctcaacctaatctaccttccttaccgtttggtaatgggcagcaagagaaaatgcttaagaactctttaaaactactgatgttttaaagtaaagctggataattccctgagctggcagcgttcaaattgtatgaggagcaaatacttttgtttactgcctaaggtagtaggagaggtctaatcaaagtattctacatttatttcattctcttttgattcttaggtagtgctacaaaaatattaaatgttaatcttagaatacaaaacatgctgtatttaggcactaaagtaaagtgatgtcaatcctaaggcagcagaaagtcttaattttctcctatgcagaatttttaaaagacaatgtcagataagaaatctggacttaggagagactttattcaaaagggttatcacaaaaggagaaaagggacttttgcaatgggtagaaccaaaagatctgcaagaatctccaaggagtgaactgtgctagaaagttttggtgtgaggaagtaggatataagggtggcttgatctaatagtagatctgagaatgttattccttggctctggctgagagttggccaaagctcaggaacctgggggaaggagagaaactaaagtttgattaacaagtattttgttccacttgatctgtagggccaagcagatcagcaaattattcataaattcatagttgaagcaaaaaatgagaatttggagggtctttcttttgcctggtcataggtaaacaaggggggatccttgagtcttacctaactcaagggtgggaggattttttaaattatagctaataaggagccagcacagggctcaagcaaaattcaacttgccaaaaagtgtttttattatttgacattgaaaagtattgaaaacctggattttatttataccatggtgaatctttctaaaactggggtttttgttattggtttgcttgttatcctataag

SEQ ID NO: 8645 - DNA, 1050 bp, Homo sapiens
tgtcatttgaagaaaacaaaatataaactgtaggccacattgccagaacacagaccaaaatgagcaaaaacagttgctaggaaacaggcccaaatgcagaactttagcttataggaggaagtcagaaagagctggaaatgagaacattgaggaatataacagaggaggaacaaccagagggtgtgatttttagaatgcaaacagtgaccacttaggatcagtgtctgaaatttggtgttccttgagctagctggacttggactctttgacagtatgtgaacaaactgcctaatcgtagatcagaaagctaacctatggaagactttaaaactaccttgactcaggtgtgtgcagttttactcaggtgtgtgcagttttactcaagtgagtgggattagtttgccgctgaattttaatctgtgtaaaatttagtttttatcacagttggcaatgtcttctatcagataggatattttaattttaaaatgagctgatcctgtaaagaagtaattcgttgtctgaaattcaaatctaacagggcatcctgcgttttttatttgccaagtctggtgaccccattttctgcatccagtaagtagagatctttggtgctagctcaatgtgctgcctgttactaagaaaaactgaacttcctgtaaacaacttacaggacccacctactcagaaggctgaggtgagaagatcacttgaggccaggaatttcagaaataggtattcaacttcactggcacaagttacagagtctattccattagtttcctttaatcatgatgaactctgttgaattttgtagtaatttagccatgaataaaggaaactaatggaacagagactccccaataactaaggaaaagaattttttacctaaaattaaaattaatagagtaaatgaaattaccctaaagggtaaaaatgtattattactatggacagataaggtttctaaagtaattagtttcctaaatccaagatgcttttcctatcaaatatgaccatggtagcccaagttttgaatattaggaaatagct

SEQ ID NO: 8646 - DNA, 1063 bp, Homo sapiens
agagcgagactccgtctcaaaaaatatatataaaaaataagaaaggtcaaagccagattgtgtcccttatttgctaatatacattgccacatagttcgttgccttgtaactttacctctgatttcctttttctcctccttaatttatcttaatccaattatctgtttgaagaaaaaaaaaattttttttatttttttattttttgagatgagagtctcgctttgtcgcccgggctggagtccagtgacacgatctcggctcaccgcaacttccgcctcctgggttcaagcgattctcatgcctcaacctcccatatagctgcactaccacacctgactaatatttttgtatttttagtagacacgagatttcactatgttagccagtctagtctagaactcctggcatcaagtgatcaacccacattggcctcccaaagtgctgggattacaggcaggagccacaatgcctggctagaagaaacttttctaattattactgtgatagaagccattttatctgatttgattgggacctgtattagttcattttaaaaactgactaaaacacagtaaatgaatataaatatactctgtttttaccagctttaaaacttttttcagttaaaatgttcagtaacatattttaacactttaaagtgtattttattttttaactttgtaaatacagtattttgacctaaaacacagacatttattcgccattttttgttacctgaggccagagtcttctttttatatgattttgctgattattgtttttctctgcagaaaccatatcaaaatgtgtttaagatttctctccagtttttgttttttttttaattttgcaaagcttaaaaacacttgtaaaattgctgaatcctagacttcacagtccctccctaccactcagatttcagtggttcacattttttctcaacagcagattttttcctaatgagttgcattggttgcatattttcttgagaatccaacttttttttttaatttgctttgaaaattatttatgaaaaatttcaaatagaaagtatggacagtag

SEQ ID NO: 8647 - DNA, 1100 bp, Homo sapiens
ttttcacttaagattgtctttgagatttattcatgttgattcacgtaattcatgtagtttattcattttaactgttatgtgggagtcccttgtatgagtaacgatttcacatcctttacaattaggttatttgtcatctttcactgccaaaggcagtgaatgctgaaagttttcgtatataacttgtgctcttattggagatatttttctccatctgacacccagaactgaaaagagctgagtcccaaggtgtatgcttcctcagttttacaagaaattgcagaaaatgttctaaagcagttgcagcaatttacattcctaccaaagttattataaggagcatgtgagagttggacacatcttaaccagatatcagatttttaaattgatttcaagcaaatgtttaataaatgatatttaatttgcattttcctaggaactatgggggaaacagtttgtatgcatgtattggcttttgttctctttctctgtgaattgcctgactatatttgtttagttttccagtggactctgtcattttctaattgatttttggaagtgaggagttactcgaatatttatgataataatcctaacacctttcaagtgtctttttttttctcctttagttatacagaaatgtgtaaattttacatataatcaaatatatccatctttttatttatttatttttttggtatctgcttgcttgtttgaaaaattcttccatacttccatgtcagaaaaccttctttattttctcataaacatgtttagtttttcttttcatgtttaaatctttaatccacttgttattgatttttgtttgtgcagaagagatctaattgtttttccatatggttaaagtcccttcttcattagtgtgtgatacccatcgattaatagtaccacatgtcatatactgagccctcatctactcatggatctgtttgtttatactataccaataccatagttttaattagaataggtttaaagtaaatcaatatgttactgtattttccttcaggattaccttggctttcttagacctttgctctttcatatagaccagcttgctaaattccaagggggtggca

SEQ ID NO: 8648 - DNA, 1052 bp, Homo sapiens
agaatttttagatttgtctcaacactctatagagttaggtctcctcttctcacatggagttcatttactgctgacgatagaataagccttgagcctgataaattatagatgattttggcatgacctcatctaaaaatattttatctccttttttttttttactgtattttcaattaaatcaaaaataacatatttatgaggtataattcattgtgttttattttacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcatgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattcta

SEQ ID NO: 8649 - DNA, 1001 bp, Homo sapiens
agatgccctatgctcctcacaggttcgtccttttatgtttgctacaaccctgtgtgttattcatctccatctttgtatttcaggtgagaaaaccaaggctcacggaagggtactaactacagtagtaacaatacaaaagaaaggtttggatctggagagttgaaaactgagaaaaaggcttgcaaaagctaccaagaaatatttgttaaggagaccatgagaagcaaagaacattttcctggggcatgctctgatgagattagacagcatgcacttatgatgagagatatttagtataatgttgtgactttttccacatcctgacaatccagaggtcagcaagaaattagacagaggggatcaaaaaatggaggggccagataattctaagatgttggcaaatgagctttggtaataaggtgtggcttttataggtactgcaaccaagaaaggccatgctgaaatggaataaggatgagatgggggactcaattgttcagtatgggaatgggggcgaaagatgcaagagatggaaaataagatggttgggaagggagatgcttcagtgggaaaatcatggattttctatatctgatagacctgggcttgagtcctgacgtggccagctgttttgtgacctaagaaagttacatcacatccctcaatctcagtatcctcatctataaaatgagagttacaataacacagactcagtgggttttgcagtttttaagagaaagagcttggtaggtataacagctcagatatatagaaggatctcaacaaatggtagattctactattagtatcattattagagagttttcagagatggaaagacttaaagatgagcgccaaaatgaggcagggcaaatacatggccaaagtttgtggagataatggttctttgacgtgagaaacttagagaattaagaagataaaatatattatatgtttgtagagtgagataagttctaagaaaaaatcaatagggtgatatc

SEQ ID NO: 8650 - DNA, 1045 bp, Homo sapiens
agaagccctcttctcatttcttcctattcagtggaggaagtctacctcccattaaggcacaactcaaagaacttcttgaactaatcattgtagttactcagaaagtctccccacttcttagatgttccattgatacatcataactctgttattccactgtccatatcctatctttactctaattgcttatgcctgtggctccctctcagctagaagtgaagttcttggaggcagggatcctgtcttagttatttttgtatccttggtagcaccaacttcatggactcaatataatagattctcagtacattctttggttgaattgtgctggattttgctgaaggagaataaaaaggttaagaaggaagttggctctgttcatttggcctctctatatgagttgcagtacggttctcccttttctattattccttacaggttcattgatgatgttacatagcccttgacccatgtgaactgatgacagaatagagccacacagcatgtgaagtgatttgacctgtagcaatctttgaaccagtgttttgtctacacctatcctcagaggctatccagctgttagatttcatttttaataattcagccaagagtgtggaacatttttctcttgagattttcaatagctagtctgaagatatgtttttgagagcttcaaatagtgttccagaagagaatgttagaatcgggaagaataagcatattagatacttaaaggaaagtatctgaaaaagaaaatagagaatataagcatataattttcagtttactaaagaatactgtttttaggaataatagtcatgaaaattataagggaaaaaaagagtttttaaaaagcctctgttacccagtttaatgcatcttttagttcagacatgattacttcacaatcacagtgacttttgcacactatcttgtaatttttaaaaagttttaaacatttatcacaaattattctagattcttcatatcgggtttttagaaagtaaatattaaaaggaacttcaggtggtgaagcattcaactg

SEQ ID NO: 8651 - DNA, 1107 bp, Homo sapiens
tattttctgtcaaagcactgtgtgcctaccctaagaggcaaagatattctcttgttgcctttatggattacttttatgtgtatgattcattctgaattaagtttggtttatggaattagaaggattgaggttattttttctcccacagggatatccagttgtttcgaaacaatttgttatatacttacctttcctcattgaattgctgtggcagccttgttgaaactcagttgaccatatatgtatggtctgtttctaggctatctttatgctagtactacagtcttgattactgctgaaattttgatagggattgtattaatatatcagtttgtccattttccctaaactgatatattaattaatgctttagattacatctgtcttttatttgataggtgaatgaatgaagtgggactagctttgggctctcaagagtaggaaggtctttggctagtggggattaaaagaaattaagggcaagaaaaaaaataagacttgacaacagaaggaaaatgactgtggtcttttaggatcataatgagtcgacctcccacaggataggtcagatttagaaatagtaggaacaaaattaacatagactttgagatcggaaagtctttaaacctaggattaggggcttgttttcccattggcaatagagaaaaataccatatttttaagaatgtgtgtaatgacaccattttatgagtagcccttgtaattgaaacttcttaaaacattctagtgtcttgcattccaattttaaatcataaatatatttggactgggttttaatttctcatagcagtaaaaacaaactgtcagaaacttgggtggtttcaaatatttattcttttatagttctggagaagtccaaaataattataactgggctgagttcaaagtgttggcagcgctgcactccctctggaggatctggtggagaatccattgcttgtcttttccagcttctggaggctgcaggcattccttggcttgtggccacttcactccagtcttcaagggcagcatttcagatctctctctctccactgtcttcacatcaccgtctcttctgtgtgtcagctctttctctgcctcttt

SEQ ID NO: 8652 - DNA, 1023 bp, Homo sapiens
caaactgaatatattatcatcaggttggttgactactgtggaatagaacaggacaagcatctttctgaacctagaaattagactgttaattcagaccaaaattacatttgctttttggcagttctgtcacatcattatcatttttacttgcccagtgttatggggattcactaaatagattaattaaatgcttattgtacaacctcaaaatttgtttcacaaaattggtaattttcagcttgatgagtttagtgtttttgctaatccctaagtaggtgatctccctattagtttttcctgcctcatatgattctttgaaaaaacagaagtgataactattatagaatatatgtgtatatgtgtataaaatggtgtgttttcaaactatagtagatgtggatgatttataagacaagatcgatttttgtttgttgttttttcctctaattaattctacaaatattaagtatatgtatactatgtgccgggcactagagatacaataataggatgcattctctgccataataatcttttagcttcatggaggaatttcaggaatgtttattaaatactactaggggttaagagggtgctccagagcacactgatatcttacccagccttgagtaaagcttcttaataatggtgccacctaatcttggtctggaaggaggtgagcaaattagttagccagagttgtgaaggaatttatacaagggtcctgaggcaaggagcaatatgggtggtgctaacaagtagtttgctatccctggaatttatgaaatatggaagggggaatgtattgggaaagaaggcaatacaacatttaaagaggcttatatggcttgctttttgggtgtttttcgactgagagcaatgaaaagccatttaagtttttgaaacgggagtgacaagattagatttgctctttagaaaaatatactcttgagtaatgtggagaatagattggagggaggagtaaggttagagatacagggaccaattgggaggctgatagtg

SEQ ID NO: 8653 - DNA, 1044 bp, Homo sapiens
cagttcatgctttcatgtcctaagaaacatttgcctactccaaggttgcaaagaaggcattttcttctaatagttttaattatttcagcttttttgtttaactctgtgatccatttcaagctaatatttagtactagtacaagaggtaagatggaggtttttgctgttttttgattgagtgtactatgaggcaagattgaagtttttatcgctttttgttgtttaaatatggatattcagttattgcaggaccatttgttacaaaaaaaattatttctccacctttgtcaaaaaccgattgtatggatttatttctggactctattcttttccactgatatatatttctgtccttttgctaattccacattaccttgattgctgtagcttatagtaagtcttgaaataaaatgataagttttccaactgtgttctttgttcagatttctttgactgttgtattagtcccttctcgcactgctctaaagaaataattgagactgggtaatttgtaaagaaaataggtttaattggctcatggttctgcaggccatacaggaagcatggctaggttagaaaacttaaaagtcatggccaaaggcaaaggggaggcaggcacatctcacatggcaggagcaggaggaagagaaagagtggggaggtgctacacacttttaaacaaccagatctcatgataactcactatcatgagaacggcaccaaaggggaaatccaccaccatgaaccaatcacctcccaccaggcccacctccaacaccggggactacaatttgacatgagatttgggcagggacacagacccaaaccatatcacctgtattctatgaccttggatttctttgtaaattttagaattaccttgtcagtttctccaaaaagcttactggaatttttattgggattccattaaatctacagatcagtttgaagatttgagtcttctatcccatgaacatgatatatctctccatttatttaggtcttctatactctcagaatgttttgtacttttcactgtagaac

SEQ ID NO: 8654 - DNA, 1035 bp, Homo sapiens
ccgaaaagctccttaaactgataaatgacttcagtaaagtttcaagatacaaaatcaatgtataaaaatcagtagcatttctatacaccaataatcaagctgagagccaaatcaagaatgcagtgtcattcacaatagccacaaaaagaataaaatacttaggaatacggctaaccaaggaggtgaaagtgaactacaaaacactgctgaaagaaatcagagatgacacaaatgaaaaagtcttccttgctcatgaattggaagaatcaatatcattaaaatggccatactgctcatagcaatttaaggattcaacactacttccatcaaactaccaatgtcatttttcacagaattagaaaacgttattctgaaatgtatatggaactacaaagagcccaaagcaatcctaagcaaaaagaacaaaacaagaggcatcacattacccgacctcaaactatactacaaggctacagtaacccaaacagcatggtactggtataaagacagatataaagaccaatggaacagaaaagagaacccagaaataaagccatacactgacaatcatctgatctttgacaaagtagacaaaagtaagcaatgaggaaaggactcccattcaataaatagtgctgggaaaactggctatccacgtgaagaggaatgaaactagacacctgcctatcgccatatacaaaattaactcaagatggattaaaaacctaaatctaggctgggttcagtggatcacacctgtaatcccaacactttgggaggctgaggcaggcagatcacctgaagtcaggagttcaagaccagcctggccaacatggtgaaaccccgtctctactgaaaatacaagaattagccaggtgtggtggcacatgtttgtaattccagctaccctggaagctgaggtgggagaatcacttgaacccaggaggcggaggttgcagtgagccgagatcgtgccactgcactccagcctgggcgacagagtgagaccccatctcaaaaaaaaaaataaaaaaa

SEQ ID NO: 8655 - DNA, 1024 bp, Homo sapiens
tttcttttgagtttacatttttaatggaagacgtaagttttttctctccatgtggcaccttttccccaaaatcagtattctaacaaccacatctgagacacaatttctattaccatacaaactaagcaagatgattcccctgtgaaagtaaatattgtacccagagaagaaagtagtacagtaatgtgaatcatgtttatgatttctctttctctgtctcattgagtcttactgggagttgagggaaagagagaaataaagaacttacgtgatgtcaagcgggacctctcctctgaataactttaggttctaatagtaactacacttcaccatcagagctgatgaaagatcttttattaaccacacagatttctgttccattttctctcttgttcccactatggtaaactaagaatcattataattggtcaacctgtggtttagaagcaatgtttgaaaacaaaacacaaatagactgttgtttcttaaaattctatatactcaaactctgcacctttttgtctaataacctaatcacttaagttttttgagtttttttgttattttaatataaatatacacattctaaataacttatttacttaagccataatactcaatttagtgattagaaaaaataaaaattaaggaatcaaacaaaccaaatggaagtacatatataggtataattagaatagaataaaatcatgtggttcacctaaaagtaaatgttttaaatgtagcattgtacattctaaaatgcatatccaaacagatagcaagtctttgtaatatattaaagaaactagaaacaggggtagaaatgccctgaaagtaactagttcaaggattcctttattgggggtaaaatcatcgagcaaatgctactgttttaatactcacaacaaataaatgttctttttaaatgtcctcatatttttttaaaaataaaatgtaaccttactagcctgtaaagtctgagactaaaataggtagtctactgaatctgagtcttactttcaga

SEQ ID NO: 8656 - DNA, 1025 bp, Homo sapiens
tacatgttggaatttactgtcagtcacatggtctcaaaagggggcaaggttggaaacaaggggcaaaagaagcagacaagcactctcatctctatttttagggcaacttttttttaatttgttaagtcattgccctttatgtgtatgaaaactgattatctttttactagcagctaccaagggcctctaacaggtagagcaactttaactcatagtctctaatttctttgagtgatttggagaaagcaaaggaatatttcttccttctcagagtatatgttggtattgtccagattcaagtgaaaatatttatctaatcagagtaaaaatttttgccgatacctgtaactacaaagctctataaattagcccctttacaaaaaccatagcagaatcatatccatactaattgcactaaaatcctgacatgcattctggataagtaaaagtcaaagtttgaactatgatttcaggttaaaagaaatagctttccaattctttgaaaactggtgactcttataagctatatatagtaacagtctggagtatttgattaaccattatatactacttattccttgatcttaaccagatcgaatttacctaaccttgcctaacctccatttaatcatagcaaacatttgttgagcctttgttaagtagcaagtactatacgagcttagttatatttttatatagtgattaaatattttaaacaaaagctttactaagatataataatagattcaatacacataaatggtgtctttttcatctttatatctatctaagaatcaaggacagggttatttacttaataggtataaagtctttgctgaaatgtatgtaatatagataaattatgaatgggcttttaaaaatagtgcaaataatacagctataaatatgacataagcttcaccagtcaagtgacccgtacacactgtgttcttagttacgtgtaagataacttgagtacatggcgtcacttccaagctaaaataactggttaaacttgcatttct

SEQ ID NO: 8657 - DNA, 1047 bp, Homo sapiens
ggcagcaaggctgatgactaaatagtctgctcttcaaccctgatatctattaggggtaggaaaacctctggataccccctgtaaagacactccctggcttttaccagcttaccatctggacccaattttaagtgatttatgacaatggagccagcataactgtactctatactgagtattattattatatgattcaataaatgtcttctctgttgcagaagtttgtaagaactgttcaaattgttttgtttattgaagttgtacgattattacttttttaaaaaatggagtggtcatttaggacttagaagtcttttgttatgaggtgattttgttataatggcatttcttagagatgatatttattccagtgctgtgaaaaacctatataactttttagatatgatttttattgagcatatgtgaattgaaagtaataattcaagccaagcacggtggttcccacctgtaatcctggcactttgggaggctaaggcgtgggcggatgacttgagcccaggaatttgagactagtctgggcaacatggcaaaaccccatctctacaaaaaatacaaaaattagctgggtgtggtggtgggcacctatagtcctagctactcacaaggctgaggtaggatcacctgagcccgggaggtcaaggctatggtgagccatgattgtgccactgcactccagcctgggtgacagagtgagaccctgtctcaaaataaaaaataaaataataaaataagtaatctttttaaaaagaaagtcataattcagtaaaacagttatcacatgcacagttcacccaaatgacttccatataagttgatgatattctaagtttaagttgatggtattctaagtttacatggaaaggtaaaacttggaaattaataaaactataaagggatgacagtagtttttgggttttggtgggtttttttgtttttgtctttgtttttttgagatggagtctccctctgtcacccaggctggagtgcagtggcacgatctcagctcactgcaacctccgccttctg

SEQ ID NO: 8658 - DNA, 1034 bp, Homo sapiens
atacagaaggaattgagttaaatataatacatcttgaaactggcaagaatcccatgttgctaaaatgatatttatgatgatatttctgcacctgcatcactagtttttgaaacaaatttaccctagagcattggtttgcaaaatgctatggccccagtggtttcacagaagatcctctgaaattgctggtttgagtttcggataggggttgtggaggggtacaagcaagaaggaagcaaagggcaaggaaaacactaagttcgatatactcacccctgcctgaatcagagcatatgtgttttatttgtttcatacatatcatttgaagtaacggtttgacaattaaaatatgtttaaattcactgcccttgagtgttagaaaatgttgtatgcaatagagaaggttgtatttaatcttctaatgttgtgttcaataggctgcacagtagatgaacctacatcatgaaaagcttctttgcagagtttagtaatgaaattgttaaggaagaactctaaggtagactcattttatttaatgcaaagcgatcatgttgaaataaaactctgttacggactgtaaaaactcaatttaaaatataattaatttatcctgaggagctcaggtattcccaaattaaatatttttgaggtatgaattagctgacgtatcaaaaaaagataaagtgtgatcatacctttattaacctgaggttaagttttcttggtgaaacttataaatgtcagtatatcctgactcattagtaacagttgaaattaaccaacttggtaacttctatttttgtaaaaatttacactcactttgactttgtatcatgaggggaattgaggataggtctgaaataagatttcaggcttttctccttctgaaatatatattcaagctgaacagagaaaagcattttaaattcatctaacagtcatgtataattaggcttggttctgcgttgtgaatggggtttctggaagggcagcaaaaacagggtttgatttgttacgtgcccaagctttgcatc

SEQ ID NO: 8659 - DNA, 1061 bp, Homo sapiens
aatcactctggcaggagtatgaaaagagattggagtgggggtggggtggggtgacaagactagaggccaagagttgagttaggaaactgttgcagaggccaggtgatcatcatcatcaccatcaccatcatcataatgattagacatgagataaaatcaactgaacttagtcatttagtaagagaaaaggaggagtctaaacttgctcccaaatatctgatttgggtgactagatgaggttggtgtctttcattaaaatagggaccataggaaaagatgcagtttgggacatgtagaataggacatataggtggatatagcctttgaacatttggatgtgtgaatttgttctaaggagatacatgatccagagatgtatatttgggaatcattgttatatagctggtagttgaagacattagaacatgtaagatcagaaaacatgtttagattcagaagagaagaaggcagaagaatcatgtggagtggtctcatggaaattaagggaagagagaattttgaaggaataatgaacaatgccaaatgcattgagcaataaatagaaacaacagttgactcatagatagagaagtctattgtatttggcaatatgaggctcataggtgaccattgaccaagaagtttcaggggcatagggctcaaaaccttaattacatgtagttggttaaagatctaatggcttttgcaatttctttgaaagtagaaaaagtgaatgggaggtaaggaaatagagacagcaagtatcgactctctgttccagattcttgagaatgaaagaaaggagaaggaaagaataatagaggtgggtgcagaatagataatttttcaattattttgctttttccacttgtaccttgattaaaatgttgcttttgattgcattttcatgagttaatattaaactttgtatttttctataattaatcattctataatactttagttaatggcataagtttaaaagaatcagggttacccccaaaccaaattaagtataaatactaaattgtgtgatttccatgaatgcacaggattaaaaa

SEQ ID NO: 8660 - DNA, 1034 bp, Homo sapiens
gttaacggacacattactgtcaagaaaatattacttgtcttaattatcagtaatgaagcagggataagctgctcacttagatataatatatctaatgaccttttcagttagaggttgtgatgaaaggtatcagtttcacaaattatgcttcattcagcttctggcctttgtgtagattaatgttttgtggatgagttttaaagtcaggcataaattgtgtttggtgtttaaaattgatttagtgtcttgcttttagtacatcattttctcatttataaagcctcagttttatcttcaagcttaaaaaaataatccatggtaaatttagaattgccttactggcagtggtttttttaaccttaccaaatagaatggtacatatgtttacacttgtttaactaaaggacatagtttatgactgaagtttctttctgatttctgaatttaaaacaataagcacaatgtttacaataacaatttttgaactaggaatgtaaatatttatcataccacttttcctaattagatatccccagatgacacaaagctggttattcatcctgagatgacacatagctggttattgtgatagaagttatgatatctcttaacattaacttcttagtgagtaataaacatgatattgaaacatcattaaagaactcatagatttggcctcattcaaaccaataggagaattgcccccatgttttaagcaactaaggatttaagcattttgtctatgcaacataacagtgagatgaaaagtggttttcaaatttttaagctgtgaaactctgagaaacttcttactcagaagtccaataaagaaatctaacaatactggagctgctctggttgaattggaaaatttctaaactaacttgaaggaatccagggctgtcaagtagcagtgttttgatactatgatcctgatagttatattattaatgtagcccaaatattagagttggggaggaaagtacagaccatggttttcagaccttcgtcttaatgggtaggaaattgaaaga

SEQ ID NO: 8661 - DNA, 1031 bp, Homo sapiens
tacgtatatgcttaggggagtgtatctatttttttaaaaaaaaagaaaaatggagcaaatgaaaaattaaaaattggggaatctgggtgatagggatatgggaattctttgttttgttctggcatacttttctgtgtttgaaaatacttcaaaatgagttattctaaaatgatcactgaaaaggtaataaatacatcataaacattaatatttatgtaataataatatgagtagtcacagtaagtcaggttaataaaaactataaatagctttatgtccatgtagacaaacgagttaagattttcagagatttttggatttttggaattgagaataaaggctgtgggtctgtataaggtatcctggcccaaataagtacgttttcccagtctcacacaggaagtaacagaaccaagatctcttgattccctccccagtagtccttggaagacagctggaaaagattacttactcaagatagggacatgtgtattcaaattctgacttttgggagttgattcaggaaagtgtcagatttacaaaaatttcccttagagctgcatcattagattcaccaagagggcatgttctgtgttgcagttttcaaatgcaacccaatgagaatataagaatgttctcattggtatgcaatgagaatgtagaaagaaatactagaaaacctttttctttctccttgcctatgtcatatatagtataaatgtgagagtgagtagatttcttcctctcctccgtggttttcatcccatgctaattctcttatcctgtaagatttccttcctctttacaaggttaaaatacccttggatttcaagcagtacctttttaaaatctgatttaccaatcacttgattagccatagtggctaatgtgtttttaatgtttcaaatagccaatgacttgaacctctgtgtaggaaaatagccttctctgcattctgtatttgctcataccattttgcatatatttaaggacttcatgctcaagcagtttcttttcctttttaaaatttc

SEQ ID NO: 8662 - DNA, 1046 bp, Homo sapiens
ttggatgatacataaatgtaaaaaacaaagtgtactttatttttagagattctttatgaaaatgcaaacaggttccataaaacctagaggtaatcaaaaacttatctgggacacttttgaaaatgaagacactgtgtgtaccatgtggtagtgttaagtgcccttataacaaatcattcacagaagagccatagacaaataaacgtttcaaaagtggtctgacggcttctgacagcagtataaagccatctttcagagccagtaattcagtcagacccatctgaatcatttcctctataaattgtctttagtagaaatacaagaaaaagcaccagtgaactaataattatctcctctttgtcatcagagtggcctaggttaagaaaatgccaccttaaaactaatttaatcttttaaaatttacctgaaattattctgttatatttttggtaaaatatagcacattcgaatattatatatttttcttttatgtgtatagatttagaaagcttatgatgataaagataaatatgtacctctgcattattttagactacaattttcaaatattttgaccaaactaaccaaattagtcatttatttaataaactattaatagtagtaggtacagccttagtctttttattattttccttcctttcactttatttaaaaaaattacctaatgaattaaatcataaacctgcaaattatcaactggcccatactacaatgccatattaatgatgcagctgatgaaaataagtatcaataacctaaagatgcatagtgctagagacaaaggtggcattttacatttttattaacacttgtaattttcttctgcttgatttcttttaggccaagcccaatttcttctaaaccatgggtcagtgagctcatgttgattctcatatgaatgatgggcttgattttgcaaagctatcaccaactaccaatacctaggtctagttaccatcattatgaacaacctagaatataacattacaaattagaatgcattatttcctttaatttcactaact

SEQ ID NO: 8663 - DNA, 1031 bp, Homo sapiens
tgaaatcactgttttaattgaaatgctgttataaaatattaactaattataatggaggcattgctggaccaacttgtctaaagccatgtctccaaaatagaagaatttaaagataataagccgtgtaattccttgactccagtgccttcaaatcaccaacaagacagatcctaataattctcattaactttatttgtggatttgcaagtgaccaggccagaggccatgacttacttcttccacagtctttctttcactccagagtgtaggatgtcaccatacaaaagcatgaaataagagccatggccaacatgttttaccagtttattgaggcatctcaactcaggaaacatacacattaaacagtttgatttgttcttattgtggctttcaagtgtgctttgtaaaatcttttcctgtcccttacatatatctttgtgttattctgcagctttggggtcacttgtttattaaaattcagtgttgtttaaaattttaatctcaaatatagtttaaaatctcctctgcttttttcccaatgcagacttcaatgaggatcctcactatttgagatgttgaaggaattagagagcaaaatctggttcaaagattgtggttctccctcctctttgcaagacctggttcctccaattcgttgggccaggggaaaaagagtgggaataggcatatgtttctttacacagctgccctctcaagagtctgctgttcattatgactgcttctctgactacctctgaggcaggaatccaaatgctggccttttcacgggctagatgtttgagtttttcagaggccctgtgatgcatccacatcatactttctgatgtcagggtacagcaattgttacatctcctctcctgcccacagtggtgtgcctcaccagcctcttgctgatggattccccttgccaggcaggtcatcatcttgggtagaacaccagcagactgaactcagcaagtgaaactcatcctgcttgtcccacaggaatttcctacatccttgccaggcca

SEQ ID NO: 8664 - DNA, 1033 bp, Homo sapiens
accttgtctcaaaaaaaaaaagaaattataacatattctgcagcatggatgaatcttgaggacattatgctaaataaaataagccagtcacagaaaggcaaatattgcatgattctacatatatgagcatttaaaacagtcaaacagtcaaaagcagaaaataaaatagtggtagccagagactgaaaggagggaaaatgaggcgttgctgttcaatgagtataaagtttcagtcatgcaattgcataagttctagagatctgtgtacaacattgtagctgtagttcacaatactatgctgcacacctaaaaagtcattaagagtgtagatctcatgttatgtgttttttaccccaatttttttaaaagagaaatctagctattttgatctcatacaccaatattctcatgacaaatggggaatgttaggatgagacagatttgtattgaaaaagacaaaaccaataaaagtgtagtgacacaattaaaattctctgagactaaacatttctggaaagtatacatgactataattaattgaaatgcagcttttactaagtctgcttatatgttcattttcaaagtgtgagactgatatttattatggatgtcagaggaattgttttcttcactgtggatctatgttgtatagcactttttatttgtgatttgttctgtcttagggctatttcaagtatgattttcccatggtagacacgctatggaatttgtttccttgacatgtacaataatttcagaatacttcttccagtgttttttgttggtgtgtaaggttattaatagtgaaaaactttaaagtacaatctagtactctttatagttaggatttttattttggtaataatgattaatttacagaatctcatgttaagattcatgctatattgccattattttaaaagtgtgaaatgcatgagttttaaaagaccaagtttaaaataccaataagtagtgatattcatataccatatgtttacctacaaatatcttaggttatgtttattacacacta

SEQ ID NO: 8665 - DNA, 1051 bp, Homo sapiens
caagctggaatgcagtggtgcaacctcagctcactgcaacctccgcctctcaggttcacgctattttcctgcctcagcttccccagtagctgggactacaggcgcacgccactatgcccagctaatttttgtatttttagtagagacggggtttcaccatgttgaccaggctggtcttgaactcctgacctcaggtgatctgcccaccccagcctcccaaagtgctgggattacaggcgtgagccaccacacctggtcgtaaaccaaggtcttatagcatagatttctacttgacatttactttactaaacactaaactatgactattattggtgtctttttcccccatatatctgactgtctcttctaccttaagtgagcttacattataatatgacagaaaaggctagtagacatgaaacaaaattgtgcagaggccaggtgcagtggctcacacctgtaaccacagcactttgggaggccaaggtgtgaggatcacttgaggccaggagttcaagaccagcctggtggacatagcaagaccccatctgtatcaaataaagtaaaattttgcagaatagtctgtgattatagctcagcaagttaaggtgtttaggtctagaatgaggacagtgctaggatgtggccaaactttgaagtatgatataattaagttcattagtataaggctaaaagaggaagatcttcctgataagaaaatcataagtcaaagcaaggaggtatgaatgccagttgcatatctagaaacagtatagaatctggcctgagagaagaaagtttgtactggggaaaataactgagatggggatgacttatggaatgccttgaaagccatagacgatgtagagaaacactttaggttctgtgtgatatgctaaaaaacagcatttagtaaacattactgtggaagaaatgcacaggacatattcatggaggcagagaaaagtcagggatgcagttatcttaagtgtgagtttatgaaagcatcagaaaactctagtaaaagtggggaaggaaagagacacgtaaa

SEQ ID NO: 8666 - DNA, 1032 bp, Homo sapiens
ggagatatcaagtaaccgatttagacaatgtggcacaatcagaggatcacaggaatagtgaccatgtgtgacttatccatcccattcctttatcccagacatgatgctgctggagagagggggctggtcagggagaaggcatctttcacagtgtttttactatccaagtacagtttaacaaatccagctgtgttatttcaactgttacctaaatgatttttttttcagttctactcatgttggagcattaatgggaataaaatttccaaaaaaaaaaaaaaaatagaaactaaaagtaaaagatactgctttcagtttgcatagaaagtaaaaccaggccaagaatagtggctcacatctgtaatctcaacactttgggaggccaaggcaagaggattacttgagcccaggagtttgagaccagcctgggcaacatagtaagacgcccatctctacaaaaaatagatgtgttagcacatgcctgtagtctcagtactcgggaggctgaggcaggacagagtgagaccctgtcaaaaaagaaaaaaaaaaaaacaagaaaggagggaggggggagggaaggattgaaggtatgaaggaaggaccattttaagctttccaggaataatctagtttgttctttgtcaatgcataaaataagggaggagaattcttaaatgtctcaaacaaaggaacattgggattgaaagatggtggtatatttattgctgtgtagccaaaagattccaagtcacattttaaaagaattaaactcagcaaaccatccccacaacagtagaaactgctagagtttctccttcatggacatttcacacaagtctcaactcctctacctggaatcttctattgggcaggcacgagattaagaaccaccactccccacagaaggagggtgagggtgagatgggagtcacttagtagctagaatgtttcttcagaatcagaagaaagcaggatctaatagccagtatataccacctttggggaaattctgtctcttgtagaatatgcatg

SEQ ID NO: 8667 - DNA, 1030 bp, Homo sapiens
atggttctcccctttttcatctgtttttcccccccatattgaagagaattttccaaatgaagggtttcagctaggttgtctccaggtcagttctcctctagaaggctgtgtgtagtcatcagtggggagccctatgctgccttatctttagcctcccacaccactttgtgtctcacacaacagataagttcctttaagtttggatttttatgaaataaattttgcgagctgggagcacggagagttaaatgaatttgatattcttttgaaaacagaaaaatgttattttgaaatatggatgtttctccctaattgcagtaacttctgtaattgtggtcagttgctggggtcagtttaaatcagcctgtatctgcagaaaaacagttgggatgggcgggggttgggagggtgttcaaagcaacactatacttttgaaaacatgacccaacattatgcatagaaacaaacttaccaagaccggtaatagatgctgtggctgacttacctgaacatatgaaaaaattgaccctccggttggtatcatttttttatgttgtcaacatttctgtgaaaattttaagttcctagagaaagtataaccttgaaaaagaatcgtcaggtcaactaatagacaaagacaaacaagtattcatgggaatctataattgctgaaaagctacatttgaccttaaaaattgcatgttggagctctggcaaaataaaacaaagccaaaaagaaaaaagacatctgccgttatttatgcgatatttccaacgttgctgttatttatgtgtttacatgtgttcacttctacctaatgagaaaagatcttaatacattttggtttggacactgaaaatgttccaataagattcctggtacggtttctgtgatggctgtaatttgtaaaatccagtaggaacaggaggtgattatactggaattcagtctgaagaattgttttagcaggaattttatatgcaagtctaaatgctgatcaacagagcataatattgtaatctgaagtat

SEQ ID NO: 8668 - DNA, 1024 bp, Homo sapiens
tgaggagcttgtaggttttaggttctatacttgaggtgcttgttttagttaggttaaggctaaatttctctaacaaatagccccagaaaaaattcagtggattaaagagaataagagtttattttcctttcatctaacagtctgaggtgtatgtttcagggtagcaggcagcttgctttatgtagttttccagccatctaggattctctatcccttaggctattgcctttatctgcatgaaccatagattcctccaggttctggttcataagtggagaaagtgcaggaggtgcgtccatggtttttaggtccatggtctaccttgaaactggcacacattccttctgctcacattcctttgttcagaacttagtcacatgtccacagcaaactacaagtagaattggtcaacccatattgacccaaatgcggtggtgacccacatgtagtgaaacaaccagcagcattcacaacaatgcataatgcagctaggagactgttacaataatccaggtagaagctgatgatggtagcagtggtatttgtgggagataactgaattctggatatattttaaagaatatcctaatagattggataaggctgtgagtcaaagaagagtcaaggatgatgtccaggttttggcctgagaaactagaagaacagatttctcatttatagaggtgaggaagactgaggaggaaatttctgtagaaaggcaaagaatttggtgttggatatattgggtgtgagatgcctattagaaatccaagtaaaaatgtcatgtaagagttgagcatatgagtctggagttttaaaactaaacactgaataaagtcaacaaggaaatcaatataggcagagaagaagcctaaggatcaagctttgggacatgttgatgtttagaggtctggaagatgaagagaaattgaggggagtccctagaaaggcaggaggataaccaggaaaggctggcacacaggagtccaattggagaaagcattttaggaagcggaacatgatc

SEQ ID NO: 8669 - DNA, 2093 bp, Homo sapiens
gacattagactagtttttacctacaaaaatggcaatttttcatttcatttgataagtagttcaactaatattaagtttattttttggtgtcttagggagaattccttagggaactgggaaagatttcacacagaaggtaggttttcaagcctgggaagcagagagataggaaggaaggttgggaacgtagacaagaacattgcaagttgtgagtatagaagacctctgggaatgagcctgcatggaaggtaaaagtgtgaatcaaaggagtgatgttctgtttctacaacttttcatgaactgaagtggatctcccagctccttgtgtgaagcagaaaactgtagttcatcaaaaataattgggtcagagaagtggtggttcacattcccaaatatgtacatctggattagggttttaacctcagaacagaaggtgatgggcattgaaattttggtatatccggggttttggtactgaaaacttcagttgaatattggggtcaaaatccaccctgttcgtatagacttagaagtggccctgaagttcattgtcttaaatggttgctaaggggatgattatagggattttcccacacttggagaagagtcatcctggagcactgggataaatatagagtgagggaaagtgtgtttccttttaaaattagaaatacaatataacaacattggagggagtttagaaatagaggggtatcttcacctataatcaccaccctaacaaaacagccctgaatgtttatgtaatccttcgacttcttggcaatttgctttcatatttttactccactgtaactacaagcttttcttattttacatttcagttttgctaattattattttaaatggctgcatattagtcccttgagtggtggcattataatttgcccacttattttcccattctcagacatttcaggttacttccaatttcttactattagagaaaaaagtatttttaatctctaggctgataaaaggcttcagtccacactttagttttttctttcttctttctttcctttctttctttctttctttctttctttctttctttctttctttctttcctttctttctttctttgacaaggtctgcctctattgcttaggcttgactgcagtggtgtgatctcagctcattgcaacctctgcgtccccggctcaagccttcctgccacctcaacctcccaagtagctgggactacaggtgtgcaccaccatgcctggctaattttctgtattttttgtgaagatgaggtttcatcatgttgcccaggctggtctcgaactcatgagctcaagcaatccttctgcctcagccttccaaagtgctgggattacaggtgtgagccactgcactcagcctagttttttcttattaaagtaaattactctgtcacatggcttccctctgtcagcagagaaacctatttctctattttactagcactaaaggcaatagtatttattgcaaagtgtgtgggatagtgtgtgacaaataatgagggctatgtcaatgtaagttattattataactaggattcctggtcaccaataccagaaaaagacctgtagataaagaacctattgagaagatactggatcacccacagagaattagtatcaacgaatatggagcagccaagcggggctggcagcagaactgtagcctaaatcgtgccataggacttgtctggtttctggacacctctgctgaaactgctaccaccaatgtccctggactggattgacagtactccatccccaccaggaagaattctaccccttgtgttttttcattatctacttaagattcaagatagctgaatctaagttatgttcctaattcttatgcatctatagtgggagatagggctctgcgtcccaccaggactctgacagtggggagaacaccctcaaaggggaaggttgttcaagttccggggggtcaagtggtaaatatcttcacttgctcagactgcctctcacctacaatatagctcagtcaataaaggagatttctactctactgattgcctgaaggtaaaagagcttttgggataagcagcaggt

SEQ ID NO: 8670 - DNA, 1034 bp, Homo sapiens
aggcatgagccaccacgcccagccaacaattaggaaatttgacccactcccgaacttgaacagtactgtactgactcagagctctagcaaatatacaaattaagaggaatagactgcaacacagttacataatttacttaaaactctctcagtggcttctcgttagtttagaacaaaatcccatatcgttcttcctgacctatcagaccctacatgttctagccctggcctttctatccagatcctgtttaataccctctaaccccagttcttggctttctttctgattcctccttccttaggtccttgtcatgttgttccttctgcctggaagggtcccctccgtgtccaggcagccctaggccccatctaacactaacttctgatctcagagaaatcatctgctgctttagggaagccttccctgatcccaggtttggtaccctggtatatactcccatagcaacctgtctgttgtatcactcattatacctgttatttctgttaggctgtaagttccatgagtgtgggcacctcagtcatgttcaacatggtctcctctgtgcctagaactgttcctggcagagcatgggcactcaataaatgtatatagaacaaactgaattaaagaatgaatgaatgttagctttgcttgtccttatattaaatgtgcccataatcatgtagattattttaaaagaatgttttaagaaataattttaagttgcaaagatagtagagggttcttgtaaagccttcttccagtttcctctgttaacatctgacataaccataatacgtttatcaaaactgagaaattaacattgacacattactagtaagtaaactacagactttgttcagatttcaccagttttgccattaatgtcttattttctgtacagtgtccaatccagagtactatgttgtgtttaattattctgtcttcttagtctctttctatttataatttttcccctttttctctttctttgtcttccatgaccttgacacttttgagaactagtggtcag

SEQ ID NO: 8671 - DNA, 1056 bp, Homo sapiens
ttaggagagatcagggtggtggcgaatggagggacaagagctttataaattgtaaaagtcctacaaaggggagagattggtattaccatttttctaattgctcaatttttaaaaaaaagcaaaaacttggcaacccaacattgccttgtttcttggagcaaaagtgggaaataactttgtctccatctgctagggacaccaaaaacaggccgactctttactgagtgtgtaatctccataggaagtgggatagaataaaatggaagccacaccagaaagaatcctgagttctacattttaacaaatggcaggggctctggaagagcttcaaaataaagagaaaaaaacagtggtatctgacaatggtatcagaacactgatgtgggatgattaaatattcagaggataaaaaacatgcacatagaaagccattcaaaggattaagagaaaggttattttgtgactaaaaagagaaaaaaattaaaatacccacccccataatgaatacttcctaacagtaccatggaaccttgactcttgactctgtgctgtaccttgcattccagatgacttgtaaagcaatgatttattggtcccagagccagtgagcttgggagcagttcaataagacagtgtggtctgtgggtcctgaatcattattctacctggcaaccttatgacacctgctgaatcttggagggggccaggaggaaatgatgttgatttatagagggagtgaaattgtttgtcaatgaaggtataaccgtgcttcttccaggctcaggcaactataggaaaccagattggcctttactgacaaattaacataggccaaaatttggaaaagagagcattgccttgcatttttattaaaaccttgtacttttgttaaagatttcactatagctctattaatatactttctataatattggtcaaagaatacaaaatgtcatttatataggagaaataagttcaagagatcgattgtaccatatggtgactatagttaacaatatactgtattcttgaaaattgctaagaaagaggatataa

SEQ ID NO: 8672 - DNA, 1025 bp, Homo sapiens
caagatctggggcgtggtcaagagtttcagagtgaggcctagggagaaggccatccatatccactccaaccttgtcagaaatggggctggtgaactcaggagggcttgttgtcagtcccacctggggaagatgaaggtggaggaaataaggcaagggttggcagtggttgtaaacagctggcccaggatggcttggttactgtcccagccagcaagtgcctccacagtggtgccctacagacacactctacaacttgggggtttgatctagatggttcgtttaagctcagtgtgttttttggggtttgtaaactacttaaattgtgacaaaattttgttcaccaggggttcttccctagaaagctgcagtctggttattctgttttgaggtctctgttgcctctgctgcaaaatcttatggcttgctctgtcttttgcctgtgctcatgcatttccggaatcggtctgttttccctggaaattatgcctgctctacaaaatgtgctgatttctctgatttgggtcatcttctctaggtcacaggtgctctcattgtctactactgctgatttgccctgtgcccatcctggctctcattgacagcttccacctgtttgcacactgtctacacttccgctgcctcatggttcattcccaactcttgactctgttctccatgggagggactatttcactgcagaaacccaattatttaggagggaatgaacaggcttcttggcatagaactgctaaaaagacccacttcccgctctttgagatgaaaaacacatgtttatttcctggtatctcaatttctggtccctgattacataaagttgtcagatttagctaataaaaatacagaataatcagttaaatctgaacattcgagacactgttacattaaaagttatttgtggtttacctaaaattaaaatgtaaccgtgtgtcttctattttatctggcaaccctatgactgaaagaaagtagctgaatttgaaagtagtcagaagggtactggaat

SEQ ID NO: 8673 - DNA, 1047 bp, Homo sapiens
ggaaggtacttgggcaaatgactgctagttgttatccaacatgtattttcttcttttagtagaacttccaaacttattctgagcacaggaaaagagaagggtgtatattgctcaatatctcttgcagctagaagttgccagaagagtatgagaagaagtgatgtgtacaacttcaggattatgcccttagagggaagggccatactctccactcccctttctcactgattggaatatagacagggtggttggatctgggacaggtatcttaggataagagacagaggttgtgtgttgagtataggagctcaacaagatagaagagtcttcaacatcacatcagccctgcctgcttgcactgatggtttggcttggtgtccccacccaaatctcatctcaaattgtaatccccatacgtacagggaggaaattggtgggaggtgatagggtcatgaacaacatcggttcccccatgctgttctcatgctagtgagagagttctcatgagatctgattgtttataagcagcagtttctgctgtgtgctctttatctcctgccgccatgtagaacatgccttgcttccccttctccttccactatgattgtaagtttcctgaggcctccccagccatgcagaactgtgagtcaattaaacctctttccttcataaattacccagtcacaagtagttctttatagcagtgtgaaaatggactaatacatgcacataaactgttactggagagagaaataatctgtctttttaagccattgttactttattgttgttggtgatttttttttgttttttgagacagggtcttctttcatccaggctggagtgcagtggtgcaatcatggctcactacagcctcaatctcccaggatcaagcaatcctaccacctcagcctcatgagtagctggactacaggtgtgcaccaccaagcccggctaatttttgtatttttttgtagagatgaagtttcggcatgtttcccaggctggtctcaaactcctggactcaagcgatccacccgcctcagc

SEQ ID NO: 8674 - DNA, 1028 bp, Homo sapiens
cttgaaatgtgaccagtgcaattgaggaactgaaaatttcattttatattaatatctttaaactacaaatttaaatcattttattttaataactttaaattttaatattttaatacttttaaatttacatagccacacatggccagtggccactatattagacagcatgggtctagggctatatccttcagtagtgcttttcctactcacctcatggtttctcaggagtttgctttgcacgtttctgtgtgtctgtggagaggagggaatcatgtacaggaatgctgcaggaattctaatggatatgccaaaggcttaccctcaacccacaaatatctcagacccaaaatgctggagcatcctactacatatctacctttcacctaaaaaaaagaaaacatacaatggaatccaggaaacaaggcagggattatgtagaatttcttcgctgtatatcttgttttaaaaaatacgtcattacatttatagttgtattatgtataatgggtcatgggatcaaactgaggtctaaggctagtcctggcttttgtgtctttcaggatttaggagatacagttaccttttgatgatctgcaagccctttgcttgctgccttttttgctttgcttgcctttgctactaagttgttgtctggcatgtgacagccctcctggatttcactttccccatggttagtaaataaaatgggataaacaacccgtcagctctctgatattatctcagatctgaacagaatatattattttttattaaaaaatatggagacagaaaactttactttagactggtctaaatctgtagcagattattcaaaatgcgtaccatgttctgcagtatgttgcaaaggagaaaagggcgctgtggtgcaaccagcttgggatacacaggttaaggttacataggtttcttgattttaggactcctcaaagcctttaatattctaatgtgcattatgacttttcaggtggggaatccagctgctgcctttctcaaaagaccctcaaatt

SEQ ID NO: 8675 - DNA, 1032 bp, Homo sapiens
gctagattcttccctttcatttgtgtagcattttctatatttgatgccaagctactttgtttatcctcatacctcccatttccaaagccctttggctacactttaaaaaccaaaaatatcttcgtggtaatctagaaacaagtgggttttgtcagagttgctctcctgccccattttctttgcctttgccatgatttgttcgtgtttccggcttaaaccagaccatatttagaataccccagtcagcccctcattcttcctttctggtagggcttggtattggtttctctctcaggcccagtatccatgtgtccaaatgctatgagctagaaagatagcaatagctgacattgctgaaagctcactatgtgctaagcatggagaaaagtgccttttacccatcatctcactaaatccttataacaacccagggaggatgtttacattattatcatttttatagctggggaagctgcggctaagagctaagtaaacgagtaaagagtggtgccgggacctgaacccagattccataacccgtattgttacctactggccttctttagcactaagcctccggacttctctattgttttttgggtcatcttttacgctaattgaaggcagagtctatgtcctgtaatgatctcctaactccgtttactccataaatgatagctctcctcacccccatgggcttatagtcccaggaatgaatttttgtttggctttcctgtccaattttgttcttatcacttcagttcacggaattgggccctttctctgagccccagtatgacaggctggccctgaagagatttcgtggttgataattggatactgtgtgacccccaaattaccctgaccctcaatccactactaatgaatccctgtggaagccaccatgttgatggttgtctactgttcatgagatgcccatgccttttctctatgggttgcaatggccaggaaagttttcctggggagattgaacctgggctggtctttgataatctgaaaggcatggggaaa

SEQ ID NO: 8676 - DNA, 1042 bp, Homo sapiens
aattattttaagagatagtatagtttaaaatattagttccatgggctcttcctccagtgctgtcagtgaacatttattgagatgtgaccatgtgtagtaatgacaacatgattgaatatgttctgtgtgccaagttatctattttaactctcaaaactcttatgaggcaacaactattgactgccccatttcacagatgaagaaactgaggcttggtgagaccaagtaacttgccaagattacaacactagagccagtggtgggtagagccaggaattacatggaggaagcctgacgccagacactgtgtgctcaatagccacattattttgcctcgcattagaccaatataatataagagagaaggatgtcaagctgaggagataaagtatggagatatgcataggtcactaattcccaaacacaggtatctattctctcttgggcttatcttgccccatggcgtaaaggaggcttcacatggctgactccctctgctccatgttggacctgacagtctcctggccttggatgctccactcttactgcaactgacccacactaactgagctctcctctaccaatgccttctccatgcccccttcagctagtggctccactactcctctcaggcctggaatctctgcttcatgcttccctttcttggcttctcttctcctctgtcatcccattgttctttctttcctttgaaaggcctcctagttctgtggttactcttcatttctcatcagttctctaggccaagccttcatgacttcatgcctagataatgacaagagcttcactcctactttttgaaaaacccagtttctctagatgcatagaaactcaaatatttggaactagaagacttttaggagaccaaccacctagatttccaaaaaatgtgtctccagaatctgcctttctcatttaagactcaactcaagaggtacttccttcatgccactgactctgactccttagggaatctgtgctttgggtaacattcgttctgcttgctcagctgggtgtagggacc

SEQ ID NO: 8677 - DNA, 1028 bp, Homo sapiens
cctgaggaacatggtgaaatcctatctctacaaaaagtttaaaaattaactgagcatagtggctcatgactgtagttacagctactttggaggctgaagtggatagatcacttaagcctgggcagttgaggctgcagtgagccatgattttgcctgtgccacagcactccagcttgggtgagagacctgtttcaaaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaacaatatttgattgcttgattcttaccttttaaaaataatctagtttccaaataattattacctagcatcctccaaagttaacttttaaaaaaggataactgaaaactcatgaatttaaacacatttgaagtgtcaacatccattaaggttatttttatggaacctcatattgtcctatctttggccaatgagatcttcttttaagttggcccctgagtcttcttgacatgaccccagtaacctgtgatactgtagttgctctttggtttgatgaaatatttccaagcccttttataatatgtttcctgtctttgccctggaatcagccatttctctaaggattcctggttcttttcatttggaaatagtgattcaaaaccacagctttggcactacgggagggcattggattggttattatctccagatctttttggtggaaaatgtagggataaagagaaatacaacataaattgatattgataaacatcatttcaaatttgagactaagggtttctatttaactgcatctatcttgcttctctttcttctttgtacgccagattctggttcccaaggacacaaacttactcatttcttttaatctataatacatattagaacacccgtgttagactaccaactccaccatcaatgatataatgacagaaaattgtttagggtttttttttcccttcagt

SEQ ID NO: 8678 - DNA, 1030 bp, Homo sapiens
acagaattggaaaaaacaattctaaaattcatatggaaccaaaaaaggggctgcatagccaaagcaagactaagcaaaaagaacaaatctggaggcatcacactacctgatttcaaactgtactataaggccatggtcaccaaaacagtgtggtactggtataaaaataggcacatagaccaatgaaacagaataaagaacccagaaataaacacaaatacttacagccaactgatcttcgacaaagcaaacaaaaacataaagtggggaaaggtcacccttttcaacaaatgatgctgggacaattggctagccacatgtaggagaatgaaactggattctcacttctcaccttctaaaaaatcaactcaggatggattaaggacttaaacctaagacccaaaactataaaaattctagaagataacattagaaaaacccttctagatattggcttaggcaaagatttcacgaccaagaacccaaaagcaaatacaataaaaacaaagataaacaactgggacccaactaaactaaagagcttttgcatggcaaaaggaacagtcagcagagtaaacagacaacccacagagtaggagaaaatcttcacaatctatacatctgacaaaggactaatatccagaatctacaacaaactcaaacaaatcagtaagaaaaaaaaaaaaacacaacaatctcatcaaaaagtgggccaaggacattactagacaattctcaaaagaagacatacaaatggccaacaaacatatgaaaaaatgctcaacatcactaatgatcagggaaatgcaaatcaaaaccacaaagcaataccaccttactcctgaaatggccataataaaaaaatacaaaagacagtggaggttggcatggatgtggtgatcagagaacacttctacactcctggtgggaacacaaactagtacagccgctgcaaaaaacagtgtggagctttcttagagaactaaaagtagaactaccatttgatccagcaatcccactactgggtatc

SEQ ID NO: 8679 - DNA, 1050 bp, Homo sapiens
taatacattcctgtggtgtgtcttctcattttagtggaagaaattgaacagacttgttcaaatcacagctctgctttttgccagaccttgggcaaattgctttgtgcattagtctgttctcacactgctgtaaagatattatctgaggctgggtcatttatcaaggaaagatgtttaattgactcacagttccacatggcaggggaggcctcaggaaacttacaatcatggtggaaggtgaaggggaagcaggtacttgtaagacagcaggagagagacagcatgaggtggggaagtgctgaacacttttaaaccatcagatctcatgagaactccctctctatcacaagaacagcataggggaaactgcccccatgatccaatcacctcccaccagatacctctcatggcatgtggagattacaattcgagatgagatttgggtggggacacagagctaaatcatatatcaatatcactttgcctcttcgagttttcatttcctaatagagataagcacatctatgaaagagactgttaactaatcaccaaaatcccttttgtccttcttctataggtctaagattgtagctaagatattgctacccaggtaaggaccatatttctcaaattcttgccaagtctgggatttgattctaccttactgaaagctaatatgttagcttctgactgtttcactggtgctaatggaagacacaagacccttaggtcagagacaaaggagtttagtactcatgacacatcaagcagcaggaacatcagcatatttgcattggttcttcttgccctgggtcttatgggggataatacaatggccccagatggatgttatgcatgcagagtgtttgtgttgcaactgaggagcaccaagcttggggaatccatcacttttatagtaagcaataagcaagcctattcattgtccctggtggtgtgtgtgtcatagggaaggataagtagatgtaatttcatttcctaaggtaattgtctgtataaacaaccctaagaaatagccagaataaaagagca

SEQ ID NO: 8680 - DNA, 1079 bp, Homo sapiens
gttccttgtgtgtcattggtaacagacaaggtagctctcgccacagtaattaaagtgatcttggtggcactaccctgatagaataacatatgctgacagctccctcatcagagcaagcagttgagccttcctcttgctgggtccacgtgcgagggtcacgttcggaggcgcagacctcttactgtggcactggggatgaaatgagactgacagcaaagactgcatgatcaaaacaaacaatgtagtgcttttgattgaaagtgtgcgctctgcccagccctccggaactgtgcattgaaatggtgcaaagtcagaggcagaactcttcgagtggctttgcctaaaagaagcatcccattctttacagtgaatagggagagggaggtggaggcgttgcgcttgaaaatcgaatacctagtgactcacaggcagaggaaacccaatgtattgactcgtcatttcacttctcggggaggcttctcttcaagcggcaccaagtggaaagtgtgtggtggggggtggtagtaggaagagcactggaattaggaaccctaccttcaccaattagctgtgtgaccctggggtaatcatgtaatggcttcaaacctcagcttcctcatctgtaaaatgggggaaaaaaagtgagcccatttttacaggattcgatgaagctcgaattagctaatacatattacaactctttctcaaaaacaatgtagacatgtcagttaggggtctaccttgtagtcaagggtcttgtctttttttttccttcacttactacctgcttcattcaccacctgacatttccaagctctgcttccgtgacagagaaactgcctgcagggtatctctcttttccaagagctactgacacacacacaatgcaaaaacgtttcctttttcttttccttgccattttgtacaatggggataatgacccatcttgtagaattgttataaggatgaaatataatgacaagtgaaagccctttggaaatgatataaacaatagtactaaacacagtggctaagactctgggttgaaagcagagtgaccatgttcctgtgcagcctcc

SEQ ID NO: 8681 - DNA, 1848 bp, Homo sapiens
ggttatgccaacagtcagtttaggcagcgaggctgtaagaggaaagtggcattcttgagggcctattttgggaagaccaacactgcttgtgggcacaaatggattctagcttctgaattactcggggacttccctgacacgttagcacggtttttatagcaagaggctgttccgatttggagttttgcaatgcagtcatggtagatgaaggaggtgcccagtagcttctggattactaaatatagtattttaaatgttgtacatcagtgaaatgacatgaacatcatacagaactagtacagttaccagagcttccatgacagtgctctttgatctcttctataggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatcttcctgaaaaaggttgcacctggaaaatctggacttcttccctgggcctatgaggcgctgtaggaggaggcctatgggatctggcccctaccagcagtagcatcatctcctt

SEQ ID NO: 8682 - DNA, 2174 bp, Homo sapiens
tcctagtcctaaatcataccagtaacttccaaatgattgaatatcatgacagtgaaaattgaaactttatatacatgtaaatcagtctctgttttactagttagaaaccacatcataggccaggcatagtggctcacgcctgtaatcccagcactttgggaggccgaggcaggtggatcacatggtcaagagttcaagaccagcctggccaatatggtgaaaccccgtctctactaaaaatacaaaaattagccgggcgtggtggcgggtgcctgtagtcccagctacttgggaggctgagacgggagaatcgcttgaacctgggaggcggaggttgcagtgagccgagatcgcaccactgcaccccagcctgggcaagagagcaagacttcatctgaaaaaaaaaaaaaaaaaaaaaaagaaaccacatcttaggtatcaatttccttcctctttaataaaatatacaagttgctttctgaatgcgaaagtgtcttacatttgatggtcttcattgtattaaaacactggaaatgcatatttaactagacgcattgagtattgtagtatcactgttgattgtgttatccatacttgtgtagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgtaagttaagatctgaaagaaactcagtttttctaggtgcttttttcatgttactaacttttaatggtgcagagcaggaattctggaacttgactctcagctgtggctcatattagctgtgaccttgggcaagtggcttgacctttctgtgccctagtttcctcctttgtaatatgaagttgttaacggtacctgccacaggtttgtggtgagagctaacctcaacttaaaactggttgctgatttcaaacattgtttatttgtttgttaaccaaccaggttaagcaaccttttccacgggatggataagaatactcctgtaagatacacagtgtattgcagccttattaaagtggcagcatcttgtggggccatccagtacatcccaactgagctggatcaagtgagttactgtgtggaatagttgttctgcttataagaaatgtactttttttttttttgagacggagtttcactgttgttgcccaggctggagtgcaatggcgcaatctcagctcaccgcaacctccgcctccagggttcaagcagttctccttcctctgcctcctgagcagctgggattacaggcatgcgccaccacgcccggctaatgttgtatttttagtagagacggggtttctctatgttggtcaggctggtctcgaactcccgacttcagttgatcctcctgccttggcctcccaaagtgctggggattataggcgtgagccaccacgcccagccagaaatgtacttttatatgttatactttatatgtgttactcagttttctccttttgtcaatctcttgtaggttagaaaatggatttctgactggaatctcaccactgaaaaaaagcacacccttttaagactactttatgaggcacttgtggattgtaagaagaggtattcaaaagtaatgaactaacatatcacttaacagacagtataagtaggtggggatgttttttaaagagaagtagggccagtaattttgctttactctgttctccacagagttgctataaatctatttctataaatttgacctaaagttaaagataactataaagattaaaagtagttttccctcatctttgaactttttaaaaagtgaaatttggctttttttctaaaaaaagaaaggtggggcctttccaacatgggcttcaacctactgctgtagcatgagcttggtgaatgtggtgaagcatctcatcatttttggatggtgcagtggcagactacaaaaaactttgtgttaatgtaaatattccatctctccacccatgtccttcctcttgcttatcacactctagacccagcgagcctatgtcaggtataaaagcaccatgctctttgccagtctggaccaggagctggcactggttcttctatagcccgtgtactaagaatggttttaacatttt

SEQ ID NO: 8683 - DNA, 1019 bp, Homo sapiens
agttacttttccttagttgtccatctttcctactaaaaggaaggttttatgacttttcccatagacagggactttgtctctcttagtcaccgttataatgtcatcagcacagtacctgcctcttaaaaatattttaaatgaatgaatagcagtaatgctttcaagttcctaaagcaatatttctttttagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatg

SEQ ID NO: 8684 - DNA, 1022 bp, Homo sapiens
cccccattgatgtgtaattgactgtttcaaaggagcactggttcataagctattgcatgcattaaaactgggttttctatattgcagcattttaagacaggggtcagtgacaatgcagaaattgctcaatgatgcactttttttattactgcattaaggttttgacatattagtaatgaataaatgtttccataaaattagattttttataactttaaaattgaaatatgacacagtacactgtgacttcctctttgatggtagtattttagttttatgaaacaaagcacagcttcctacaaagtctttaactcatacttcactgccttagtagtttgatttttcagaacaagagtcctaagggttttaagtttggttctttgttactttaaacatcaatttaaagtgtttttagatgcaagttttcacatgtaaaatagataacggttttatggaattcagcctagaaataatcttcattcctctgataagttttttcatttatggtaagattgtaactgcagaaaagataagcagtaaaatagatttaatttcaggagtatttaaaataatagaaatttcagaagtttctatcactttatattgaaagagagttgtctgtccatgccaatagaactgagaatgttaaggaatttttgaaaaaaatctttaatacttattcattgataagaaaaaattcgttaacattgctaatttattgtgccagctagaattcaaattccttcatttgccttacgtttcttgaacatctatgcaaatcagtattctattagaaatttgtttatatgcttttcagaaaacatctttatattaatgtgtatattttttattttaattctataattaaacatttattacagctgaaagcctagtgacaactatctagattccacaagttgcaatcagtttgtcagaacattttcctttattaacactgacaacttaggccaacagtagcattatcttgtgtcaactgaattgccctaacatgtccacatgta

SEQ ID NO: 8685 - DNA, 1032 bp, Homo sapiens
tgtagagacaggatctcactatgttgcccaggctgatctggaactcctggcctcaggcaatcttcctgcctctgcctctcaaagtgctaggattacaggcatgagccatggggccaagcccttgaccagagatttaagacctgtgatgaagagtagtgagtgacttgggaaatgttgtataattggaatggcagccacgaatttacatttgagttgccagacatgaggtggaccacttaagcagaggattaaaaggaaaaatagcctttggggaaggtttttgagaatgtggtaatatactaggttctaggaacacagcggtgagtaaaacaagcatagtgtctgcccccatggctcttatagtctggttttcttaagtaatgtgtactagagctgggagaaacaggaagacagaggaaaaccaacaaggatgctagcatggcaattcagatgtgaggtaatgagtttgaacctgtcttcaaggaaaaagaagtcgtagaacttgatgcctgattagaaagaacttggggccacacgcggtggctcatgcctgtaatcccagcactttaggaggccgaggcaggcggatcacgaggtcaagagattgagaccatcctggccaacacggtgaaaccccgtgtctactaaaaatacaaaaattagctggacatggtggcacacacatatagtcccagctactcgggaggctgaggcaggagaattgcttgaacctgggaggcagaggttgcagtgagccgagatcccgccactgcactccagcctggcaacagaacgagactctgtctcaaaaaaaaaaataaagaaagaacttgggaatgttggaacaatatgacttgaacctaagcttctgtgctgaagaaatatatgtatggaagctgggagcaagaaaacaaaatttggatttgacaggacaaaatggttcatattttatttatttattttttttgagacagagtttcgctcttgttgcccaggctggagtgcaatggcaaattacaggtgtgagccact

SEQ ID NO: 8686 - DNA, 1051 bp, Homo sapiens
cctgagtagctaaccacacctggctaatttttgtatttttagtagagatggggcttcaccgcattggccaggctggtaatttttgtatttttagtagagatggggtttcactacattggccaggctggtcttgaactcctgacctcaggtgatccgcccattttggcctcccaaagtgctgggattacaggtgtgagccaccgtgcctggcctgttttttgcctttctaacttgaaataacttttggcaccagtttttagaattcctaatgcatacttttttttagtatgaggtataatgagtatgataaatactcctctgaaaaaccaaagtaatgattagctcttctaaaacctgtcagtttctatatgatggacatttgtttgatacatttcaaatctagagttttcctcaaggtttttgggaaaaggccttatagatcataatttgtaaggcgtaagaacaatctcaagttaatgaaaggttatttcagacaaacttccactgttagagttcagaaagttttttcccatggaaaccgtgttgtaagtaatagtagctgtcatttacatcactagcaactaatttgtgctagctgttttaagtcacacgtacattcatttatcaaaattcatttatcatgaataaatgaatacatacattcatttatcaaaattcattataaaaatcctttgaggtaggcattctttttaccatccttttatggatgaggaaactgagggatagagacatgaagtaatttatacctacagctacatagctagtaaatagtggtgctgtgattgaaacctgggcattgcagatctggagcctatgtgataaccagtgtactgcactgctttattgtaagatagtggaatgctgtaatccacctatatgtgaaatgagtttctgtgagttggcctggaaacctaagcatcattaatatccttatttaagtgttctttgtcaccgttgaccattacctagttgaaatacattccttttcacttccatagcactgtacttgcctggttttcctcctactttt

SEQ ID NO: 8687 - DNA, 1047 bp, Homo sapiens
ggcttgggattgataaatttcttgttcattccttgctttctcctgcggactcacatccacgtccatgcttttaaatactatctcagtggagatgcccatatttgagcagactcttctcaggacctcagactcttctgaaaacctgatcacataaccaactacctctttgaccttttacttgagcttaatgatatgctttccccacccatcacacctctgcttctctagtgaggcccatctcagtagtcatacctctgtccacttagttgcccaggccagatggtgggagttgtgtgtgctcagtcactaagacctactgttttgaatctaatgtcttgaaactgtctgcttcttttgtatccactgctccagctggtccaagccaccattatttttcacttggacaactgtggtagcttcctaacttagtcatcttggaccttttctttcctctcttcaattcattcttcttataccatccagagtgatttttaaaaacacagatctacaagtttgctcttggtcctttgcttaaagcctttccatggctactcctacatattagggtcacatttttaaacatctgtaatatggtcaggcgtgatatctcacgcctgtaatcccagcactttgggaggctgaggtgggagtattgcttgagcccaagagtttgagaccagcctacgcaacgtggtgaaaccctatctctacaaaaaataaatagaaaaaattagccgtgcatggtggcgtgcgcctgtggtcccagctactctggaggctggggtgggaggatggcttgagcctgggaggtggaggttgccgtgagctgtgatggtgccactgcacttcagtgtgagcgacagagtgagaacctgtcacacacacacacacacacacacacacacacacacacacacacacacattgtaatgtgctctgtatggctctgcgtttactgaccaattttttttaatttattttcttttttattttttcttgagacagggtctaactctgctgcctagggtggagtacagtggtatgaac

SEQ ID NO: 8688 - DNA, 1004 bp, Homo sapiens
tcctgccttggcctcctgagtagctgggattaaggcatgcgccaccccattcagctgatttttgtatttttagtagagacgaggtttcaccatgctggccaggctggcctctaactcctgaccttgtgatccacccaccttggcctctcaaagtgctgggattacaggtgtgagccactgcgcccagccagtagtaagcatttcttaatgtgctagccgtgaatatgaatatgtgtatggatgctgtataatatgaagaggtaaatgagaggatgtgggcctggtttcagcatatccactcttttttttttttttttttttgcagaaccatcttctcttttacctttgagtgaaacacagttttttcactgttcctaaaatggtgttaggaatgctcttatctagggtctttgtgctttttcctgtgccaggaccacttttccctgagataatctgcgtgacttcctcatgttgatcagtggcctctgctagtaccctcaaaagaatggtatgcacccccatcaccatcaaccctgcttaaggtttcttcataacatttatcaatccttgatataaatacttctctgttcttgtttattgtagtctctgtcctttagcttgggtgttttttgacagtagaacttcagctgtgttttcccccacttgcctggcatataataactgttcaatgaatactgatttaataaagaatatgtttaatgggggatattctacttttacttgtctaatatttcagagtttaaatttggcctctgtaagttaacaactctttagggatcctgaccgtgtagcttgtcctatgttgctaggcatgtaggcatttatggggtgtaactaaacataaaataatgaaattttcatatggcctaatgccatcattctcattactgtgtgatcactgatcctgtttaagtaacttgagaccagatttgtctgacccagtgaagcaaacacaaatatgtggataagctaaaatacttttg

SEQ ID NO: 8689 - DNA, 1029 bp, Homo sapiens
atgcccagctaattttttgtatttattttagtagagacgaggtttcatcgtgttagccaggatggtctcgatctcttgacctcatgatccgcccaccttggcctcccaaagtgctgggattacaggtgcgagctaccgcacccggtctttcctcgtccttttaatactcagttgtcatgtcctagaggaagtcttcccagattgtgttatgtttatttacttatgctcttttatttctctagttcctagcataacacttggcagtcagtaaatgtcagttgtataaatgcagaacttacctttaggtgcaacaatagtagcattgattcagcattcattatgcgccagttgctggactgtgctagttgctgctgaccgtatgtgctttattgtttactctcacaacaacctgatgaaggtaggtgttactattacccatattttactgttgaggaaacggagacttggttaagtctaactaattgtctgtgtggctagcctctaagtcacagaatttatatagaactggatttgaatcctgtggcctgtttgcagagctatgcttttatacagctgttacacagttgtttcaaagttccctcgtttattttttcaaattcatgataaataatttcttaataagagctgattattcttaggctacatgtttttgcttttaaattatcaaactggattagctaaaacaaagattttaaaatatttggcatttaggtatgaatgggataggtatatgctagagttccacacagatttaattcagtggacttagtgtttatttctattcggattttataccaaagaatactgtgtgctaaataaagtaaaaatatttatcttaactgagaatattagaactacaaagaacattaggctttataagtaggaaaacaagtattctacaagattatgtactttgctcaaagtcttgtagcatttatttgcagaatcaggactggaatttggggctcctaacttccaatccagaatgtttatctttctcaactatga

SEQ ID NO: 8690 - DNA, 1047 bp, Homo sapiens
caacctcttattactttgcttttgataaccttcacagttttcagaagtactgggcaagtattttgtaggatacccctcttttggaatttgcctaatgttttttcttttcatgtttagaccggtgttactggttttgaggagggagaccacaggggcaaagtgtcactttcatcacatcctgtcagtggtacatactatcaacgtgatttatcactactgataaagcctttatcacctggtcgattcttgtcaggtttctacactgtaaagttactctttttttcctcctttcaatactatactctttggaaaggcgtcactgtgtgcagtccacacctgagtggggagttatggtctccctccttcagggtagagaatctacataaattaattgggaattcttcaaggggaatttgtctcttcctctctatttattcaatcgtttatcagtatggacccatggatatatattttatacttcgggttacaagccagtactattttgttgctcaaaatgttcctgctttggtcattgggaactcttttcaaatagcttgtgtgttcctttgacataaatgtcttttctttttttctccctccctttctgccccctttctttttagcactttcttactttctggcactacaagatactctagactcatcttgtatatttcctgccccagtactagaatcagccatttctccaaggagccttggttcctttttcttggagaatggtacgagaaaccaatctgggcactaggtatgttctttgctgctggagtgtcattgcttctgggctctgtccgccagagtaaggaaatacacatgtagcttgttttaatatagagaatgattgctatgatcattttaaaagcatataaaatcgtaagagtattttgaaaatagcagttgggcatttgggtttttgtattaagggatttctacattatactttgagtagcaaaagaatgaaactggactcctacctcacaccatataaaataattaatttgaaatggatctgtcatcctaaatgtaaaa

SEQ ID NO: 8691 - DNA, 1034 bp, Homo sapiens
gttgaatcttaagggacaggtatatggtgttcattgtatttttgatttctttctatgggtttaaaatattcaaaataaaaacataacctttcctttccaagaagagggggaaaaatcttgttttgggctactctgaaaatgtttgagcttgaagttttctcagtgagttattgggaaatagtattaattatttatttgaattatctgttattccatagaatactataattagagaggttatggaggttatttcatctggtcctttttttatacagatgaaattagtccaacaataattgagtcccttatttaaattacactgtaagccagaagtagagcctgtacaatgaattcacctctctgttgtccaggatattactttttcttctgtaccacattacctctcccagtaaaaagactcttgtttgaggtagaattgaattaaagaaaatactgtgtattatttttcttactaatgcatcttaaatatatttcctccattgtgatagtattgtcagactgtgtttgatccacgaatctataggtcaggaaattggtcaaaggtttctactacttttatagttgttcttctagaagttttttttatcagatggtttggactgtgtattttggtcactgatttttaatgtcctctagtttaagctatgaagaaggacatccctcacactctgaaacagatctccttcagagacagagttttgcagcctctcatcagcttcctggatatgctcccacacctcagcctactggtaacaattctcttgtgaattatactacgagtctgggtacatttagtgaataagaagaaaaaccaattttcatgtgttgagttctgaatgtataggacatactcatgccatgggaaatgaaatgagagtaaaagcttgttttttgtttttatttttgacatggagtctcgctctgtcggccaggctggagtgcagtggcgtgatcttggctgactgcaacctccacctcccgggttcaagtgattctcctgcttcagcctcccg

SEQ ID NO: 8692 - DNA, 1029 bp, Homo sapiens
ttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcatttt

SEQ ID NO: 8693 - DNA, 1056 bp, Homo sapiens
catgtgccatgttggtgggctgcacccataactcgttatttaacattaggtatatctcctaatgctgtccctcccccctccctccagcccacaacaggccctggtgtgtgatgttccccttcctgtgcccatgtgttctcattgttcaattcccacctgagtgagaacacgtggtgtttggttttttgtccttgcaatagtttgctgagaatcatggtttccagcttcatccatgtccctacaaaggacatgaactcatccttttttatggctgcatagtattccatggtgtatatgtgccacattttcttaatccagtctatcattgttggacatttggcatattttaagaagcaatgacttatgtaaacaattggcagtaagtatggtattttctattgtaagaaacatgccaaggaaaaatttatttgtaacaataatataactaccacctctgtgccaggaactagtagcaatgttgtgagatacacattgttatctccaatatacagatgatataactgagaataaatgaattatgtgggcccatacctctagtaagtgacagagctggaatctgaacccaggtttttctggttctagagcctacattctttctcagctctttaggataaatagggtggtgctttaagacttaaaccttgttttgtaacatacttcccagcttctctctggacttgactacctttaactactaaagtgttacgagacagctggtatccaaataacctgttagcataaatatctgataatacatttctaaagaattctcatttcattacacagggaaattaacatgatagaaagtcagtctcagattcaaagacattactaccatggatgtgtctaatcctaatatggttttataacgtctcacccagttcagagtgctttgcaatcgctattatattccctcttacattcccagaatgaaccttttgaaatctctgttctaaaacatgagtctaaaactagtttcttccagagatatgttatctcatttttagttaaaatcatcatcataaacccgatcct

SEQ ID NO: 8694 - DNA, 1046 bp, Homo sapiens
tattttctggaacataggcttgctgttagttttttgtggactgctgtagccattctgagcatatgaagatgtctttagttgcacctgtttcctcctgttttttgactttaaattattcagatgcctaaagggcatattccttgctctaaaataataaagttttctagtaaagtttgtgataaaataattataaagtaagaattatttacatatttacttgcagtataggagttggattaagaaaaaaaaaactaatggaactgtatcttgtatcaacataaactaaatcctgggctcttttaggcaagatggtacacagttgtctaacactctgaattctatatttgcattaaaaagaccaatggagtataaaaacccatccctagttttgaatcctgaaactagggttaggtgctattttcaccattccttactcctttcagattgaattaaaatgtagtataaaactagtttttgcactactaaaatgtttctgaatctgtatcaagtaatttactattatcaagtcagtggaagtagaatgttagagctatatagtctagttacaatttgatttcattcaaagtgactggtatgttttttcaaaatgaaggccaaactgacgaacagcactcagcccctacttcacaggcacccagatctcaagaatgtaatgaaaccaaaagtggtgtttcccttcagttttgtttgcatctctggataaaatggacttggctgaaatgtgttgaaagcttaaaaaaatgtgtaataccaccatcagttttctgggctccttgaagatcttttaaaacttaaaatttgggttttaatttttttttaaggtttgttttagttctttgtctctgaaatttatttggcattctgggatgttctgggtctttgtatactgagtaattttggattttatcttggacattttgagtactgtattgtaaaactgtaggttctattaacatcctctgaagaatattgatttattttgttctgttttagcaggcagtcagaacataagttctgtcttactt

SEQ ID NO: 8695 - DNA, 1051 bp, Homo sapiens
tagttttcttgttttataaaatgtaaaggttgaaataatttgttatcaaacttcttgatcttagaaccattttacattcttaaaaattattgaggatcctaaaatgcatttatgtaggtatatctattgatatttactatattagaaattaaaactgagatagttgtaatacataagaatataccagcacacaaagcatggtgtacaatatatgtaagaaatttcaggtggtttagtagtgtagtacagaggttgccaaatgtcttgcagactgaatctgaccctcagcctgtttttatagttttattggaacacagccgcatagattcatttgcatatttccatacagttgctttcccactacagtggcagatttgagtagttctacagagaccatatgacaaaatctaaaatatttacctatagccctttacagaaaaaggttgctggcccctatttttctagaacataaagtagaatttaagaaaagaggaagggatgatgaaagaccttgtatgccataataaagctaaaaagcttgtgatcctgtaaacaaatgaaagtccttagagggatttataagggggaaacaatatggtgaaatttaaatttgaattacaagacataattcaggcataaattgagtctgaacctaagtagtggcagcagggatggagatgaggggacagttttgagatattcaggatgtaattttggcagaacttgaatggtgaattagttgttggggctatggttgaagttgatgtccaggatggtttctgacattacaagtatcattgcttgagagattatcttagaaattatctgattagaaatagaaccataataaaaaaaattcttcagtgctgaagtctactttaaatttaccgtttttattttttattttttgagtcaaggtctactctgttgtctaggctggactgcagtggtgcactcatgactcactgtagcctcgacctcccaggctcaagtgatcctcccacctcagcctcctgagtagctgggactacaggtgggcaccaccacaccc

SEQ ID NO: 8696 - DNA, 1054 bp, Homo sapiens
aatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactgga

SEQ ID NO: 8697 - DNA, 1050 bp, Homo sapiens
tgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaagaaaatcagaatgtttggggtttttttgttgttgtttcttttgtttttttaagaattgaaaacaggtatcatataggcaaaatcatcatcatgttacagattcctcacacaaactaaacagttattagttacaaatggcatagggcccacccattattttctcagattattttaagttagtatttgatgaatatgcatccttagctaacaatggcagaccatatttaagagtttctgttttaagatataactcttttagtccttttccacctataaagagttataaatctgccaggtgggtgcagtggcttacacctgtaatctcagcactttgggaggccgaggtgggtggatcatgaggtcaggagatcaagactgtcctggccaacatggtgaaaccccatctttactaaaaatacaaaaattagctgggcgtggtggcgcgtgcctgtaatcccagctgcgcaggaggctgaggcaggagaatcgcttgaaccagggagt

SEQ ID NO: 8698 - DNA, 1041 bp, Homo sapiens
tgtgggaaaatctgagtttaaagcctgccaactcccctcatgtaaatatctctgcaaccttgtctccacaaggtaagctaaggatgaagcaaagtaagaagtagaagacaaacttcaaagttatttaaaattttttaatcttaatctttattagattttaaatattcaaagtacagagaaagagtgcactatgtattaaagctgtttatgttcaattttaacagaagtctattatctttaacaaatagatcagtgttagaactcttgaacactgacttttgtccgatcagctggcaaaggttcagatctgagatgttttgcatgcagatttgtattgaaaatatgctctccgatgtttcttttcctaagattttattaggtcaagtaaaatttgaaaattacattaaaacattaacagaattcttcggttcttccttgtctgtagcaatggaatatagtttaatgactttaatttccaccctttcccccattccagttgtggaaaccctgagtggaataatctgcaaccaatagtttcaaacaagtttttagcttgaatgaatcattctttcttccagagtccttattaacatgttacatgacttgatctcttatctctgacagattgctttttacagtacaaagaatgaaaagaattcctgttgtccaaagcctattctcctacactctaaacaaatcttggattgttttactttgttataagaaagcacttcgtaaggttgactttttctttctttttggccacaaatttactagcttagacctgcttagaaaaatattatggtgagcatatagtaactattaattgttacttttcaccttgtcatttttcctgtgtagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttata

SEQ ID NO: 8699 - DNA, 1046 bp, Homo sapiens
ctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattagatttaactgttttcagataaaatagcttgagttcacgaatctcctagatgaggaagtcataggaaatccctggtgtttgagcattatttttcaaggaacttcagtgaccagaattcctgacatgtcctctgagcgtgagtgatttgggtctcatagacgatctgttctttttttttttttttttttttttttaaagtgtacacatgtatgtctgcattttagacagggatgttatattagaagcagagccatgaagttggaatgaccaactgccacaacagcaaggggtaagactatattactgtatgagtaatgcagtaatatcggcacctgaagccttctgtacaggaagctaagagaaacttacaagttagccgggcgtggtggctcacgcctataatcccagcactttgggaggccgaggcaggcagatcacctgaggtcaggagtttgagaccagcctgggcaacatggtgaaaccccatctctactaaaaatacaaaaattagctgggtgtggtggcacgcgcctgtaatcccagctacttgggaggctgaggcaggagaatcgcttgaacccgggaggcagaggctgcagtgagctgagatagcaccactacattccagcctgggcaacagagtgagactctgtctca

SEQ ID NO: 8700 - DNA, 1055 bp, Homo sapiens
ttctgtaatgatcagtgataacctttttttcatgtgcttgttggccacacgtatgtcttttgaagagtgtctgttcatgtgtaaaggaattattttaaatgtcctaactggttctggatccagctgcttaaaaatatatatcttgcctaatacttaagcaccttatattaagaatatatatttggagaagtactgagtcagtggaggcttttaggatagtcagtacttatgtggcctacttaaggaagaatgtcacttcttttggttggcttggtatgtagttaagagtggtttggaggaagaacaacttaatattagtgtgctgcttctgtagctttgccatagatgttctttgggaccttgtcttagtcacttgtaggacaaagatagaatagatatttggaggatgtatgttacacatttataagtttgtcaaatgaaaccttgagctttttggcagaccaggctgttctcagttgatacttggaacatatgttactaaacaaaggcagcatattgtctggattctgagacaccactgttatgccagggacctagagcctctgttcttactgtgtggaaattaaaacaactggatgaatattgtcaatatgtattgtatttttaggacagcatttgtggtttggagacagttaagttattaagcagatttattttgtcttttatatttggcagttaatgccaagttagtacttgagaaggctcttttcaacagaaagtccttgaaatggagcaaactgaggaccatatttttgaccttaaatgtattttgttactttaaactaatttctctaatttttatatttgttcttttctctttttatatttattttttctatttttgtatttatttttttcatttacagacagggttttgctccatggcctgggctggagtatagtggtatgatcatagctcactgcagcctcaacctcctgagctcaggagatccttctgcctcagtctccaaatagctgagactacaggaggtatcgccaccatgtctgctaactttttcatttctttttctgtc

SEQ ID NO: 8701 - DNA, 1030 bp, Homo sapiens
agtaatacatagatgttaaagaatactagttaggcatagggcaaaaacatttttaaaggcttggtcacaaagtgagtttatttaattctgtacactgtagctgtaaaatatgtagtaaatgtaataccatgcaaaccagtctgatctgtcatttcatatcaggttttaatgactgtatttaagaattgtttatacccattagatgtggttgtcccttgatatctgagggattggttccaggaccccccacggacatcaaaatccacagacactcaagtcccttatataaaatggcatagtatttccacgtaacctatgcactgcctcctgtatactttaatctctagattacttattataatgcctaatacaatgtaaatactttgtaaacagttattatactgtattgtttagggaatatttacaaggaaaaaaagtctgtacgtgttctgtacagatatgatcgtctgttttttaatctgtggttggttaagaccatgagtgtagaaactgcaggtacagaaggctgactgtagttactcgtaggttaaaagaagactttagtggtggttttaaaatttttggaataaaagcctttaatgtcaaaggttattagttttttttccttgtgctatatatgtagctttgttttaaaagtgcatatagcttcatgaatgtactatgtcaatagaatgtaatggtatcatggattagatgtccttcccgacctcacacacttcaaaatgtgtgtacctatttgttctgagtcttcagcattttcctgtgaatggaattcagcacgctgaatgttattaacagcatgtgtgccaccatgaaagagtgccagttcagtggccagtgaataatttaggcatcagctggtgtggcaagattgtattacttaggacagagaatctaatatgtgctaaactttgacattaaaaggaacaaacatttctttcgtgagaaaacattgcattacaaagaatgtcgtgtatatctaaaaaccaatatactaaattaaaaatta

SEQ ID NO: 8702 - DNA, 1022 bp, Homo sapiens
ggaaaaatactaatgatttttctagctgttaagtgataatttaagaaatggtgtgctccagagcaccatgagattacgtgagatcacctgatgaaccagagtgtcattttctatgtgctcatttatgcacaagtacccggtcttatggttaaataatgtgtttattttatttttatttatttatttttttaaatttttttgagagatagggtccaggctggagtgcagtggtataaagacagctcactgcaatcttgactttgtgagctcatgcaatcctcctgcctcggcttcccaagtagctgggactgaaggtgtgcatgatgttgcttgtatagatggggccttgctatgtgcccaggctggtctcgtactcctgggctcaagcagtcctcctgccatggactcccaagatgctgggattacaggtatgagccactgcacctggctgaataatgcatttaatagttcataaagtaaaaaatgatttatctacatggtggtgaggagcttggactgtcactcagactgcataggtttgtataagccccacctttcactaactgagagatcatgaaaagttacttttgcacttagttttctcctgtctaaaatgggataatgtatctacctcaaagggttttgttaggattaagtgagataatgaatgtaaaacatttagcacagaatctgactctaggctggggagggtggctcatacctgtaatcccagtactttgggaggcctaggcgggtggatcacttgaggtcaggagttcaagagcagcctggccaatgtggtaaaaacccgtctctactaaaaatacaaaaaaatttagccagccatggtggcaggtgcctgtaatcccagctacttgggaggttgaggcaggagaattgcttgaacccggcaggcagaggttgcagtgagctgagattgtgtcactgcactccagcctgggtgacagagagagactccatctcacacacacacacacaaaaacgaataaagaagctgactc

SEQ ID NO: 8703 - DNA, 1045 bp, Homo sapiens
atcagataactttatctgcccctcagccagttagtgtggggattgcacatgttgtctggcctcagcctgccactaccaagaaaaataaacagtgccagaacaggttggtattggtgctttagctttcctctgcattttgagaatcttttaaatgaattttgcatgtactctaaagggtcactctgttgtattcaaaatgacctcttttatagctttgttacaaacactaagccagctcccttctcaatttctcagaggtattttggtaaaactaatggaatgggagccaggaagagaggaaataaatgctttcagttggtaagattgtctttattgcccttttgatttattatctacctgtaatgtagcaattgtggacattcagatagcacatttaccaaaaagcaactatttaaatgtatgtaaatgcagtctacatggatatttctagagctattttatatttcacaaaaactcaagatctgttagtgtgttatattcatgaactcgaacaagtgaaggttctcattttctggtttaacaagataccttagacaattgattatacatattttgattatagaaattataaattattcctttggttgcaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagagtaagtgccaaacgctgcatcctcaaaggatatagatggcatcctttggtgtgccgaaaaacaactttctgtgacttatttcttgtttgtcaatgtactctggagtaaaacctttaaattagataacccagttctag

SEQ ID NO: 8704 - DNA, 1062 bp, Homo sapiens
catgcttggcttgtagacttccagcaatccccaggaaatagatttctgtaattccttggacaattttgagaaatctgttgtaagtattctaggtgggggtggatttttctgctaagtgtgcttcaaaacttaagctgtgcagtaagcagttgtcctggaaataataatgattactgcctgcacttggaaagggcaggcttttgtgtttctgacgaaattctgagctcttgatacactgccttatcaaggaatatatttctcacttcagataatgtgttcctgtagttttgcattttttagcaaggactaatgacttcttctttctcagagtaccccctcccccaaattagattaaaattcctaattgtaaaggggctgacattgttttagataagagagttttaggttaaaaatatttctcgtcttcagcagcttaattcagagcccattttccttcgattcacttaaagagtcactgacaggtggtgcttgtgcttgcgagttactgtcagataatgttctattgcgattatagtggttacaaagttcaggaatctttggatgtgtgcctcagacttgagaaaaacctctgacgaattttagcccccgatttttatgcctgtagcagtttttagtgatgtgtatttggcataattgttaaaagataaggcctgagaaagacccacgtaaataccttggtattcattggctcagaaacatacatcctgtttttgattaaaggatatcaagtccttggtcgtttttgtgaactgcttatgagatgtttgctttgggatgatgttcatttgttcagccatctgtaatatgtgaaactggctttcatgtgttgttcttgttcagcctgatgttgggtgatttcctcggatcagttttgaatttctgatttcccttctgacctttgtaccttgagccttctgaacctccctgactttccttggctcctctttcagaccgccagagcctgatttagaggacttctcatccacattgtttgggtttagccctggtgtcctctttctttttcctttcagtgtggtggtc

SEQ ID NO: 8705 - DNA, 1033 bp, Homo sapiens
atatatgtctgggtttatttctagtctgttctattgtacttctctccatatgccagtacaacactgtcttgatttctctagttcagggtttcttaacgtcagcactattaacattttgggttcaacggttctttgttgtggttgcctgtcctgtgcattagaagtttagcaatatttctgactgcctggtagatgtcagtaactcccctcactcttagttgtgacaaccaaaaatgtttccagacattgctaaatgtccccctagggagtaaaattgaccgtgattgagtttcactgctttagttctgtagtaagtcttgaagtcagatagtgtgagtattctttattcttttaaaaaatctttttggctattctaggtcttatgctttctatacagattttagtatcttcttgttaatttctatttaaaaagcctgctggatttttggttggaatttctttgaatctagaccatttagagatctctatcttaacagtgtttttttttttaatccgtgaacatatctctctccatttacttaggtattctttcttttctctcatcaatgttttatagttttccacatacaaatttgtacatacatttttcatgtttttcagtgctttggcatatagtaatagaaaaatttctttgttagtgtatggaaatataattttaaaaaccttatatcatatgaccctcctaaactcattttagttctagtagctttttatagaatctttgagatttttctaaataggaaataatgttatctgtgaataaagacacttttcattctttcaaatctgtaaggcttttatttatttttcttgccttattgcactggctagaacttctagtactttgctgaatagaaatagggagagtggacatccttgccttgatcctggcattggagggaaatatcagtctttctctagagtatgatgttggctatagttttgattttgtttcacagaggccctttatcaggctgaggaaattcccttctctagcaaatttgctgtgaat

SEQ ID NO: 8706 - DNA, 1059 bp, Homo sapiens
cacacctgtagtcccagctacttgggaggctgaggcaggagaattgtttgaacctgggaggcagaggttgcagtgagccgaggttgcgccattgcactccagccttggtgacaaagtgagactctgtgtccaaaaaaaaaaaaaaattccaaaaatgaattaatgtttgttttaagctctcctctgttttctaaattttatcataatttgtttaaaagtgaaaacgttttaggttgggcgcggtagctcacgcctgcaatcccagcattttgggagaccaaggtgggtggatcacaaggtcaggggttcgacaccagcctggccaatatggtgaaaccccgtctctactaaaaaaaatacaaaaattagccggacgtggtggcaggcgcctgtagtcccagctacttaggaggctgaggcaggagaatcgtttgaacctgggaggcagaggttgcagtgagctggggttgtgccattgcactccagccttggtgatgaggtgagactctgtgtcaaaaaaaaaaaaaaaattcaaaaatgaattaatgtttaagctctcctctgttttctaaattttatcataatttgtttaaaagtgaaaacattttaggctgggcgcggtggctcacgcctgtaatcccagcattttgggagaccaaggtgggcggatcacaaggtcaggagttcgacaccagcctggccaatatggtgaaaccccgtctctactaaaaaaactacaaaaattagccggacgtggtggcgggcgcctgtagtcccagctactcgggaggctgaggcaggagaatctcttgaacttgggaggcggaggttgcggtgagccaagatcgcgccactgcactccagcctgggcgacagagcgagactccatctcacacacacacacacacacacacacacacacacacacacacacacaaaagtgaaaacatttttttctatttaaaaaatttattacaaggtaatcttttaataataataaaggaaatttttgaaaggaaaaatcatatagttttttttgtttatttgttttttttaaat

SEQ ID NO: 8707 - DNA, 1050 bp, Homo sapiens
ctaggaaatcgacttttaattcctcaccagtaagttgcttatctcaagccatctttaagagagatgtttaataatatgttcaatgtttattattaattaatagaaaaataatttctagaacagtcttgttagcttctgacctttcacgtacagcacatctttaagagtcattggtacctacaaatgtgtagaaatcaacccatcacatatttacaaaacatgcatgatgtgttaagtaagaccaatgctaggtaaggtttccaaagtgataccagtagtgctttgaaggtatataagtaaggacagggttgcatgaaaatagctaattgaatatgaaagcttaagtatccaggcacaaaataagtggtacagaaactaaatgaactgggctatcaaatttagcatccactttaccctgggttacaatgggaatggactgctggtgtccctaatggtaagaacttgtctgaaataacaacttctactgagtgtctgtgacttgggacctcatggtctaggataatgctaggggtcttgtgggaacttctgagtcattgatttttaccagagcaggtcttagagaatcatgtaccagcaacagaatcttttaaagcaaagttggcattttgcttctgaaatatattcttacccacagcacatagtagaaattgtggattaaaattatcttaaaactgttcttacttgaattacctaaaactgtagaatgtctttgctgaaaaactctgtttcatccaaattatagtaatagtaatagtttccacttattctgccagcatttcccatgatccagacactgtgcagggtgcctgagatgcttatatggcatttaatcttcacagacctcttatgaggtaagaactgtcattattcacattttgcaaatggggaagccgaggcttagagaggtgatataacttgcccaggaccacatagcataatgttggatctgtccttctgaacccaaggcctgtgctcctgtccactgctaagctgaatgctctccatgactgtatctgcctttcctctgcc

SEQ ID NO: 8708 - DNA, 1049 bp, Homo sapiens
agtacctggaggtgatagtattttggctgtatcatctttcacctggtcacctgggcagagctgtggggctataatgatgattacccttagattgaaagtttgttatgtgctagaatctgggtaccaactgcttgtcaccattaatcttaataatatttttgaaaagcaggtaggtgatagttcccttattttaggatacatctcagagagattcatttgcccaagagcacttggatggagtggaaatctgactgcaagctcaggttctgacagctgtgctgatcttttctcctttgcccttggtgggtgctcccctgagggcctccagatctggcccctccattatcatttatatctgtgcttgatagaaaattaggaatcagtgttttcctaccccctattatctgtttaagcatagactagcattttatgtaggctctttggggctattaattggtttctgtggtcaaatgtgttttggggaaacttagggataaatattaaattcagtagctctccacctttacccaggcaactaaatgggcggtagaaaaccacacgaccaggctcattagtctcatcagtttataccatgaacctcaagtgggcctttggtgctgcccagcaatgccactctatttccctagcacagtcatctgcccattctctagggtgactgcttcataccttctcttcctcacaaaatctccccatctcccaagaaaaaacaggtagaagaggatttccacaagcccttaccactgccttaacctggctgcctgaatcctgccttctctccctttgaggatgaaccatctctgatccctttgtgggagacaatatcccctctcaggctgtcggggtcctcctgccagcagttccccctgctcagtatgctcctctcccatcatagatatgcatgctgatttgtcttccatttctccatgttaggaaagccctcccttggccatgcatcccccttcgctgctatactccctccgtccctatttctccttcctctttttcagcaaacccccttgaaataattt

SEQ ID NO: 8709 - DNA, 1041 bp, Homo sapiens
cctgcacttctcagcccttgggtggtcgatgggactgggcgccgtggagcagggggcggtgctcatcggggaggctcgggctgcacaggaacccagggaggccggggaaggctcagccatggtgggctgcagtcccaaggactgccccacgggaaggcagctaaggcccgacgagaaatcgagctcagcgctggtgggctggcactgctgggggacccagtacgccctccgtagccactggcccgggtgctaagtccctcattgcccggggccggcatggcaggccggctgctccgagtgcggggcctgccaagcccacgcccacccggaactccagctggcccacaagctctgcacgcagtcccggttcccgctcgcacctctccctccacacctccccgcaagctgagggagtgggctctggccttggccagcccagaaaggggctcccacagtgcagcggtgggctgaagtgctcctcaagtgccgccaaagtaggagcccaggcagaggaggcgccgagagcaaacgagggctgtgaggactgccagcacactgtcacctctcagcactagggaaatctcactttacttgaccctgactcatggtgacttacaattaggatttggttttggtaaattttatttgaatatgtgtttgagaatgcagtaccaaatgggtttcttaaatggatatgggtttttttttcttgtaaatttgtttaagttctttgtagattctggatattaattttgtgtgttctttctgggcatgatgataattttgtcctctgtaaagctgctgagattctgaagggaaataaacatatcttttcctcctatttccatgatctaaactgaagacaaaaatatgggcattcttcaagacaattctaagcaaaaagaacaaagctggaggcatcatgctacctgacttcaaactatactacaagtctacagtaaccaaaacagcatggtactggtaccaaaagagacatatagaccaatgaagcagaacagagacctcagaaataacaccaca

SEQ ID NO: 8710 - DNA, 1032 bp, Homo sapiens
ttctagaatctttctgggtcacctttctgggctcaaaaagcaagagttgtcggggtgataggcatctgatcatatcatgaatataattgaatatagctatgggaattaagttttaaccattcctaacaaatcagattaaaatagctaagaaatatcaatacctaatcattgtcaagcatctgcagtttctgctttgagtaatgtttaactgtgaaaatcattttttaattatgcctgagctctgtgaacataaaccccaaagtaaaacacatgattagttcattcaatatccagttgcacccttccaggtgaatagtgccaggcaaagtattggagggaatacaaataagaataagcatattatttcccccttcactcccccaggtttttaattcctctgttgccaaagtgtttatatgctatttggggaaacaagtaatactgagcaaaaagttaaatcacagttaagggcaagcatgcgatccctttcagcagacaactaaaatacctgacccatctgtaaacagctgttacacaagctctctgcctggaaccaagaagtaagcggaggagactctgagctgatgaatttcaagaggtcccagcattaaaaccagaatttactgataaccctttacatccttatttataccctattcctactttacaaacatttctaactccagttctagcaccccgaaattagcaaatcagaggcaacaaatgagaggggaaaagaagcatccatagacacaggcaagcaccttttgaaaacaaggtaagtagtaagtaaatataggcagacaccctgacagtaatagagcttgacattaatagctaggcaacagatgtgacagaaagctataaaattctgtgcctggggtaggtctaaatagtcccactgagctcagtgaccctgagggcttcattgcattaaggggcattatagtaattgatgcatttttttctgagtctgatagcctgtgtttataacagtgaccctgaggccttcagggaagattaaattatgct

SEQ ID NO: 8711 - DNA, 1050 bp, Homo sapiens
acccaggtgtgtttttcagtagtgattgtgctgagcaagtggcagatgtcattctgctgctgtggtcaggttgagggctcgaggtgacccctgggctgatagcttgtgtcccccctgggaagctctgtgtagagttagggaaagcatagaatgaacagtgttaaacttcagagcacaagacttagaatctgagaaacaatggtgtttgaaagtgccagctgggatggtagccgtggcaagatggggagtttcaagcttttaaataacatgtttattacttacactgctttttataatcctaaatctcccagttttgattgccattgccagctgctatgagatgggctttgttgatggattgtatttataaatttggatgtttgtatgttagtggagactttatttcaactctacagcagcttgaattgataatcgtgtggaagaattctgggctttacccatttagcccagacactgctgttttaaccttgttggatggttgtcacactgtatttattttgatctgtactctgagatcacccttcagaggtctgcttcctccatcttcaggtgtgcattttggggaggggagttctgggcaggtctttctgaagggcagttcgtgtcgctactttggaaatgattgcacatgtggatccattacttgccctatctgccatctaatgtcacactgcctttggccacttcgttgtgcattgtctcacttaagtcctgccttatgatgctcagcccaggagggttgtttggtgccacggtgtcctattagcaggataacatattacattttgtcactataaaaggagtgaggagttgaaaagccagtttcctggaggatatggaaaactaattctgattcatggcctccgtctgaaccatccatcagtcctgtcccttgtttggcttgtagaaatagccttcatcgggccgggcgcggtggctcatgcctgtaatcccagcactttgggaggccgaggcgggcggatcacgaggtcaggagatcgagaccatcccggctaaaacggtgaaacc

SEQ ID NO: 8712 - DNA, 1030 bp, Homo sapiens
ctgaatactatgaatataatgtgtcatcttgtttattcatcaggtgatgaacatgtgaattttttccactttttggcttttgtgaataatgctgtgatgaatgttcatgtacaaattcttgtgtggacatacgtttttggttctcttaggtatatacctaggaatggaattgctggatcatatgataactatgttgaatcatttgaggaactaccaaactgttttgcaaagaggctgcaccattttagaatcttgccggcaatgtatgaggattctgatttctccacatccttgtcaacacttgttattgtgtcttttttatttcaaccatcttagtagatgtgaagtgtagctcattttggttttgatttgtatttccctaatggctaatgatgtggaacatcttttcatatgcgtaatgactgtttttatgtcttctttggagaaatgtctgttcaaatcctttggccattacaaaaattggattatttgtcttttcattgcttaactgtaagagctctttatatattctagatacaagcgtcttatcagacatttggtttgcaaatattttcttccattctgtgggttttactttcttgatagtgcacttgaaggcaaaatgttttaaattttatgaagttcaatttatctatttttttttcttttgttgcttgtacttttggtgtcatatctaaggaactgttgcctaatctaaggtcatgagaatttactcctatgttttcttcaaagagttttgtagttttagctcttacatttaggttcatgatgcattttaaattgatttttgtatatggtgtgaggtagggtccaattttgttgttttacatgtgggtatcaattgtcccagcaccattcattgaaaagacccttcttttctcattgaattgtcttggtgttcttgttgaaaatcaattgaccgtaaatgtaagggtttacttttggactctcagttctattacattgatctcatatgtccatctttatgccactgccacactgtagtata

SEQ ID NO: 8713 - DNA, 1034 bp, Homo sapiens
gtctcccaggctggagtgcagtggtgcaatctcggctgactgcagcctctgcctactgggttcaagcgattctcctgtctcagccttctgagtagctgggattacaggcacatgccaccatgcccggctaatttttgtatttttttttagtagagatggggtttcgctatgttggccaggctggtcttgaactcccaacctcaggtgatctgcctacgttggcctcccaaagtgctgggattacaggtgtgagccaccgtgcccggcctctgaattccttttctaattaggttctgtcgctctgcccgtgaccagactggttttcagctctgttggctcctggtcctttcaactttcaaattccctgaaagtttgactcaggctttctctatctgagcagttgagccctccttcaatgtaacattccaatgctctattttatattttcagaatcacaaaagtaacctgagactatttagcccaggaaaagatacacataccagtgattaagaacctggagtcaaatcacctgggttcaaatcctgagtctatcctttattagctgtgtgacctcgggttggtcccttgatcattctgggcctcggtttcctcatctgtgaaagggcgtcatcactggatacatctcccagggttgtggtaaggagtaaatgagatgacgtgcccttagcaccctgcctggcacacagcaagcaatcagaaatgatgacggttactcttgtctgttccttgctgtttccctgaccccctttcattccttccctcaactcctgcttagcctccccctcccatggcctccatgaaacacaccctggtcttatttggcctgtctccctccccttttctcctgtgttgattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccat

SEQ ID NO: 8714 - DNA, 1084 bp, Homo sapiens
agtctcattctgttgcccaggctgtagtgcagtggcaagatctcagctcactgcaacctctgcctcccgggttcaagcaattcccctgcctcagcctcccgagtagctgggattacagacatgtgccaccatgcctggctaatttttgtatttttttggtagagatggagtttcaccatgtcggccaggctggtctcaaactcctgacctcaagtgatctgcccaccttggcctcccaaagtgctggcattacaggcatgagccaccatgcctggccactttcataattttagcataaaaatataattttactaagggctggttagatcatttccaaagctgtaagagaaacctcctctctgttgaagtccagctgaccatgggagtctctgatcatttgaaaagattttcaaaacatcaaagtcaagagaaaacccgttatgaatcttatgtttctggcttccccatcttgccacatcatttttctcattcctgctagataaagactgccttccctctcagaatgggtctgttagatgatccaagaagtttctcaagtgaaaaccaggagaaaccggtggtttgatggttaagatatctcaatttttatgaattattttagcactgaactctgagggttcagtcacttccagacagtcagatgggtgttctgcgtccttttcctccagtgtagggtcttggtgaggctattttgttgatatatgactgagattgttgggccaggatggagaatcaaccgtttacagctgtttgcaaagggcacttcagtgtagtgattggccgtgattcgtgccatgttcggcagttgattaatcctcaacccgagaatattcttcccagctccatgtcctcagaatggggacttttgcattcagtagcctcaaactgcagcctcgcaggtgacactttcttgctttcaaaaacacttttgttactgtcatgtgagtggacatgcatgcacaaacacacgggcacaaatctcactctatttttgaacggaagttttgacttgatgactccctgtaaatgtgtctataaacagaagcaaagagtaaagcagagt

SEQ ID NO: 8715 - DNA, 1024 bp, Homo sapiens
agttctcactccagagggcttctttggggaaatgtttgaaaccagatgcttctacagctgaaaagtacatgtaaatctataaaaaggggtatcaggcgaggtccagctgcagaaaactgaaaacatcagctgtttaaaacagacccaaaaaatgactattaggaattaggcgctcacaaaatcatcggcgggttgaaggaatgttcctggaaagattcctagaacaagaccacagggctggccctgaggaggggctgctgcctcttcctcaagcaggaagatggagaagcggcctgccctggaacaccgaggttaagaaaacacagtcatagcatgatccaggaatgagagagccccacagaaccagagttaaggactgtggtgctcagcaacccagcttccagcagcctaggcagcagaaagatgggcctgccccatttcctctgtccggagtgcacacaagtgcatctaactgacaggaccgaagtctcatccacagccacaacctcctggaacgccaggagatagaaattagccatttagcctcaacagtacaggaatgcacactacaaggaggttgcctgtccattacctccacggcaggcaccaggcaaaagcgagaggagagaaaaattaccaggcagggcaatactcaggaagcagttggggcaactagtggataaaagtatatcccaaaggcgaaaatgagcccgtttctcagagctcagtccacaacagcctgctgaggaaggcctgggcgcgttgtctgatgtcaagcctataggctgacagtgcacccagcttcctttgttacaggtgagcagtggttactggaaggagatgaaggaattgaaacggttgttttgatgagttgcacttgcagaacaatgaaatattatctggaaagtccctgactgctcacaaagcttatggcaagtctggggcctcctcagtaaatttgtaatcctattattaatagaaatctcttctgcccacccacttcccacacctgccccagcacctt

SEQ ID NO: 8716 - DNA, 1028 bp, Homo sapiens
tcctgtaccatcatggtcttcttcccacctggtgaagtgagaacttcctgaaatgtggtttccagaagcaactttctaaatatgtctctccttcctcagtaacaggcagcacttgcagtgggcagaggaggcattaaatggagagaagtggcactgttttgtgtggcccaaaagactccgattggtggaaaataaaaatggacatggagccagataaatttcatcatggccagatggcccaggaatttatcttgctgaaacccccactcggtctctgggcccttgccacgaagttgcataatttgttcagaatctgttcgtgcaggatggagctgcgattgacactgagctgaaaatctgggctttggggcagggtttggagagaggcttcaaattcctatgctccagaaatgaagtaacaaggtgaggtaaagtgatgttacacccacttgtgtgtcctggaaagtgtgggcttgtaaaacccctgttcacttcggggcgcctaactcaagaaattctagaataagtggcctcaagagccctttatccctcttcgttaagcccattctagataaaactgtttcattcattttagacaaaactgtttcattcattttagacaaatggaaatgtcttttactgttgaagacttttgagtaggaattctccagacttttaacactcatttattcagtgagtatttattaatgttctaccacatgccattctgggatacggcagaaaatatgacaatatccctgccctcatggggcttatccagtagtcaccacttatccatggtttcagctacttacggtcaactatgatctgaaaatattaaatgggaaattccaaagataatttatacgttttaaattgtgtgccattctgagtagtgtaatgaagtctgacgccatcccactccatcccacccaggacatgaatcttgcctttgtccagcttatcctggtcaacaaggataatgtctatgctacccagctgtcagtcacttagtcacacagtggtta

SEQ ID NO: 8717 - DNA, 1023 bp, Homo sapiens
gcacatctcaggaacctgccttctcaggagggatcaccggaacatccagcagggaggagagggggctgctttcctaccacacatcccccatctagagtttctgagtcatcaccccatccaattggtgatgtcccactcgattcatatgttcaaatcctaacccccaaggtgatggtattaggacatgggacctttgggaggtgattaggtcatgagggcgaaccccctaatgaatgggattagtgcccttagaaaagaggcgtgagagagacccctgacctttcctgccatgtgagaggatagtgaaaagaaagacagctgtctctgaaccagaaagtgggccctcaccagatagatacagaatctgccggcactttgatctcggactttgcagcctctagaactgtgagaaagaaatttctgttgtttataagctccccagcttatggtatttcagcatagcagccagaacagactaggacttcctgctccatcctcccttaggagccagatgagcattgctgttaagcatgggaacaggctgtatttctcagaagtgtgacattgaaaacgggtagatcaaacgggacatgcagactctgtagcctgatattcagcagcttatgaatccagtcctgtctgtcttgcctgagctcctcccacactaaacacaccctctctggtcagcctgaggtcactgatgcttcctggggacactcttctttttgtactgttatgggatctttggggtatcagttttcttcctggaaacctctgtggccggtggtgcttttgcccgagttcttgtcctgggtccaggaagaataaggtatgcagacacatgaaaggtgaagaaggtgaaaaggaggtttatttagtgttagaacagctcagaggagacccacagtgggtagcttctctctgtaggcaggtcatcccatggagtgttcagctttcagcaaagaggtggccctggggagggtggctcctctctgcccactgctcattccactgtctgctgct

SEQ ID NO: 8718 - DNA, 1029 bp, Homo sapiens
tagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaa

SEQ ID NO: 8719 - DNA, 1025 bp, Homo sapiens
tatggattttaaaatcaaatatcctggcaaaaatgactatggatatgtagtattgcttaaattaaaacagagaattgaaataattttattgtactttaaaaaacaaagttgtttatttcctaataatttgagccattaaagaaaaagctaagcatctgctcattgagaatgcatgctcttaatgttgatgaaatatgatcgtgttatgtaatgcaactaaaaggcttggtgggtttttaaattcaggcttataaagagtacatgaatgtttagcaaagagaagaaatacagctgtgataatcaagtgtaaaatccatttgcaaatcttacaggtaatattgaattgaatgattaactgcctagttttctttatcagttcattggtgctgaactgggccctaggctatgcaagatatttcaaaaccaagtcttaattttaactgaagagagacctcatttgatattattagatgtaatcagttgtgatatagaataaaggatgttttaatagatgacatttaaaattgttatattctttgtgaatataataggtttagactctagtgactttggtaggtgaaagattaactaatgatcacttgcgtaaaatgcaaaaatagcctgacagctttttaaccactaagtgaccaaaactgatagccagaagtgtagtgtttttaatactttttcctgaaggctttctgcacttcatctttgcagttagtagtattctttaaaaagaatgctgttgttgtgagggtaacatttctttctagaacgttgcagtgtgtctgtgcttagaattttcattgcagctgttgtgcagaacttatgtgttcagtgttttaaaataaaaacattcttaactattttataagtaaaatctttccttgaggctattacctgaagccttctttgacatttaagatctcttgatgtgtttgcttttccatgggttgcaagaactattcttctgcaatgcagagggcaagattattttgcattcaccttgtcatagaaaaaag

SEQ ID NO: 8720 - DNA, 1080 bp, Homo sapiens
aaacttaagcatgcatcagaatcacccagaagactcaataccaactacaaattgctgggttcccccagccaccactgagtttctgattcagtaggtctggggtagtgcctgagaatttgtgtttctaacaaggtgccagttgatgctgatgttgctggtttggggcctacagttttaaaaatcactgacgtaaaccaacatagggtctctgctctgcagagatctgattatatataatagtgaaacaaagtccttcccagctcagattccatggtgataaagttctttgtatacctcaatagctgagagatcaggaaatcctatattttactgataagggaaaaactagtgccttttaattaagtttttattgtcatcctgcagttttcttaataagttttggtatttcctcttatgagtgctgtttcttagaaactttgatcagacttaggatcctgctttcctgaagcttaggcaaggacaggggataggatatttataatagtagtgtagaaaatgttaacagccatggaagaacatgtgtaatgctatgatgaaactttctttttttattgtggttagaaaaatgttatatggatgacctgtagtttcttttgatctcactcttggtcaggctggagtgtgatagcgtgatcacacgttgaggctactcactgcagcctcaccctccccagactcagtgatcctcctacctgcacctcctgggactgcaggtgcgcgccaccaggcccggctactttttgtattttttgcagagacagggttttgccatgttgcctgggctggtcttgaactcctactcttgagctcagatggtttcctcaccttggcctgtcaaagtgctaaagtgctaggattacaggtgtgagccactgtgctcggccaagacctgtagtttctgtacctttttaatttatttttatttatttatttatttattttttttgagacagattctcactctgtcacccaggctggagtgcagtggcacgatcttggctctctgcaacctctgccacctgggttcaagcagttctcctgcctcagcttcccgagtag

SEQ ID NO: 8721 - DNA, 1072 bp, Homo sapiens
ccacaaatgattcacctgcctgggcctcccagagtgctgggattacaggtgtgagccactgcgcccagctagttttcctatttaaaattaatattaattgaataaaatttagaaatgtatacatagcattcatctgctatttactgtttggtttatttcttttttgtttctttgtatgtttaatctgtaatgtggaaatcagaacaccagcaacaaacaactaaaactgggaatatgatagtcctaacttcacatggtcttgtatgtaacttaactgtgtttgaggtggacagattaacattagattgactttccacagcttttggtaatagatagggactgtttgttttatggctgaagttttgtgaaacaattattgcatttcatacattctgctcatggttattgccttagtttttctttagtttgtcttagacatctgctaatttgaggatgttaatttttttctgtatttaaaatatgctgatacttggtctagttttctttgtgagctccttattctcaaacatgcaactgtgaactgatttttttaaaaagggacatttacgtttcactccttcagtataggaatttacgtttttagccttctgtgaaatcagggaatagattcttatctttgccatttataaggttgcattaggaaggtagatttttgaacataaaatgaaagtatctgtatttatgcatttttagctattggttgaaaagaaatcagattggattataagctttaatcaccaaaatggtatgagctttaattggcaaaatttagaagagtatatttgctttaaggaaatgggtgccagtccttgtctgtcctttcttcatttaagaaataattttcttggtttgttaacatttactctggtctgtatttctttgtacaatatgtgtttacccttttgcttttagttctgcaagttctatatgtataagcttgttaacttaaaaaagtagttttaggtcaagcttcatcagattttcatgagcattgttgaagagtaacaaaggtgttattaaacctttaagcttatagcttgttttggggtta

SEQ ID NO: 8722 - DNA, 1030 bp, Homo sapiens
caaaatgttaagacagattatcaagagtaattcctaccagtattcattatatttgtcttagtagtcatttgtcttactagtcttgatcactattataaactgatagatagttcttttgcagtagtattgatgggcaggagtatgggtgagggccagctgttacaaggattttcaaataggtttctgtctgacatgcccagatttgctatttactatgccagtgcattggaggaatagtatgagttgcttttgttttgttttaatcatggggagattatagctccataatcttgaactataaattcctccaaggcaaggggtcttttccagttaattttatcatgtagcacaacactaattatatagctagacacttaactgtgaatacttttatgataactcttatgttgatgagtaaaattctgaatacaaggaaacattggagcataagttttgttagaatcagagtgcctgaatttaaatcttcgcttcaacacttactagctctgtaactttgggcaagttaatgaaactcttgtacctcaggttccccgtttagaaaatatgtcaagtgtgtatacagtgcctgacacgtggtaagcacttagtaactggtagctagtaggttgaaactagaagtgaagattgtacattggtggagttaatagttggagattaatataaggcaatctttttccccctcttaccactttactaagtaaagtaagatttttaatctgtatgctgcttcatactactacttatgagacgggagagggcttttaatatagtagctctttatttgcattatacattatctgaaatagctactgttgaacctaaagtaattctggaataaatggtaaagaaaactttctaaaatataaaacactgttaattaactttataaataagtttgtaagtaaattcagattatgtgatggcaaactatttacttatttggaatttaagttgaattcttttttttttttttgagacagtctctgtttgtcactcaggctggagtgca

SEQ ID NO: 8723 - DNA, 1062 bp, Homo sapiens
tggtttatgtagtgtgggggacccatcatggtggtagtgagtggagcttttttgctctcctattccttctaatccttttttttctaccttaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggtatgttcattttagtcagactctgtaacagaaagtttaagtgtttatattatttgactttattctatcctaacttaacctgtaggattcaatgctggattttgaaaatcagacacttgatcctgccattgtatctgcacagcctatgaatccaacacaaaacatggacatgccccagctggtttgccctccaggttagtagtggtacatttttatgtgagagagaaatataaggccagtactttcaggttttaaaaagattgtgaaaataaattttgtttattttaatgactgtttaattttgactcttaggtcttttaatttgatagaaagaatgttattgttcctatgatttgaattaaaaatgtagtttataactgtttatttttaaacttttcattggcatgtagatatagaaaaatatacgcaagtttaatgagtttttataaactgaaaacacctgcagctagattaagaaatgaaacattaccagtaccccagaaacctacgttgtttcctttcaatcactagttaccctcacccctagcgatagcaaccacttccgtacttgtaactgtaatagaccagttttgtctgtttttgtaactttaacaagtgaaattttgcttggcttttaaaatttcaaaattaatctaggagtaaaaataatagaggtgcctttttttgaatgcttttagctttctaggagaatttctggattttattaccttaaaaaaatacacagcaatgaagtgggtaagggaatatgtaagaggcaaagggaagagagaaaccacaagacagtttcagactc

SEQ ID NO: 8724 - DNA, 2436 bp, Homo sapiens
gaagtaattaaatggtacaaaatggtaatgtactaagagtaaatcttttgagttattttgggtctcttgtgctaaaaagtagatgcctttcagaagacgttaatatagcctttcaaataatttgtttggaaggatcaatcatgcaccctgctttcaaaggtttggaattgtggttggagaattttacccccaatagctgagtctaagggtaggagaaaggtaagagactttattcatgtgtagtttttcttatcattgtatgcaaatttaaggattaaactttaaggagactgtataagacacttcttaaactagaaagtgcgtgggagaacaaacggtaatgagctgtttatgtatatatctttttcttttttaaattatagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggtaaaaaaataaaaaaggaggttctaatgaccttttactagttcaaattattttttgatttgtaaaatatatcacacagtttttgggaaggatgtatctgcattagcctcctatgtgcaatttaaacaatgtatattttggtacaatttgtgtatttggtataatttgttatttaaataacagatcatggaatttttgttcatttggttatgtcaaattaatgtctaccactatctcctggaggataagtattttccacattaccaaaacttacggggattgtttattatatttgtacagatgtgtgtttacatgcatagatgggttaaaagtttatcttctgaggggcagttagtacttacagaaatttataaacagattggatcaagataggaaattggagattaatttgattaactagcctggcttataatttctagttcttcccgtcttcattaataaaaaagtaaaaattccttgtgaagataagaaaattatttcttttcttgtcctaaattttaggaggatatgatggttaccgcccttcattctctaacactccaaacagtggttatacacagtctcagttcagtgctccccgggattactctggctatcaacgggtaggtaaagtagttctaaagtgtaaacctgaactaaatataccaatgaaagtgacttagtgttgttgcttaatgaacctaagtaactaatttggcgttaactttgtggtgtccaagacactctgttgaaacaaaagcttttagcactcaacatcagtactcctttagtaaagcctgttaaagacagtgatttccaagagcagagaaatatatttcactgaatgttctttgagaatagtagaagtacaacaattacagaacaaggtgtagctgtgataaactgatactgaagtgtctaaaagattaaggaagaattctgtattgagtgttagactgaaagaatagatgggtaagcattttttaaaaagtaccttttcaatactaactagcttgtcttttaggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggc

SEQ ID NO: 8725 - DNA, 1006 bp, Homo sapiens
gacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagct

SEQ ID NO: 8726 - DNA, 1096 bp, Homo sapiens
agcaatctgatagcctcatctaatacacttctcagcttctgctactaatatcctacttttaacaagctgttctgaagcttaatccagttacataagcagtacggctgttttgagtagaggcagtggaagatcagcagtttgttcctgatcatctagcaaaggcatttgtgtattaatgcttatttggaaataccaattttaagtactgtgtttaatagggagacacactgtattaagcaactaaactaaggctttattcagcaaattagggtatcctttgcccagcatcatgccaagcactaggcatttagtggtgacaaaaattactgtggtttctgctttcattgaactgtctaatcaaagactgatgacaccaaagtgtagcagatgccatgatggagcaatgtggttgatggcagatattaaagccatgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtgttgggccgggtgtggtggcttgtgcctgtaatcccagcactttgggaggccgaggcgggtggatcacgaggtcaggagtttgagaccagcctggccaatatggtgaaatcccgtctctattaaaaataaaaaagtagccaggcgttgtggcatgcgcctgtagtctcagctatttgagaggctgaggcagaagaatcgcttgaacccgggaagtgaaggttgcagtgagcagagatcgcgccactgcattccagcctgggcgacagagcgagacttcgtctcacaaaaaaaaaaaaaaaaaaaaaaaaaaaaaaaaaaaaaaaaaggctgtattgtttggggtggggttggtggctcacttaataa

SEQ ID NO: 8727 - DNA, 1149 bp, Homo sapiens
tcactgtgttggccaggctggtgtcgaactcctgacctcaagtgatctgctcactttggcctcccaaagtgctgggattacaggcgtgagccaccgtgcccgatcatagaacactagtcttttaagagggaacatatgaggagggtttggccatatatgtctgggaaacacctataccgttttttcctttatgaagatttgccccagcctgttgtaatctctgaaaagtcttgcagcagcagggacctgtttaactgattgtttcccaaatttattttaccaaaaaaatttatttttttgaggggtgtgggaacaccagttagcaccctgtgaaacaccttaggaaattttgacctaaatcagtggttctcatctggagccatttggccccctggggacatttggcaatgtctggaaatgttttgatcgtaatgactttgggagggtggtggtgggtgccgtgggcatccggtgggtagaggccagggatgctgctgaacaactggtggtgcacaggacagctccacaccaaagaattatctggtccaaaatgtcagtagtgctgaggtgtagaaatccgagccttgatgaaccctgggggcctttctcattttaaccatctgtgatgcactaagtcagtagaatgagcagatcaggaggagcagctgtgtgctactgaatacaacagaagcctatgaaatccttttcttgcagtgggaggatgtttgaattttatagtcaaacgcatttttttccctgcttgcaagaacgtttgtattgtatttctttggggagctttcctttcaccttcttccttttttttctttttcctagtgacaaaagatgaattcatttgtattttttccctgtgtgactggtgatcatatgggggttgggtttggaattccccatttaaggatggcctgaaacacctcagtgctaaagagcaagcctgggaggatgaggagagggccacgtggtgtagggaatagtggcagtcatgcacaacaggagggcttctaattgatctcctgggatgagtccttggttttctgatttgctgtataaagtatgttcaggtgccttgtggaggaggtgctgaatcatctcacactgctctccaactaggttttagctttttctggcttt

SEQ ID NO: 8728 - DNA, 1628 bp, Homo sapiens
ttgttacctccccaagccctgataacctccatactctgtttgaatttgtatttaaaggatttgatgctctgcaatatcaggtaggaaatttggattaagaatttttattttggacctggtgtggtggctcacgcctgtaatcccagcactttgggaggccgacgcgggcggatcacctgaggtcgggagttggagaccagcctgaccaacatagagaaaccccgtctctactaaaagtacaaaattagccgggtgtggtggcgcatgcctgtaatcccagctacttgggaggctgaggcaggagaatcgcttgaacccgggaggcggaggttgcagtgagctgagatcacgccactgcactccagcctgggctcgaaactccatctcaaaaaaaaaaaggatttttattttgatacagtgctgggtttaaatccaagtgaagtctttagaatacttgcttactttcataatatttagtttctgaaacttgtttctaaagtttgtcattggtttgactccccaccaggaacatctggattatgagattatccagtctctaaatcctgaatttaacaaagcagtgatcagagtgaatgtatttcgagaacacaggcagactattcaggtgaggcttgttctcagaccctgatgtgcagggccagtgtcttgctgtatttaactggctctaagatgtttcctgttatagacatgtatgtcttgtgtaattgcatgtcttttagacaatggtggtgttgtatgctaaacctgttccagattttcagactcttctaaagaaaaacattcagcaaactaacaaatatatgtagttagattgaaaagttgtgtttttgtcctttgaatatggaataagtggggtggaaagtacgctgattaactaaaagagaatctttcttctgacatcagctctaactttgcttagttattgcagtttttgaaatgttgcatctgtaactagaacaataaccttacagcttaaatgaaaaaaagaactttgcaaaatgtgctctgaatctttgtggtttagccagtggcctattttcttttttaaacagtgttttcccaaaagttctaaaaatctctagcactctgtaagcctgaatggtctgcacttgtccaaaggctgcagttttgctaaatctctaagagaggcatgaggtgatgggcttacagacggactgagactaatgggctcttactggaggaggttcattgattatttttggaattgggttgggaagtgagccaggtgaatttggcagtttataccctagcactttatgcctgtcaaagcatatgtatatgcatgtcaagaagttatacctttttatcagaggccagattataaacaatgttaagtgtttatgcctttcaccttaattttttcttactagcctctttctagaatctcttcattctgtacatttctgctcacttttgctcgattcccccagctgggaggaggaaaggctgctgttggtgagggtcaggctgcaggcaatgagaacacggagacctgttaaaactcaagaaaaatacacaaaccaaagaaggaaaacatttccctgaaataccctgcctcgggccttgctccttcttgaatttgtaat

SEQ ID NO: 8729 - DNA, 1055 bp, Homo sapiens
attcacctgttagacattttagttattttgaacttgtgctgttctgtacagagcctcatgagcatcctgtgtcttgatggccttcacacacgcacagcatacatagagactctcttctaatgtggcttttactttttgggtcaggaggctgtcagtcttctgccctgtaacatggggcctggtaattaagctcctgttaagaatggatgtgtcaggccaggcgccatggctcacgcctgtaatcccagcactttgggaggccgaggcgggcggatcacaaggtcagaagatcaagaccatcctggctaacacggtgaaaccccttctctactaaaaaaaaaaaaaaaaatacaaaaaataagccgggtgtggtggtaggcacctgtagtcccagctactcgggaggctgaggcaggaaaatggcatgaacccaggaggcagagcttgcagtgagccgagatagcaccactgcactccagcctgggcgacagagtgagactccatctcaaaagagcggggggaatggatgtgtcagtgtcagggttaaacctgaacatgggggtggaaacaactggcctagttcgagaaacaagctatattctgtgagtgggctctgtatcagagttggcctttctgcctgcactgtcctgcttcccccacaggtgtgccttgaaggggagatttctcgccagtccatcttgaacagtctgtctcgaggcaagaaggcttcaggggacctgattccatggacagtgtcagaacaggtgacgggctttccctggtgtgtctgagggaagctggtggtgtccaaagatgtctgtgttgctaagttactggtttgtgtctcccacacagttccaagatccagactttggtggtctgtctggtggaagggtcgttcgcattgctgttcacccagattatcaaggggtaatgtgtcctcaggctcccctgaagccgtgttgctggcggtgctttagggtgggggtacttggtggctggaataagaagctggtcaagcagaagcaagtgaagtgtaggcacttccctgctct

SEQ ID NO: 8730 - DNA, 1025 bp, Homo sapiens
ggactctggcctgggtgacagagccagaccctgtctcaagcaatgaaaaaaaaagttcaagctcagaggtttgtcacttcctaaggctgtcaggtgatagaacctggacttcatgctggatcacaggagcctgcctgtccctttgtaaatctgttgggcatttttttttttttttgagatggagtcttgctctgtctcccaggctggagtgtaatggcgtgatctcagctcactgcaacctctgcctcccaggttcaagcaattttcctgcctcagccacctgagtagctgggactacaagcacacaccaccgtgcctagctaatttttgtatttccagtagcgatggggttttgccatgttggctaggctggtctcaaactcctgacctcaggtgatccacccgcctcagtctcccaaagtgctgggattacaggcatgagccaccactcccggcctctgtcagtcgtttctaaactctttggctgtcttcctgcattctagaggtctgaagcagtgtgattctatgcatgttgaggtgttttgagaatgattgcttgactccggtgttctcatagtttgaaaaccacagcaataaaccaagaaacctctcccagtttttgttgtgctaagtccagagtgcgctgcggcagggtgcttgacgatgtctctctccctctgctgaatggactgtgttctctccttggcatcttcccaggctgtcagcttgttggaagaggtcatcactccccggaaggacctgcctcctttactcctcaaattgaatgagaggcctgccgaacgcctggattacctgggtgtttcctatggcttgacccccaggctcctcaagtaagtgcctgccctccttccacggcatcactccttggcattgagaaagaagagttctgtgggctgtgtgtctctgttggtagctggtatcggtgctagcctgctatttgtggcgtgctcttcctggctcttgcccttgtgtgtctatcagccactccccagaggccacacaca

SEQ ID NO: 8731 - DNA, 1033 bp, Homo sapiens
tgttacaggccacacctggggtagtctaccccctgtccaggaagctgactctactatattatccaaagcgtacatttcatatttggtgaaaatctgtccagccattttcttgtgatgcggcaatggacatgcaacataatttctttttaaagaatatgtcatttttactttctgacattaagatattctgttagaaaattatgacagtaacagatggtattaaaaaaaaatctccccttgcttggtaaatgcttttatctaagtgggcagctttgtgctaatatgatgtcttccacttcccaattagttgtgatgctttactgatctaggagagctttatggtttgggactactataggcgaacactctgttgcctcctctctcaagaatcagagtgtcctattttggaaacacagtcaaccatgtgaaagcaatttattgggcgtatcttctgtggtcagatttggtttgctgacaggtgaattgggagttttgtaaactttaataagtgagcattgagtcagatgtgttcatgagtatgacctcgatccacttaaaaattcttatttctttttctctcttggcaggagggaggtggttgtgcaggtattcccagccactttgaagggaacttaaatgggaactttattgctcactgcttagaatgccatgggctcttcttttgagatacttacctttaacccatttcctttttttttttttaagtgcagcttgctgccagtgctcttttcttgggggtaaatgggaaatgttaataagtagcctctgatccctttaaaatgggagaatttgaacatttcaaaccttacctttttatacagttctcttattacctgggagagaggttaagtcttagactatccatttctgtcagtgagttgcctatgcattatagcctgtgagggtctatatttttttagggtaatcctggtaataactgcattgatgttacactgctaacatttgggatggagaaggggtgactgagtgacttaacccttggtccacatgt

SEQ ID NO: 8732 - DNA, 1109 bp, Homo sapiens
tcctcaggtgattttagtgcattgccaaggttgaaaaccaaggctttaggtttaaactaaaggtgaaattgctctttttctggttcattttctactttagaaagtagaaattttttttctggttcattttctactttaaattaaaaataaacctacagagggtaacacgtattagcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctttgctccttctgctgcgaggtcatgttctcacagccagtgaagtgacagcatatatgtgttgaatgtgtggcttgcattttacatttaactcttttaattcatgtgttaaccttaggaggtacttattattctattttgcagatgaaaatggagactcataaataagtaacttaccagcagctacatagctggtaattggtagaactggaagttggacccaggctctagtgctggcactcatagtttctccctgctgccatgttggcctcttcctacttggatgaagatataactctagtggcaagggcatttactagtgtgtgagagggtcttgtttattagttttgcaaattgcacggtctcctttattcaatatcttttttcaaacagctcacagatcttttgtggttttgtaagtgcctactccccaccgtattgccttctagagaagaggcaggaatttattttaatgtacaggacagacatgcatggggagtaaaactacagactccactctaggtgtgtggaaatactaaaaatagtgcttttctctgtgtgtgaagttggtctgttgagttttgtcatagacagcgttgagttcctctcccaggtggaggtggcgtagctttgcgtcacttacgtgtctctcctgatttccagtgacccggggaagacactgcagaggcagttgtctgtggtcaaaagtattctctgaccatgga

SEQ ID NO: 8733 - DNA, 1082 bp, Homo sapiens
tttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggaaaaagaagaaaaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgagattacaggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctataatagtatggtgttcttccttcccctacacacacacttggtgtcttgatgaatgtcatacataggcacctcttgattatccactgtggataatctattacggcagtgagctggctaaaattccaaccccagattggtttgctcaaaccacttaatatgtttctgggccactcctgtttaggcagtgtgtgctcgggtaatgaaagcttctgctaatgtcagccaaagcatagttgagaaaataaatatgctaaaacgaaaaaaaagcctta

SEQ ID NO: 8734 - DNA, 1111 bp, Homo sapiens
gagtctcccctccaggtattggccactggataacctcttttagcaccctatgtagctgtctttctctgtgcttgattcattctgtatcaggttaaactattgtggaggaaagaggatgagtctacagtacctattagggattgttagacagaaaaatagagaaattagaggtgactgaatgagtcccccacagccattattatgcgtcatctggagcaatggtgaatcaagtgttaaaaagggaaagaaagaagggaagtgcaagtagagaatgaataacatggtctggggaggacttgtctaattccagagactagccctggcaaggacttccagggtatcctaatgtgatttagtaggcacagatgtcactcatacaaatgttggtattgagtggtccagtctagtgcttgtaaaatagtatcaaaagagtttaggcagtgggcaggacaccagagtctggaagagctgtgttgtgattctagaaggtctagcctttcatagcatcacttttgccactaatgacagatgtggggatcaggaagagggctaacaagtatttacttgagaacactagccaaatgagctggggagtttgggacaagcaaggcctcacttctttgagggagtctggggtgtaaggaaaggcaagaaaaattgctgtgggttgagccactatggaggttaggaggtatggtgcagtgaggttatccaaatgaacattactggtccttgatagacccaaccaagtctgtttgggcatattacttaattctgttcctcagtggggaatatgtctgagtttgttcatgtttgtgcttcccataatgactaacatcgtaattggaatagaactgcagtgctgtaagtggtcagttagtaaaggtaatggcagaggggaaagtaagccaaaagcagggtacatgacagggatccaagaaggctttgcagatgaggtagtatttgaactggtccttgtagaataaatgggctttttaaaaataatgagaaggacattccagctagaaaaacatgggtaaactcttggaagaaagatgtcactgagacatacttttgcaacagcaggtaggtctggctgcattggggacat

SEQ ID NO: 8735 - DNA, 1118 bp, Homo sapiens
atccatggaggtaccatgagctaccatggaggtagctcagagaggaaagggaacagtaacagaggcctgcttggtttttaaacagttttgcaaagagtattatttacgtatttatactaagtctacaccagttttgagtatttgcctactacagtgtaagcaaatgcttacaggaaattagcacacctctgaaagatctctgcaccaaaggaatagaaaaggttgaagaaattatcttaaattcatatagagattttaatgactttaaatggaattataatcaactgtattttatcttctgttatatattcaagttgtatggttgtatatcacttgtccttgtccattgtatttgggtttcatgcttcatggtgtcacttttttaaatagaaaaaaatgtgaatagttaaaaataaattttatttgatatttagataatggtaaaaattgaaatgatgataaatgctgtttattgcctacttgtgaaggtgtcaatgttacgttggtagagtatatatggaatcatttatatgatttacagtaaatgaaacagaaggtgaggtaccactttcagatgtagtacagttgtctgactcagattttagaaatctattgatatttttaaagcaaaactttttttaatgctttacatttgaatgatgttctttgtacttggatattgatcctatttctgattcagttttgaaaggaattaacatcaagtggacttcatgtcacttaacagtgcttttttgtatacatttttaaagaaaattagtcattttactttgatttttgagttagcaattcacaagcaggtaattaaacacttttagaagaaaaatattggtctaataataatcttaactcatctttttgacatagtaaagaaaaaggaactctgcagaagcaaaattttttagtatgtggcaaacaactaagcaactagatttttcttggctttcttagtattcttccatagcttgtaattcattaaacattcctattcagctttctatactaatttcatatatatatatatgtattttgcttcatgaaagcattgctgcttttcttcttcatcagtaattagtaaacttagcttcctaaccccttat

SEQ ID NO: 8736 - DNA, 1067 bp, Homo sapiens
gtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacgttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcgtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatc

SEQ ID NO: 8737 - DNA, 1050 bp, Homo sapiens
cactgtgtccctaagaagctagtctttccaactttttgggagcagttcttattcaccgtttttggttgaactcttttgagaatctgatgaaagttctggactctgacctgagaaaatacacacaaaatctagtatacaatttctagaaaattgcaagtttctggtctgtggatcccaggtaaagcatttcttgggagttttgaccccacttaggccaatttccacagcatcactattgttgaaactggtgctttgtgctagggctcttgataaggcaatctttttgcctacttgaaaacatgggaaataggattttgccacatgaatccaagcaagtgatacgtctgcattgaaaagactaacaaaatagttttaatagtaacttcatatgtgccccgagttcattttagattcttcgtgtttgaaacttagtagaaaaggagggtaagaagatggaggccaaattggggtgggagtggaagttcccatgtcctctgtctggatctttgtctgtcgtggaccttactggtcccccagaacagtggacacttcggaaatatttgttgaatgaatgaatttgcagacgatgcaccttttattcatattgtggatgtttactatcattgagagaaactgctggtgttaatcggggagggagggggaaattttgagtggagtgatcagttcattaagtaatctgtattagtgaacattgtcatattatgatgacttttgcttccctgaatagggaatagctggcattgggataacaaataccttgagagtgaagatcctctgtattaggttttcccttttttagtgcctatttataattgtaaaatgcacattcagaaagtgtgtaaaaacttacagtctaacaaataattataaaacaagtactgaggtagtctccatccagattaagaaatagaacattactagcaatattgaagccttttccccataccttttccaattataaccatctctcttctgcataagtaagcataatcttgacttctgtgatcatttccttgcttacctttatgc

SEQ ID NO: 8738 - DNA, 1045 bp, Homo sapiens
acctgtaatcccagctactcgggaggctaaggcaggagaattgcctgaacctgggaggcagaggttgcagtgagccgagattgtgccattgcattccagcctgggcaacaagagcaagactccatctcataaaaacaaaaaattgaaaaataagaaaagagcctgggagactagttagactaggttatcgatgatgggagcctaaatcaatatcttctagttactggttcggtttttatcattttccacagacctttggtttagatgcactttaaactatctccttggccctcctccgccttttctctcaggattagctctagctccttaaaatccagtccagtcagagccctagacttactttcccagaaaaagagttcaaacaagaccatgataaagaaaataccttggcagaggtagtgtgcagactccacaggatagcagtggcatttctgtcttaggagagccgaattagggtgaacacactcatctttatagccacatgccagagtcacattgattagaagaatacaaggactgtatgaagagattaactccctttaaagatactgttcagtgtgagattctggctttagagtttaattgcagatacctttgtatcattttgacaagataatggaaaggcatagagtttcttgtaaccaagatgtcaggccatctcccttgagccaggctgctatggaggtcagtaaggagtccattggactaggagttgacggatccctttttggtacaataagtaccaaaaataagtgcatgttctgatttgtcagaaaggaggaggaggagtcagattttcttttttaacctttaaattcctacttgttggttcaattcactttatttgtattaaactaccatttggctcaatttattctgattaacccttcaaggcaaattgcctttgatctgaaatttttctcatttatgatacatactttaccctttcaacaagccaaatagagttttgttccaagggcttctgtattgctgacagtactaaattagagtttgatgtataagg

SEQ ID NO: 8739 - DNA, 1095 bp, Homo sapiens
ttctcccatggtgacctagtttgtcagttattgatgtatgtaataaaactaattaaacactcaaaaatgcttttggttagacaaagtctttcagattctgaagctcatggggagggtaaatgggtgttcttgatggtaaaaaatatatgaaatatagtcagatttgaagactgcaaattgatgggtcatcagccaattctggcctaaagatgcattttgtttggctaataaaatggtggtgttttttaatttataaattcctgacaaacatttaaaaattagaaaatgtcacatcaaaaagcagatgtttaagcttcttttcaaaattcaaaagttctggcattagtggatccacatttgtccatgacaataaccagctggaaccgggttgttacttagatgaaccacgtgctttttccagtttcccacagcctccacctgacccagttcattgatgtatattacctgtcaggctcagtaagcatgtgagtctgtgattcctgggctagctcagactcctcatcatcttgtttggctatggagtaaaacccattttccgtctgtgatcactcacatcttttgtactctgtacagctttgtgtcttgggacttttttcttatgttgttattttatgtctttcatgtaaataggtctgtttgacaagagccacattctcatcagttcacagttggcattgttttgggggctggaaatgcagaggagtcttatggtgctcgcaccctgagggaggtcacagtctagccttgtttctttttaatttacaaagcatccagcattctgatgtgcatgttcaggacttattagaatgtggagattaacagcatgggatttggtatcagaaagacctaggttagagtactgatgtagtttatgtaaactcttcagcttctgttttcttgtctttaaaagggggataattaatagtacttatgggatacagtgaggtttgaatgacccagtgattataaggggcttagttccaatccataacatttaataactgccaaatacctggtaactcttattactagggctggacatacagttggctctcaattgatgcttgttgaatt

SEQ ID NO: 8740 - DNA, 1044 bp, Homo sapiens
cttaatgagcagtttagtctcaaagggagattgcccagttgcagtttagatctgcttctaatcctggatttggccagaagattccttgattgactctgggggaacctttacctttatagagaggatacaggcctggtattttctgtccaggggatctaagcatggggtggagtatgccatctctccctggtgctcagccaggcctgtgggtcatcaaggacccagcccattctgcagagagtttagacagcttgcccaaagtctatctgtagttggaagaagcatgactggaagggagataatgaaagggtgccatttcttcctgatctctctaattctgcctgtacccttacccccatctgaactcccacccctgcctacactacccttccatctgggagagagaatagtaggcaggggtcatgttttggaaaggatattatttcaagggcgttgggaccccagtgaaagattttattgaggggagtgacatgacctgttggacactgtggtgggctgatttgcatccccaaaactcatatgttgagccctaaccctcagtacctcagaaggtgactgtatttggagatagggcctttaaagagataattaagttacctgttaggctgttaggataggctgtagcccagtttgacctatgtccttgtaagaggaggagttttagatacacagagaaacaccaggcatgcacatacacagaggaaggaccatgtgcagacacagtgagaaggtggtcatctgcaagccaaggagaattcttgagaagccaaacctgctgactccttgaacttggacttccagcctccagaactatgtctgtcattcaagcccctcggtcagtggcattttgtgatggcagtcccagggtacgaatatagaaccaaaaagatgaattgagcctcagggcggagaatggataggggagcaatattgtgggtattcagaacagccgggaactcacaggaaagaggaaggtggtgtggaccagggagatctacagaggtgggaggaagaggacagatt

SEQ ID NO: 8741 - DNA, 1066 bp, Homo sapiens
aaatgagtgaatcaattaaaaataaatccgggacatgccattccccccccccgccccctgcccccattgcctgtccccgtccccaccccttgtcattgcattgtgaactcttggacttgatagtgaggttgctggttgctcaggctgtagaaggaagaaaggagaggaatggtgtctataagccagctgtgctgttcaaaaacatgttttttactttttatttaagtaaactttttatagaaacttaacgcacataccgaagagcgcgcagatgttaactggggagctctatgaatttccatgaagtaaacacacctggggaaccagggcttagctcaagaagtacagcattgccaaccccagagccccggtggtgcccccactccatcctccccctgccccccgccactgttctgacttccaacatcacagattcctttcttctgtttttgaactggcaagaatgtctggctccttttactccacgttaaaaagatctagtttccacctcatcttccaggaggtgggttgtaggataaccctccacccacttgggttgcaaggacaactccaaaaccttggcgacccgacctcccacaagccttgggctccagactccagcactcttgttccaggcgcccttgaatgagctcgtctgttttccagcagaaatcgtggcctgatgccacctggaagacccagtagcatggaaataggagtccagagcaggctgtaagtgtgagctcacagggagggcaagtgagatttggagagacctgccacattccccgcagaggacgaatgacgtttacatcccttaatcagagtcagaggcatcccacccaggcaactgaggtgtgggcctcttgtggggagtggggctggccagaagggaggggagaagtgtggctgtggaaggtggctcataagagcttttatagaatacacttgtgttctaaaagggaataaaaggaaacatagcccttgggtcattttctatgctaactcattaataagcagtcacccacaggtttctccaagtgattccttgttcagtttttctttt

SEQ ID NO: 8742 - DNA, 1030 bp, Homo sapiens
gtatggaggaggttttcaggattcacttggagctctcggaatgcataaagtgcaatactttcccattgccgcaaaaagatattgcattttaaatgtctgaaatcatgattgacttagctcctcagccctgaagggtgcagcagtggcttgaagcatcagaaccttgaaggagatttctttgaggaacactttgctatctcctgttaaaattagcagcaagcattctcagggcactctccactaaatatgtctggcaggagggtacacgatacctctcccttcactccccaaatcctccctgtattgcagtccagagcttttcaaactttatatgcattcaaaaggcatgggggtcttggtaaaatgcagagtctggctcagtaggtatgtggggtaaggctgattgaatttcaaacaaccccccaggtgactgttgatgcactggtctgaggtctacactttgagccacaagggtctagagtttatgattttcagggagctaagctggctgtatcagaatgacctggagtcttcagtaagcagcttcccaggacctttctgggatattctcaatcaggaggcctaggatagactcaggaaactgccagtgtcccaggaaccacactatgagaaacgccgcctcactcagtggttcctgtgatcgtcagggtccctggtggattgaggccaacttgggaaacattgattattgggtttgggatggggccagaagcccacttgtatcctgtttcgccgggggagcctaatctacactcaagtttgtgaattcctcgcagtaattacttctttacctcctcatctttcgtctgtcccttggccccaaactcttcctcaagctagtgtcccactggctcttgttccttctcctttgttgtagccagtgtgtgactccttggccctctgcacctggcttttgcatcctccacagtaatgttttgctccaagaatctcttagttgtcagatccagcaaatgttgaaatacgctattacttggccttgaagcggtac

SEQ ID NO: 8743 - DNA, 1046 bp, Homo sapiens
aacaatgttagatctgtttttatagtcccacaagtccctgaggctctgtgagtttttatttttttatattttggggggtaggtcagggtttcactccatcacccaggctagagtgcagtggtgcgatcatggctcactgcagcctcaacttcctgagctccagtgatcctccctcctcagcctcctgagtagctgggaccacaggcatgcaccaccatgcctggctaattttttttttattgtattttttgtagaggtgggttttgatatgttgcccaggttggtctcaaactcctgagctcaagtgatccgcccgcctcagcctcccaaagtgctgggattataagcatgagccaccacaccagagctctgttcatttttaatcactcctttttctttttattgttcatattggacaatttctgttaatctgtcatcaagctcacttactctttcatctgtcatctccagtctgctttcaagcctatatagtgttttgttttgtttagttgtttaaatttcagttactgtatctttctgttctaaaatttctttttggttttctttatatctttctttgctgagactttctgtttttccatttgttttgagagtgtgtgtgattgcttactcgagcatttatgtaatagctgctataaaatcttcatcatataacttcaacatctgtgtcatcttggcatttgtctgttgattgtcttaacccaaatgaattgagattttcttggttcttaatatgacaagaaattttggattatattctggatattttgattattatgtgtgacactctgggtcttatttgaagcctagcgggagtgcttatatatgtgtttttgtaggtaaatgacctgcgcaggtcaggccacagttttctaccagccctctgtgggctatggttacaatcgttttcacgctgtttttgcaatgctatttggatgtatcctgcctatggccctaccagtagtttgtgagttcagtctttgatgtgctgattaggaccaggtccatgtgcatgcagcttgagg

SEQ ID NO: 8744 - DNA, 1036 bp, Homo sapiens
tcaaaatagtcaggactttctataatattatgaaaaggcagaaagggagattggatgggtactggggattgattagccacagtctttgccacagactcttttggactgagccgataggtcaaaggttagcttatgcagtagcatgggctgtaggttttttgcactgatcaacaccggaacttttagaagacttttagaagatttgttgctgctgtgagtgacatcagttcacacagcctgagagagaactctcagtccatgctgtccctccttgggctcactcaagtgaaatgggtcgagctgcaacactgtgcggtgccaaccgggagaaatctgcctatcggggctgagagacatcctgtagtggctgcccgtctcctttgccccaaatgtcaagtggaagaggtgcttcacatatttatttcttcctacatgggctcatttattgtaagcccattgtgacccttggaaagccaagcttttatcttgattttggagtgtgatcaaggtgacagttgttctctggatgacaggaatctgactttggttttgctttttccatagaggtcagttggcctcaaatttgggccaatttgcatctggaggagacctccaaggacagatgccttgtcctcattagctaatttgtcaggcagtctttcctgtgtggcacagaaccttttatagatttttcctcaaactcgttttggttggccagtgcctgcctgcctttctttctggaaatgtgctgtgtatttgtggggacgtgactccatggtgcgtctctcttcccaatacattccctttcccctatccacagccctgttacttctgtctttcttccactctcagtgcagcaattttaaagtacatccacagattctttggcactcctacctttgagaggtacagactgtgtccctacttctggaaactgggccagctattgtgactattttgatcagtagagtatggcagaaatgatgctatgtgatttctacgaataggatataaaaggcgacatggcctcttccgt

SEQ ID NO: 8745 - DNA, 1109 bp, Homo sapiens
aagtcagcgcatccgagtgaagccggcagctggaccttcacaactgaaagcagactaaataaaagggggaggatgaaaaaagaagagctgcaaataagatgtcagggaatgcttaattatataaaggttatgcatttgcctgcataattgtccaaagcaactgatggcaacagctggcagagaagctggtcttcagctctatttgtgtttatctggtgcctgtcaccgtaatagctacaagaagtattgatcacaaattaatttggcctcattccttctcctttttgtctctacccttatcagtctcacttcccctactaaaataggaaggctattgaatacatggagaaaacttggagtttgtggaggctgaggctaccaagtatcatggaagcaatatactatatgccaggcactagcataggtagcatttgtaactgacttttttaataaaacaaccctataaggtaggtattcttattcctgttttacatataagggtagtgagacccagagagatgaactcatttgacaaaagtcacacagcttggggtagcctggtgattcccttaaccacggctctcccaactgggctctgcaaggtgggtattttgggagttttttcactgcacctggagtgaaatctgaaccctttaccacagactacataccctgtatgttctaactggtcttcaagcacatcttctcctggtatcctccaccttgtccggcacgctagtctccttttcctttctttttttttttttttcttggagacagagtctcactctgtcgcccaggctggagtgcagtggcatgatcttggctcactgcaacctctgccacctgggttcaagcaattctcatgcctcagactcccgagtagctgggattacaggcttgtgccaccatgcccagctaattttggtatttttagtagagacggggtttcgccatgttggtcaggctggtcttgatctcctggcctcaagtgatctgcctgccttgacctcctcatttccatttcttagacatgccaagctctttcctgtttaagggtctttgcaggtgctgttacctctgcctagaactgtgttcctgcaaggtca

SEQ ID NO: 8746 - DNA, 1087 bp, Homo sapiens
attttagaaaaagtattaagatcccagccttgatcctcaggacagcgtgaggccatcaaaaggttcggaaggaagtttggagggcagaaggctggagggaatgcttccttgcccagatgaagcctgaatgactcgcagggctggggcaagctgccgccagttttatccacaaagcagcaaccacttctgctaagatagtgatgactccgagcccctccagctcccctgttctcctcaaccctggtctgagcgcctgctttgtgcgagtcattcaggcttcatcaaggcactatgttaatgttaggtccttcttacagatcagcccacgtagtcctcacagcagctggttgaggagctattatcatcatccccacttggcagtggtaggtagaggctgaggctgagagagttgcccaggttcactctactggaaggagccagctctggaatctggaattcagccccaggcctctctcagtccaagtccagtgcgcactatctctttcatggactgcctcccattctcaggatcctaatgtctttatctaaccctgctggtggccagaagcctctacctggtacccgtcacaacccaggtgagaccaggcatctcaggatgcctcacctgacttccagctggaatccaacctgagctgtgcagttggctcaaagggtggccaaccagaggagcagatttatccacattggcatcagaaaaaccactctaggccgggcacagtggctcatgcctgtaaggctcatgccttgagaggctttccctgttctcccagctctcaccccaccaccagtaatctgtgcttaaacgagctgtcttgcctttccacgcaaatgaattggagatggtgaggctccaggcagcagcagacgcatctcaaagctggtttggggcataagagctttctctctatgagaataacctgcttcggagccttctcaaggatagggaggttggtatttatataaagtgaggttttcgaaatgaacagaggtatgagctgcctggcagtgtcctggaacgagccagtttgtaaaataactacttttttgttgctttggggctagaata

SEQ ID NO: 8747 - DNA, 1047 bp, Homo sapiens
gcctgcagaactgtgagccaactaatcctcttttttttttttttgagacagagtcttagtcacccaggctggagtacagtggcgcgatcttagctcacggttacccctgtctcctgagttcaagcaattcttgtgcctcagcctcctgagtagctgggattacaggtgtgtgccaccacagctggctaatttttgtatttttagtagaggcagggttttgccatgttggccaagtgggtctcaaactcctggcctcgagtgatccacctgcctcagcctcccaaagtgctgggattacaggcatgagccaccgcacccagcctaaacctcttgtttataaattacccagactcaggtatttctttatagcaatgcaagaacagcctaacacagttacccaaagccctacaactagcaaattctggcagggccagaattcagcatagatattaggaagaggtccatggaacataacgcagccatgctaagcctcatttgtcactggccagcaacctgaactgaggttgaccaggaaatggatttgtgatgggaccattctgtcactgtttgtgtatgtaaataagggacatctctgacacctgctggggtagccagaacatttaatatcctttgcctgcctgaacaccttttcagatgtagggctcaattcacatacctacaagttcagtttttacccaaccaacttctaatgacataatctcatgagttcattttatctgtaacctctcatcagaattagcagatcctctgcaatttgggaactctggacaaaatccaggggaaagattctgaaggtgaagcattcaagtctagcagtcctaatggaaacagtgtaatagcaacatgccactcatctgcagtcagcctggatgacttaaattggtttccaggaggttgaagtttcatgagaacagctcggcacagctaagctggtattaataagcacattgtgcccgtggacaacattgtagatcaatacagtatatgctccaaattcacatgatagatgagtaccattatgaccta

SEQ ID NO: 8748 - DNA, 1035 bp, Homo sapiens
attgtaccagtgcactccagcgtgggtggtagagcgagaccttgtctctttaaaaaaaaataaaaaaggcaagaccatcctggctaacacagtgaaaccccatctctactaaaaatacaaaaaaaattagccgggcgtggtggcgggcgcctgtagtcccagctacttgggaggctgaggcaggagaatggtgtgaacccaggaggcagaggttgccgtgagccaagattgagccactgcactccagcctgggcaacagagcaagactctgtttcaaaaaaataaataaataaaaaattaaaaaggaaagaaagaaagaaagatcccttgttgaagctgaatgcccatgcccaaattctggccttctctctacctcctgcttttgcagtagctttctaatgagccttcctgacctccagtccttgtcactgaaagcccagtcctgcttgtcttgctgtctgtgttcaaacacacaatagcccctcattgccagtagcataaagctgaatctcttactggacatggaaagttctccgaggtctgatctgttcaccacatgcacccataggcacctctgaacaatccttggtttcccacctttcaggcacacttttctgtctgtctagaacgccctcaccagtctagccaggccagaggtttccagttgttcaaattgtaattcacatggtgctgtttcagtgaatcatgctcatatctgggaatgacctgaattctatcccagctctgatgtacccacatggtaacattagagacagtcataatagcagctactgtgtattgagcacttactacacaatacacagtattgtgtagtaagatgggccaggggtgcacatcgcaaaacttcagggggtgccatttacatcgaatacagaagagaggcactgctggccactgtgccaagaccttcatatagataatctcagccctaacagttggactctgttaccgccattttacgaagaaggaaactaaggctacaaatgttaagtttcttgcccagggccacatagc

SEQ ID NO: 8749 - DNA, 1046 bp, Homo sapiens
aagggagcccctactattttgcgggtctctgttttgagtgtcttaaaattctagtggagtaggagccattgggaccatcacaggaagatatagcccctgggtgggaagcagggtgtctgtcttttggagggagcggagtgtctccatttcagttgttgctgagacaggcaaggtctggtggttgaggaaacatctttttctctctgagcctctttttgagcttagattataaggaatctagatctgtcacgggtagatgcttccaggttctgggagcagaaggcactgctacaaggaggcaagttggggactcagtagaaggtaacctgttggttagtagctgttaagcaatttggaccccaacctacaataagaactacttttatatcacaaatatacagataggaagtcattctacattcagcacactgacgcaggtattttttaatacattctattcccttcttttcgttttatgctggccctgacccactatgttagtttctgtacttattatactatttggttgagacctgatgttgaaaaaacattccagtgggatagtctatgaagatagcctcagcacatgagttatgagagctgcctcagctgtgagagttccaggcacgtcactgtccgggggtaattccctttgagtttcattgaattttaaggaaaaagcccccttgctcttcctcaaatgcaccaaagactctctcaccccaggatctttgcacttgctgttctgttcacttagaacacctgtcttccatatacccaagggtccaccttcagctctttatcaggtgccaccctctcaaggagaaccccatccccatccccaccccctgtttaaaattgcaacccatcaccaaccccgctccctcttcgttccacttaccatgttctgggcttttttttttttttttttgccacagcatttattatcttctcccaaacaatataccctataactttttattatatctactctctgtctctgcccactaccatgtaaattctgtgagggcaggaatttctgttct

SEQ ID NO: 8750 - DNA, 1025 bp, Homo sapiens
taatttgccaccttgacacatggatgcagtgtctggaaggtgcaccaactaaaatgctttgtcattctcatagaagagaagttcagagtcactgtgggtgggaatgaattggtcaggaatcccctcctctttcttagactcccgagttggtctgaaaacgctcatcgatattctcctctactttctcttctggccctgccttcaggttgcagggcagcccggtgacaaatgaggaggagctgaatttgctttttatttgaacaaactatactaattgaaatggaccccactgggattgctgtctgccataagtaatgtatatttcattaacattttctttaaaaaccaacaagatcataaagctaagattgctttagcctaaatgctgtccagatttaatatgcatgatataacctcctggcatagcactaagcttgagcatgcaatttttggtgcctccctgatgcttgtttttaacaggaggagaatcaatacggggtgagggttagaccaacaacgtgaactgtcaagaaccagagaaataattaaagttataatattaacaaaacaacatggttgtagaggggatggataaatgattttattccgtttttttctttcttctttttttttttttttttttttactgcctcaggcatatttgttggcattttcagaaggagatagaatcaggagttatttttctgctaggaaatgtttaagtaaatcccagttgtgatcaatagggtagcctccacaaagcaagcaaagcagtaaatgtcactcatttcactttttagcaacagttgtgtgtgtgttagagccgaagtctgaaaccagtgacttcaacattagccagggagtatcgaccaaaatcggtggtgaggagataaaattgccctggaaaagttgggttccccttaacaatggtagcatggagaaatcagacttccagatgttgtgatttctcagctctctaattcatcaaattaagatgactttcaggactgcctggagatggactt

SEQ ID NO: 8751 - DNA, 1050 bp, Homo sapiens
aaacaggctatatcaagagaaggaaacttaaaacagaaaaacctaaaagatgactgaagatacagaatccttgaaataaaaataagatgcctcccctcttttaaaggactaaacaggaaaggactcatagaaatttaacttgaaaaagttgggattgtttaaggtcaggaaatcaagactagtgtgggcaacatagtgagaccccatcttcacaaacaatttaaaaaatatattagttgggtgtggcggcacatgcctgtagtcctagctactcagttggctgaggtgggaggattgcttgatcccaggagttaaagtctgccgtgagttatgattgcaccactgcattccagcctgggcaacagagtgagaccttgtctctaaaaaaacataataatggaaaaagttaggtcataaatttgaaggtatatcccagaaggtagaaaaacacaaggaaattgaaaataagaaaaactgaagaccgggttaggagatatatatccaaatcgtaggaattctagagagaagagagaaaaaaaatgagaaattgaagaaaatgctccctgaaccaaagaacagtggttttcagacagaaaagagcccacctaatgctcagattggtgaatgacagtaaaccacaccaaacacatcattatgaaatttcagaacattgggcaaaaagaagatcctacaagtttctagagagggcattacaaaaataaatacataaatgaaagtaagtgtttttacaaaggttcaagaatcaaaatggtgtcagtcttctcaataacattggacatgagaagacagttctgaaacaaatcgtttcaactcaagttctgtactataaagacattttcagaaatgattaaaaagttagtctcatacagtcctttcaagaagctgctaataaatacggtctaccaaaaccaagggagtaaaccaagaaaaagaaagacacaggatatgggaaattggggatccaaccttagagagtgaaaaggagcctctggaatgacactgaagggccatcacagggtggcggctgtg

SEQ ID NO: 8752 - DNA, 1105 bp, Homo sapiens
atagcaggaatacccaataataatagtaacagcacctctcacggttgagccattcctacaggccagagatgctgaccacttgacatgcatctttcatcttcctagtcaccgaagtttgagacttgaggaacttgttcagagtcacttgcgtagcaaatggcagagggagatttgaaccacagatcctgagatctgtgtgctgtgtgccactcattcactatcatttttctccaacttgagaaaaagaaggaaattattgtaagtccccacttttcatttttcttcaacttgagaaaaagaaggaaattattataagtccccagtttaggctgtagatggaattcatgcatctcccttgtttttccaaggtcaccttcatactacagatagatgtcccaggggcacctaagtcagtaaagtcagaccctgacagggagctaggaagaaggacacggcagagggggatgtgatggtggcactggcagcagcagctgcaaatatttaatgaccccttagactgtttgccaggcactgtgctacatacttatttaattatgtgtttttatttgtcttaagagacagagtcttgctctgtcgcccaggctggagtgcaatggtgccgtcatagcacactgtgacctcaaactcctgggctcaagcgatcctccctccttagcctcctgagtagctaggtttacaggagcatgccaccatgcccagcaaatttttaaattttttatagagacagtgtctcactgtgttgcccaggctggagtacggtagtgcaatcatagttcaccgtgaccttgaactcttggcctcaagcgatcctcccatctcagcctccaaaagtgctgagattacaggtgtgagcccccgcgtccagccctgtgctacatactttataacgaccatgtctgatcttcacaaacacctcatgagatgcatgctcttatccttcattttacagatgaggaaaacaggctcaggagtttaagtaacttgccacagttgcaaagccaataaatcgtagagccaggattcagacatgggtctgtcagcctccagagtctgtggtctgtgttggatgtcagtgcatcatcgt

SEQ ID NO: 8753 - DNA, 1056 bp, Homo sapiens
aatatttgctgcaggcagcaggcaaagtccatgatgaatgctaaaattagtgggtgaaagtttaagcagaaacaggatatttgcatagtttcaaagaatctcccccaaaatatttattgactacaaagacagaaatagtaactttgcagtgaagaatcctggcagataaagtgatcaaagttaacatcatcagtgaatgcatttcaggtatcccctgatgggatacactgaatatgctctgatactcttttcaataatatatattctcacaattgtgaaactacatcagaaaaacccaaattgagggacattctacaaaataacttctcgatcctcttcacagtattaaagtcatgaagaacaaggaaagactgagaaactgtcaccgattagaggagatcaatgccatgtgggatcctggcaaaatttgaatcaattctattaacttagttaatacagttgttccaaggttaactcagttttagcagttgttctgtggttaggaaagggatcatcactaggggaacctagatgaaggatttgcagaaactgtacttttttttttttttttttttttttgagactgagtctcgctctgtcacccaggctggagtgcaatggtgtgatctcggctcactgcaaccttcgcctcccgggttcaagcaattctcttgcctcagcctcctgagtagctgggattacaggcgcatgccagcatgcctggctaatttttgtatttttagtagagacagggtttcaccatgttggtcaggctggtctcgaactactgacctcgtgatccacctgcctcggcctcccaaagtgctgggattacaggtgtgaaccaccatgcctggccaaactgtactatttttgcaactcttgtgtatgtctaaacttatctccaaataaaaaattaaattttaaaaaaggagaacctagcatatagaaagtgctgtataggtatttattaaatagacaaaatggtaattggttaaaagtatgtattgatgtgcttaattaagtaaaaaaatcagggtgtaaccatgcatgtta

SEQ ID NO: 8754 - DNA, 1110 bp, Homo sapiens
cctgttgtatttcccagattgtggtgagccctgagtggggttccaagaaggagcaagcctggtctttgcccaccgagaacttaatggtaagatagccacatatgtaaaatgaaataaagctttgggctaagagtacagatgctggaactagacttcctgggttcctcttggtttctctactagctagctctgataatagctattaataattcctcaggtatagggagtatttgggcaagttccttaacctgtgttcccatttcctcacctgtgaaacggtctacttcataggagggtgtattcgtttgctagggctgccataacaaatgaccacaaacttggctttgaaacaacagaaatttattctctcacagttctggaggccagaagtgcaaattgaaggtactggcagggtttgttctttctggaggctctgagggagagtctgttccatgcctcattcctagcttctggggccgctggcaattcttggtgttccttggcttggttggggctgcatgattccagtttctgccttcaacttcgcatggcctttgcccttgtctgtttctgtgtcatctccttctctgtctctcataaagacactcatcattggatctaaagctctctctaattcagaatgagctcatcttgaaactcttaccttaattatatctgcaaagaccctttttccaaataaggtcacattctgaggttctgggtggacatacctttggagggacactactcaactcaatacagatggtgcaaggattaaaagtgttagaatgtgtaaaacacatcagatattaatgagaatagggtaagagctgccaggataattatggtgatgatattatgtttactcttgtttttgagttcaaagtaaatatgcatggtggtgatggttgttagtattattagtatcattatttagttcaaatcaggaatgaggacatgtcacaaggcaaatggtgttcctcattccaactctggacttttccccatgcccttctgggggttgatgctgggaaattaatcacagggaacagtgctgtctgtgaacgacaggccaaacagggtgatgtgagccactgaggttccttgatc

SEQ ID NO: 8755 - DNA, 1033 bp, Homo sapiens
agagacaagggaataaacagatgcagacaccttaaaaattgcaaggcaaagctggtgttaagacatagctctctaggactttcccctagagtctccctggctcagtgggtgctgttcatgcaggggaaagcttgaccaagagtgagtccatcacgctgtgagtcactgggtcagggttgcgcgccctcacagacacctggcacgcttcttggctgacttcttctgtgaccagggcctctgatagccctgttcccctccctgcatgttgtttgtatcttcttttcctagttttctttgattcagataagctcaggggctcctgagccgatcttgtcttcctttgatggatgggtggcaagggagtagggctggggccaggggcccgtctgtggagggtggaggcagatggcgtggggcaaggcagcaggcaggtaggagaaatgaaagggcttcacatcaaagaaagagaagccaatcaactggagtattctctgtcctctgagattggatctgagctctaatttgtgaatcttagttaagttttgaaaaccaaaagcaaggggctgctggacctcctgcctaacaaaagtgtttgttgaaaagattcagaaccgtgacaaagatatagctcccgcagagctctaaagagaagggaattcaagctccagaaggtggggaccccacagtgaaaatgacaaacagggttcacactctcctagagcttgtcttccagtgggagtacacagacaatgccaaacaagatcatttcagcaagtgtgatatgtaaaaaagatgctctgtgactttgggttgagtggtcaaggaagcctccctgagaaggtcacactggggctgaaccctgcgcagccacatgtggatctgggggaagtgtattctagggtgaccaaagagttggtgccaaggtcttgtgcagaagggagttcaatgtgattgaggaacagagggaggtcagcatgcctggggaaagtgcagggaggagagggggcccactgagccggggaggctgggacaa

SEQ ID NO: 8756 - DNA, 1042 bp, Homo sapiens
tatttcaatttgcttgtaaccctttcccctccctctttgcctggttaaccactctttatcctttggcttttggttggttgatctaaactcttcagcataggtcaggcctcctttttgttttacacttaccttttctatgtagcactcctcacagttcgtaattttatatttgtgtggtaatttgattacatcttcctcatacactagactgtaagctccttttgttcacctttgtattctggaatctaactcagtacttagcaaggcagaaggaactaaataaacttttgttgagtgatcaaatgaatgaatccattatatataattcatattgttaattgatctgaggttgctaaggaataattttgtacttccactgagctctgactgcaaaacacttccactgagctctgactgcaaaacactcactcacccactaattatctttgttaggtattgcttttgaaatgctgaatagtatttcatcttatcatttgatctgtaccaccaccaaaaatgtttatttaagtctccatctatgttttgagtggagattttttttttcttttaagacagagtcttactctgtggcccaggctggagtgcagtggtgcaatgatggctcattgtggcctcgacctcagcctttctcccaagtagctgaaactacaggtgcacgccattacgccaggctaatttttgtattttttgtagagacagggtttctccacattgccaaggctggtctcgagctcttgggctcaagtgatctgcctgcctcgacctcccaaagtgctggaattataggcatgagccaccatgcttggctgagtagaaacctttctataaatattgtctgcttgggtggcagtgtgtgtgtgtgtgtggtgtttggggggtaatgtgaaatgagtaaagtttgtggaaatgaaagttactgtacagttcattgatgcctgttttcctataagggaaatttgaattatttagggtagaaacaggactggtgtgcagcaggctccagggaaagcagccacacctt

SEQ ID NO: 8757 - DNA, 1032 bp, Homo sapiens
ttgaggggcagagtcctcttgctctaaggtaagaagctatgggtgatgtttatgcagggaagaaatgggtggcgtttaatctctcggctctgtgtgtggcacacacttgcattgtttaagacaggggtcaggagttcaggctctggaatcacacaggatttgcctcttggttcctcttcctagtcttctgcctttgggcaagtgaatccctatgcttcggtttcttcatctgcaaaatgagcctaatgaaacctacctccttggtttagagtagaaattaactgagggaatagatgcaaatggaggcttgacacagtcctgaccatcatggccagcctctgatgatagttaatattattctaatcagcagtcataatggtaataaaatagtcatggttgacaattgatttgaccaaatggccccaccacttttgaaaatctgcttgtgacctggtttccatccaatgggctggcgcaggggcaggcgtggggtccagatctagtctcctatgctggcttggagggttctgccttctgtgtgtttcctttagcagtaccttgggtgctgctggcttaccctgtatctgggtgtgtatataatacataggggagtatgtcatacataagacttcatagagaaatcggtgatgggctgcatgttctcattcataggtgggaattgaacaatgagaacacttggacacagggtggggaacaccacacaccggggcctgtcgtggagtgtggggaggaggaaggatagcattaggagatgtacctaatgtaaacgatgagttaatgggtgtagcacaccaacatggcacatgtatacatatgtaacaaacctgcacgttgtgcacatgtaccctagaacttaaagtataaaaaaaaagaaatcggtgatgggctgacagtgagataagacagctgccaagttaagaggctggtgaattagatgatgtggtaggtgggagttcaaacatggctgagggatggttctgagtttgtattgtgttagggtatcagcccctg

SEQ ID NO: 8758 - DNA, 1028 bp, Homo sapiens
taacattaactagcttaggtggttgttagcttcattatttgatagcagaaaacaagacttaagggaggttatatgatttttctatctctcagtgacttggcaaaaagtgaaccctattcctaaccaggcctgtggtcttcaagtgaagtgtagtagtccatggagcagtgcatgctccctgtatttccttctgggggccatgattgtgaaagtgttgcttgtgatttaccagcagatatttatacacatttacttatcacaagacgttttgagtctttcatgtggagctcaaagccttaaaacataaaaaccaaagcaaaacaaagaattctgttatctaggcaagtgtctctctctctctccccctctttttcttttagaaaaatacttcgtgataaaaacacaaaagtatgtgaatggtaattgaaaatgcattgcttccttttagaaacccactaggatttgcataaaccacttggctgtctgataagtcattatctgttctgtcagtccctggggacttttaatattaggtttatatttttatagaaaaggcaagttctaaatttgaagatgggtattgttaaactcttcaataatgacagtttgtgaaactgcatgttccaaaagtcctttaaaaagtcaataaggccacgcgcagtggcgcacgcctgtaatcccagcactttgggaggccaaggcaggcggatcacctgaggtcaggagttcgagaccagtctgcccaacatggcgaaaccccatctctactaaaaatacaaaaaaaaattagccagccatagtggcaggcgcctgtaatcccagctactcgggaggctgaggcaggagaattgcttaaacctgggaggcagaggttgcagtgagccgagatcgcatcaagagcgatactctgtctctaaataaataaataaataaatagtcaataaaaacatgtcatctctatattgggataaccacacaaataaaattaaaggcctagaaggattttgaatttgtgctggcacaatctg

SEQ ID NO: 8759 - DNA, 1030 bp, Homo sapiens
atccaggatgcgtgcaggcttatattaaactcccaaattgattactggctaaactggtagggacagccacttttcaatatgctttttgaattatagattgctttctctgagttgtaaaaagctaaaattataagactatttctagaaggactcaatttcttttttaagatttgttcatgctgttgacttcacttgtggccataaaagttattggaccagccagtagacatggcacctagtacttttatagaaatacaattttatttcagtacaatttgagaatatatataatctagtacaattatagaaattgttacaaagtggttttaattaatgggttaaaaaaactgaatgatttctggaatctatcaaatagcagtataaatcaagttgagaccccatatatggtggtatatttaagaggaatataaatttcctaccagacatgtggacattttaaaatgttggaatcaaaatgatacaagccacagatgaacaacttctgctgttttttgaatatctgaagtaacatcttggttgggaatttttatttctaattactattttttagagtaacttttcacaaccgtctagaatcacaatacaggttgaacattcctaatgggaaaatccaaaatgctccaaaatttgaaactttttgagggctgacatgatgctcaaaggcaatgctcattggagcattatggatttcagatttggggattagggatgctcaactcgtatatattctgcaacccttccaaaatctgaaatccaaaacacttcatcccaagcattttggagaagagatattcaacctgtactgtaccaacactgccttggtttgataacattcatcttaaagcacccagtgctagtaaaagaacataatcattagtttatagcaaatgggtcctgaagggcttactgaaaggccattttgggattagagatgatggtttctttctgtgatttcaatctgaaaagctgaaaatgtattctggatgtccttcctaactttctcttaatt

SEQ ID NO: 8760 - DNA, 1011 bp, Homo sapiens
tctagattccttcaggtacattcagattgaactctgcttatctttacctgcttccctttctgcattcttccttttttttacatttccatatccagtcacttatcgagtgctgccaatttcactttctacggatttttcaaatctctgctaccagtcccctgttctcatgatctcttactgaaccgctttagcaggttcctgagtactcttctggctccaggcttatcccactcaaatctaccttctgtttaaccttcatagtgacctgtctcatataatttccaacagggcagggcattttttttcttcttttttactccagcacctgtctcattgtaggtacttaataaaaatttaatggatgaaggaatttatctgaaatgcatagatgaccaaatgttttccctgctttcaaaaaattcttcagtgacttttcatcatctctaggatgatttggcaccatatttgtctcttgctactctccgacttacactttgtgctctgacaatgctcacctactttcagactcacaaatatgaaattctgcatcttatttccatggtctgctcatggaaactccccgtcagcaaagctctcctttgtcaacttgtaaactaatgtttaccctttaagagtcagctcagatatcacctgttccaagacgccttctctgattccttcccaatcccctccaacttagtctgggtcaggtattccttctgtgttcccatcaccctgttcttaccacattttactctaatgatttgtttatgtgtttatctcattgtttgtgatttcatataggtcttcatctttgtatccccagcacctaacacagtgactagaatttaataggaatatagagtttgtggaaagaatgtaaaatatctcaatgattgcaggaggctattcctctgacatttcgactcagggatgtactggccacattacagtatatctccaaaatggtttagagtgtcctgaatgtcatgttttggcattgcaaatgtg

SEQ ID NO: 8761 - DNA, 1044 bp, Homo sapiens
aagcagcagctctttctcacccagatattcctccatcctgtttatagcaccatattggtggccagagcctctgcaaaaataaccttttgatttcaatctctcctctgtattccgcctgccatgattcaggcctttatttttacttacctcttttgggagccttcttattttctaattagtttctaaatgcctctattctctcaattctagtgtttttgtttgtttgttttttgtttttgtttttgtttttttttcagatggagtcttgctctgttgcccaggctggagtgcagtggcacaatcttggctcactgcagcctccgcctcctgggctcaagcgattcttcagcctcctgagtggctgggattacaggtgcacaccaccacgcccggctaatttttgtatttttagtagagatggggtttcaccatgttggtcaggatggtttcaaactcctgacatcatgatctgcctgccttggactcccaagtgctgagattacaggcgtgaacctctgcgcccagcctatttttacttatctcctttggaagccttcttattttctaattagtctctaactgcctctattttctcaattctagcatattttatatgaatctttgtgttgctatcctttttttaaataagaaaactaccactagctgctcattctctattgaattattaaaaatgtatcaatttagcattcaaggactcattctcatgcaccccaagataccaacaaaactgactacaagtgtctcctgagtatttccttccacctaatgcctttcttcttattgttctctctttctggatggtcacccctcatttctgcccaggaaatttctgctcattctttaagatgcatcccaggggtcacttccttcatgaacctttcagattctcccaaccaggtgtcgtttcatcctctacagagccttggaatgattgtgtaacactcttggcgctcatcacattccagtttgtattgtagttatttgtgtacaggttttctctcaacctcaagggcaaaggccaaa

SEQ ID NO: 8762 - DNA, 1049 bp, Homo sapiens
aataaacttgtacttataacatgtctgaacaggatatagtttgaggaactaagaagggtcagacatcagtttgaaaagagcacctatcagagcaacatgaattctgctaaagttgaagcaagaacaaatatcgaatttatggtgaagcttggtggaagaatagtgaaatcattgatgctttatgaaaagtttatggagacaatgtccccaaagaaatcaacagtttacaaatggatcactcattttaagaagggacaagacaacgtcaaagcccattgcagcagatcaatttgcgaggaaaaatttaatcttgtttatgccctaaatgaagaagaccgatgattaatagcagaaacaatagccaacatcatcgatatctcagttggttcagcttattcaattccgactgaaaaattgaagtttaacaaacttcctactgatgagtgtcaaaaccattgcactcagattagctgcagacaagaacagagctttcagtggaaattgtaaacaagtgggatcaagatcctgaagcatgtctttgaagaatgggaacaggaggtgaaacatggctttagcagtgcaattctgaagacaaaacacagtcaaagcaatggctgccaggaagtgaaaagggcccagtccaagcaaaaagagaccagttaagaggaagggctatggcagttttttgggatgctcaagacattttgctggttgacattctggagggctaaagaataatgtctgcttattatgagcttgttttgagaaagttggccaaagattgagcaggaaaacgcctaggaaagcatcaccagagttctccaccgccacagtgctcctgctcattcctctcatcaaacagggacaattttttaagagttttgatgaggaatcattaggcatccaccttaaagtccttatttgggcccttctgatttctttttgttgcctaatcttaaaaaacatctttaaagggcacccacatttctttggttaatagtataaaaaagactgcattgacatggttaagttcccaggaccctcagttg

SEQ ID NO: 8763 - DNA, 1035 bp, Homo sapiens
aatctggcacaaaacttgattttgaatcaagcacccaatagtgattattgaattggactgaaatatggaaatgcgtgtgccatttccctcatgggtctttgggatagagaagaatctcactgtgcactgacaaggtagtttgcttcaaatgtgctgggctaggcccatcagactgggattgggaaatgcaggaatgaaccttgagaatagtggtcattaccaatattttgagtaagtatccagagactaaatttaacaggaaatgaggcccaccttaaccatgagtaattagttcttagctgttgagagttcttactaagtgtgtctttatagttaatatatttatcatttttgccttgcaattagcacaatcattaacctgtagcagaaagtgtcgtatgtattattttccatacttcttctcacagatatattggaaatcatgggatctgggttttagggtctgccctgccacttacaccctgtgactttgtcgagtcacataatctctgacctttactttccttcacagtaaaatgttgggctgcatctatctctaaggttttcttccatttcaaatgttatgattctgtgaaaacataattgaaaataaagtcttaaatcgttatctagaattactctcatttcataacccttgcttattcaaaaaaacagtaatagtgaattgtgtgttttaggtattgaaattgttggcggagatgagttcattttgtggtgacatggaaaaactagaaacaaatttaaggaaactatttgataagttattggtaagaactttttcctttccttatgggatagtcagtatatagctcaaagtctaatttattattaatttctagattacaagaaccagtttttgaaatttcaattaaacaataatcctaataagtattgttagcttcctaggccacatgttgttgtctactttgttttaatcttggtgtttcttataattagggagaaaataggccatctgataaaatcattatcagcatcactgagtgattttcttat

SEQ ID NO: 8764 - DNA, 1589 bp, Homo sapiens
acagtaaaagtaaaatttaaaaaaaattaaaagacagaaatgacttaacaaatccatggggggtaaaggactctagctcttcctacttgttttatgatcttgggcaggtaccctaacctctcttggctcccccaaatttttctcagttgttaagtgataatagtacctacctcatagagttgtaagaatttaataagacaatgaatgtacagcttttagcatggtgcctggcaaatagtaggtattagtaaactgtagctgttgttattaataataccttagtgttactggagaagcagcactggagaagtcaatgtaaatagttttcacaaagacactgcttattgaattgttccattaacaaattcacattttaaattttgaaatgcttgagccatgtgttacctgttactgtcctgtactgtgtggtaaggcagaagtttgatacttgatgaagctcttaatcagaaacaagcaacttaaaattctcttctttaatttactggtcatgtaaccatttctgcacttaggatcattttgctgtagtataagattgagtttaaaaacaaaattgaagtgatgaattgctaattaacaaatacattttcatttaggctgcagtactttgcacggggcctgcaagtttatatcagacaacttcgcttagctctccagggtaaaacgggtgaggccttaaaaacagaagaggtaagaatactggctcacatttcataaactgctagttccataccaaactatatagacttgtgttgggagtttttcattttcccttatctcacctaatttaacagtcttcatcccagtcctaatgaaatattttagatttttattatgttcctataacttaaactgatttattttaaaacaacttctatgtgcatgtgaccttactcattttttagctacattctaacctgtcaagggaacacagattatttgctttctttgctacatctagatttgtttagagtcaagcaataggaatacgcattatctatagatttaaaccaaggaattctgtaaagactgtagaggtgattctgatagaagtgtaattactctagttctatgacagaatggattatgcctcatagaagttattggcaatttgtcttaattttcctttccctttgtagaacaagattaaagtcgttgcattgaaaataacaaacaatatcaatgttttaatcaaggtaagtctgtaataccaagtgacatttctgcagttaccataaaatcatacatttatttatttaaaagttttgcataagatacttccaacaaagggaggcatgcaaacttcttctggctcaaagcattgaaacagatagatacagtctcagaaatttcagcgacttaagttctagtggtcttaattagctgttgggttcttttgaatgtccagtaaatccctgttctgcttactcttaagaatggacatgtggtatgtagcacaatgaaatgtttttctgtgtttgttttttataaacttgactatgtaataaattgagagctttctgtactgtaggctagggtatacctttccattaagccataattacttttca

SEQ ID NO: 8765 - DNA, 1024 bp, Homo sapiens
ttgccctcagagaaaccacctctgattttctgaatgtgttcactaggataataaacacaatgatttcattttcaaatggtttgcatactaatcagcttgtaaaaaaatgtgtcatggcataagaaggtgactttgaatcagacccattctattatacagataaatattagccaaactggggaaaggtccagtgagtttcctgtctcagaattgaattacttttctttctgcagaaaggggggtcaaaaaagacatcaagacatcaccctagtaagacataatggcaaaaaaattgattgcaaaattgactgaaaaggtatttttcaagcctccaagattgtggatcaaaaacagcaaaaccaagctctctctattgttgctaacaagattgctataatgaggaagtttagaagttaatgaagagatttgatctcatttacatatgattaaaagtccagccttgtgataacttcgatcagttttcttcatgggacgacacctttgaggaccatttctctgtggctataaaagtgactgaccaatggatgagagactcttgttctgtacatcacaagtgacttgatttttcagcaaaagatatgcttagtttatatcagtagctgaaacacactcagacgcacatacacacatagcacctatttggcagtattctgagaagcttatgtagctgataaagcagtgaaaaaaactcagcctttagatctacatttgtgtgagtccagttgcgtgaaatactgtgatcaaaacaaaaattgcatatttattgcattcaaagggacattttgtagtctaacctgattttcgaaattgattattgataatttaagatatttttcatagttatatgagttacctttagtaatgatagacaataaataaagaactaagaagttgtcatgaaagtcatagccagagcaggtagataagagaaagaaataaagggcatccaaactagaatggagaagtcaaattgttctctatgcagatgacatgatgttatata

SEQ ID NO: 8766 - DNA, 1110 bp, Homo sapiens
aaaaatagatacagagcaatggaacagaacagagaaccagaaattaatccacgtatctacagccaactgattttttacaaaggtggcaagaatactcattggagggacaaaaaaaaaagggacagtctcttcaataaatggtgctgagaaaactgggtatccatatgcagaagaatgaaactagatccgcacctcccaccctgtacaaaaaccaactcaaaatggatgaaagacctaaatgtaagacctaaaacaataaaactaccataagagaaaacaagaagcacttcaggacattggtctgggaaaagattttatgactgagacctaaaagcacaggcaacaaaaacatgggatcatatcaaattaaaaagcttctgtgcagcagaggaaaccatcaacagtgaaaagacagcttacagaatgggagaaaatatttgtaaactactcatgcaacagaggattaatattcagaatatagaagatattcaaacatcttaatagcaaaacaaatctagattaaaaatgggcaaatcatctgaacagacatttctcaaaagaagacgtacaaatggccaataaatgtatgaaaaaattctaaacactaagcatcagggtaatgcacatcaaaaccacaatgagtaagttggaagttcagggaagagattttatctcatttacatatgattaaaagtcagacattggcacccccatgtttattgtagcactattcattagccaagacatggaatcaacccagaatcaacaggtgcatcaacaggtgaatggctaaacaagatgtggtattatacacaatgggatactattcagccataaaaaaagaatgtcctttcatttgcagcaacatggaaggaactggaggactttatagtaggtgaaataagccagcaatggaaaattaaacaatgcatgttctcactcatgtggaagttttaaaaagttaatcttatagaagtaaaaattaggacagcgcatactagaggctgagaagatagggggaaggaagggatagggagagatttgtgggaggatgcaaaataacataggaataagccctagtgttgtgtaccactatagcatgactatagt

SEQ ID NO: 8767 - DNA, 1065 bp, Homo sapiens
aaatactgtaagtcaaaaatgcatttaatgtacctaccaaacattgtagcttagcctaacctaccttaaacgtgctcacaatacttacattagccaaatttgggcaaaatcatctaacagcatcttttacaataaagtatcaaaatacctcatgtaattcatgaatacttcactgaaagtgaaaaacagaatggttatatgggcactcagtacagttgctaccaaatgcatgtcacttttgcagcattgtaaagtcaagaaattataagttgaaccatcgaaaggtggggaccatctgtatactttgtcctgacataccaaattcttgctgcttattcttggttacaatatttgaatgagagcataagtgtgatttcagttttaaagtgacctactaccaggcaaagggctaagggctaactggattaacagcttttagaaaattagagtggtacataccttttgagaacctttaatattaaacacacccagattagatatatgggtcattgttttccacagtgatcataaagaagtacttatgacttaaaaatctgaattgtccaaccatcattataactttttttttttttttttttgagatggagttttgctcttgttgcccaggctggagtgcaatggcgctatcttggctcaccacaacctccgcctcccgggttcaagtgattctcctgcctcagcatcccgagtagctgggattacaggcatgcactaccacacccggctaatttgtgtgtgtgtgtgtgtgtgtgtgtgtgtgtgtgtgtgtgtgtgtatttttagtagagacagggttttaccatactggacaggctggtctcaaactccaaaccttgtgatccgcccaccttggcctctcaaagtgctgggattacaggcgtgagccgctgtgcccggccattataactttttaagtacatcaaggagtctttcccaggagagatgaaaattcatttgattttttatatttcaaggtttagcagacaataaagataggcacccaccagttacataccgcagacttgtcaacatgcgtatgtattg

SEQ ID NO: 8768 - DNA, 1768 bp, Homo sapiens
cggcttcccatatggggaaggaagcaagtgaggtgcttttgccacaggggggacttatggatattggatagcaaacactacaaatactcactaaacagaaccatttcaggttttacatagaggcaaaatcttggcgactttgaagattttgatttatgttttccttcatattgtcttaatatttaaataactataattctgaattaaaatattaaaattattttgtccctagtttctaacttaaggggaaaaattttaaatgagaatggcataatttaagattatattcatcagtttccaagtgctatttggagaagagtgagtttcccatattgctttcgtgtacctagatgaataccatttaaaaaaaaaaacagtgaaagtgttcagtatatatgaagaataagttgcacatgagagcttgaattaatgttacaacagaaatgttcagttttctgccataaagaataattaaaaagtgattgactcaaacttgtttttgtaggacatcaaaaatgtttatactcttagattggttaagtttaaaatgttcacccttaatctgatttggcagtgaaataattaccctcatatagtgagtgatatttccatgttaccatgtgaacttactgaatttgttgagatagggttccagattggaggtgtagatattaacaatatcttggttaattaaagcaacaaataacatgaacataatttgataggagtaaaatatttactcatgttatatataattggatacatgtacaggttgagtatccctaatctgaaaatgcagaatccaaaatgctgcagtgaactcaaaaagtatcggattttggagcatttcagatttcggattttcagattaggaatattcaacttgtacttacataatgtattcaaaggaaaatgaaattgaattgccttatatggcttgtcattttctttattataataaactgctacagtaacagtgaaattttgtttacttggaactcttagagaatgaatcattctgaataatagaattccatagagcctaatttccagatacttgatcaggttttccctgtagtttaaatttttctctaaaatacttttcataatttcttcacctccttaaagtaagtgaaaatgattataatttttctttacaattcaggttattatttgcatcatttattgttctgtgcagcaatggaagtttgtagggttgtttatcctttgtgaaaaagccataaagtgctttgagatcttgtgtgttcattatgtcctttttaacctacctctctgtaattcctgtctcctttttgcttctggacttacagcagcctcttttcaatgctaaagactttgaaggcatattaacattcttttacacgttgtatatgacacaggagtacatagactctaaacattgactcaggacatcgactcatagtgggcctggcttatagaagcttaataaacacttattggttgaatggatgttgtaacatgttcatgcattgcttaaaaatgggggtgtgttctgagaaatgtatcagatgatttcagccttgtgcaaacatcatagagtatacttaaacacacctagactgtacagcctactacacacctaggctacacacttgtacagcatgttatggttctgtaggcagttgtaacacaatggtaagtatttgtgtatctaaacatagaaaaggcacagtaaaaatacagtattaggttgggcgtggtggctcatgcctgtaatcccagcact

SEQ ID NO: 8769 - DNA, 1069 bp, Homo sapiens
gcatgaaacatcatttaaggaagttactttatcaatcattgccaaatacttctttactattatatcacctgtaaagtcagaatatgtactttgaatgcttgttcttccaagttggagttcacaggacaactgttgcacttgtcattccctttgctaacatttacatgtgatcactttgaaatactccttgagttttgctgaggaataacgctgattacaatggcgaatgaacaataatttaaagcatattaatgactttgttaatccaaaccagcattaatgaaatccgagctttatttatttattgcttgcttgcaggtggattcaccaatgaacttgaagcatcctcatgacctagtcatattaatgagacaagaagcaacagttaactacctcaaagaattagaggtgaggcaactgggcatgtgagatgcagctgatgcttgttgcatttcacaggagccattgtgttcaaagaaaagctaaagcatattattttttaagtctgagtcttctgacttttgcgggaatatactacctgcaatgtgtgtgtgtgtgtgtgtgtgttttttctttatcattttatcaaagtgatatttgagtagtagtaagaaaaacagactactctagcctgggtatatgcgtgattcttaaaactcatttatctttgaacagaatttctgtgtttttaagttttttccatcaaatatgaaaatgatataatctctgaagatattcctagaataatctggataaaatatgaaaagaaagaaaggttttaatagcctaaaaatgtaattattgtttattctcaggtagtaaaaactaatgtcttcctattatgttttcttatggttgacgtgaaaaacattaatcaccttgttccttgaaagctcgaatcttattagtgctaataaaatctgactttttttaataaacatcagttttccttttctctaacatatttccataaattgattttgcttaatagcaaacagtatttgttatttgaaaaactaggttttttttttctcatgaaatctctgctttaaagttacagtgtaaattg

SEQ ID NO: 8770 - DNA, 1049 bp, Homo sapiens
tttctcacacgactaattcggtagttctcccgacatcaactaggtgttctacaactcaatacaattctgacactaactacctggagttagcacagaccccacaggtcaaggactcagtcccacaaggctacctgcacttcagatgccagtcgcaagtcaaggccaccagacaaattagctataaagtcagggtgttcccacagctgcctccccaagttagaacagctcacggaagtcaggaaagcactttacctactattattggtttattgtaaaggatgcaattcaggaacagccaaaggcataagccagggaatagggggaaggggtgcacagagcttccatgtcctctccagaacaccaccctcctagaatctcaatgtgttcaccaacccagaagctctcaaaactctgttgtttaagggtttctacggaggtttcactatgtaagcattattgactaaagtattggccatgagtgatgaactcaatctctactctctctcccctccccgaaggacagggggaggatgggattctgaaagatctaaccctctgatcatgccttggcttttctgggaccagcatctgtcctgaagctatctgggggccacctgcctccagtcatcccattagcatatgaaagacacacattactcctgtgattcttcaagttttaggtttgtgtgtcaggaactagggacaaagaccaaatatatttgttcttaccacatactaggtggcttaaatttatttctcatagtctggaggctgggaagtctaagatcaaggtcccagtgatttggttcctggtgagggctctcttcctgccttgcatatggctgccttctctccgtgtcctcacatggcctcatctgtgtgcatgcttgaagacagagagagatctgtctcttccatttcttataaggacacttataggaagaaatcaaatttgggccccaatccttatgacttcatttagcctttatccactcctcacaggcctgataacacttgaacatatgaactttgaggagacatagactttc

SEQ ID NO: 8771 - DNA, 1026 bp, Homo sapiens
gtctatgaagtgctcaacacttaaaaaaaacagcctttttttattggaaaaaataaaagtgtcacagaatgaaactttatggaacagtaaaggttatcttctctaaaaaatggaaaataacttttaataacaatatgagcaaaatgattaaatattgaatctgtagaaaagtccagaaatacattgatgtggcattacaacatgatagtggactttccaagcatttattaccgtaaaatatttttgaaatactaatctgcaaattaaaaagttacatctagcaaagatattttctactactaaagtaatctaggctgtcttatatctttgatacattcgattttactttatttttaatggtctatatttattatttttcttatattagcataaaaccaataggttctatgtattagaattttatgccacaaacagcaacttcgctgtttacagcatataattaagcattaaacccaagatttctgagctctggtcatttcttaattaattgaggcacacgcctacttaaaaaaattggcccagatccttagaaagaatgaataaatattatgcagaagaactcagactttaatgtttaggtgttcctgtaattgtctgcaagtttctctgtctaatacatatttgatatcttttgtctctggaacaaaaagtagaattttcaaatcatatacgtgagatttaatatctattccaatgtgcagatggattatcttgtcttcacagtgtttctgtatttatagcatctatttatgtaaatcatatctccttttataacttgtttcattgcctgtagttttagtctgtgttcttcaacctaaatttttgtagatttgtaacttgcagcttaaagcaattttacagagttcagatgttgaagaaaaagaaatcctgcactttgctgccctccagtggattatccagcatatatactgcctgcaatgaaggatctttgctttatcacatccttttacattcttttataagaattagtgaaggtatctgctt

SEQ ID NO: 8772 - DNA, 1034 bp, Homo sapiens
ctgttaggatgctattgcaaaaatatcagtgagagatgatattggcctgtaccactggggtggacagggagaaagtgagaaatgatcctatttggaatatattttgaaggtagaaccaaaaagacactcctagaaagggatatgggaaatgaaagaaagagaggtcaagggtgactcttaaatttggaacctgagcaatcaggtaaatagtggtgctatttaatgagatactcaggtctgagaaaggagcagatttggggagaaaaacaagtttggttttggacatgttaaatttgagttgcctattaagtgttcaagtagagatgttgaataggtagttggatacatgagtgttataatgatggggaagagaccaggctagagataataatttatgggtcatggacgtatgtattttctaagtcattagcttggatgaaattacctcaataattactataaaaaggaaaatgggtcaaaaatcagttactagggtattctagccaacatttaaaggtcaggaagaaaaagagcaataaaggagtagccagtaagctagtagaaaaaccattgaagtattttatcccacaagccaagtgaagaaaatgttttaaggggttatcaagcatatcattattattgtaccagcatgctatatcctgagagattgagctggatgtgggcagagaatgaaccactggatttagtaacatggagattgttggtaatcttgtaaaagcttgtgtgaaatcggttttgaaaggaggtgaggaagtgaggatggcaagcaactcttaagttttgctatagtgaagagcaggaaaatgggatatagctggaggggcctgtggggttgaaggtatttgtttttgttattctaaaaatagaaagccctgcagcatgtttcagtaggaatgatccagcaaagtgggaaaaattgaagatgcagcttagggctaactgtagaagcagaattcttgagtagacaggaggggatgaaatctaaggcacaaatgtaagagtagtccttagga

SEQ ID NO: 8773 - DNA, 1030 bp, Homo sapiens
gatatttcaagtctgaactactcagataactaagtattaaatgtaataatgagtaattaacttgtatccacccaaagtttgcccagagtgctttctaggaaacccccctcaatatacataagtagatacaaatctccttttaaggtctacagttcccactgtaagagggggaagaaaaatggaattgtattgtcttactggtccagtaggagctaacatgtctgacaagtggcctgtattgtcccaccttcagtccctcctgtttttaatgaaagttataaactagtgtctctctcgaccctcattgaaaactaacacctatgagtcagtctcaggaagtctgttgaatttgtttccccagtattcttgcttaaagaaaagttccctaggctgaagtaagccagagatttaaattaaaaaaaaaatagctatgtcagttaattttctttttcaatataatttctgcatggaaaagtctcatagtaaacttataatgaattttaaatttgctttagatatgtaatctgatcatttacctttctagaagcatttataactgctgaaagcctggattcttcattaaaatagtttctaacacagcctacatgtcatggtatctgtgtctcaactggtgctgactttgctttccgtgctgtagtcatttaagagaaggccacatggcaagaccaagaggccagatttatagccagttctcctttctctactctaaaaggcagcagggcatatgggatgcaggggcatataggtctgcagaaaccaattcagctctaaattcttgggcaaagcaagtttcaggtgtgaccatgtgtgaacagagtatttcccaggacagaatttaactccagaatatgtagtaaaaggaaaacacacacacatacacattcatatttgggaatcacatacttttctttctttccttcttttttcctgtaaactcttctgacttaatcacctcaccaggagagagtgctgatttctggtctttactatggtctgttttctctttgcc

SEQ ID NO: 8774 - DNA, 1091 bp, Homo sapiens
agcattagcagtatcatctagatcctgcatcgttttcattcttctaatctactatcttccttccttccaggtattacaaaatctcggcaaagaccaatatccacaacagtcgcttgaacagattggcacccgaattgccaaagttttggaaaaggtaagtcaccccacagaaaagctggaaacaattgccctccttctaacttcttttctaagttatttgctcctaagtgtctgtaacctcttctgttagttacttagcacttggtggctaaaaggataatgtgaaataactcccctcagaatgtttcagtcgctttttctatcacttgggtaatattcttttctgtctctttgcctgctttctgtggtgaaacttacctagtcagttttctcttctttaccccagtatgtgtgtatagaggtggtagtattggaaaccatggaatctaggtatatgaaataagtcagatattcttctgatggtgaagaatatttggtattttggatgatggatgggaaacacactttgaaatgtcttttctcttgaaatcatgaaacaaaatatttaccaaattgcattttcgtagagcctacagaaaatatcattgagaggttctaagactccttttcttcctctgtgtgatatttgtgtaaagaggaggggttttttaatttaattttattactttatggctaagaatctctctactttattactgtataatattaaagagctaatttaacatagtcatttaaacaatcaacccaacttcaagtatgaatgcgacactgtgagatagcaacttccttcatcttccgagtatcgcacatggaaaaatcatcagcagactccagttataatgaaactagggcaaacacatgatccccagacttcaaaaaaagtaaggattgccaaaagtggttatgatccacacaaaaaacatacaggatgaattgtagcagaattcaggcagggttagcaatttcagaaaacgtcagcaaaattctactacctgaaggaactttctacaggtagcccaaccaggaaaatcctgagtaataaaaacagagcagacacagcactgatacaa

SEQ ID NO: 8775 - DNA, 1026 bp, Homo sapiens
tgtagtctcagctacttgagagattgaggtggaaggatcgcttgagcccagaaagttgaggttgcagtaagctatgatcatgccactgcactccagcctgggcaacagagtgagaccctgtctcaaaaagaaaaaaaaattcgcctgcataaataaagatcacaaagcaaaaatataaaaacacaggagaaagattagcaatggatataaaaacaggagatagaaaactgaaatatattaaacttgagtgccaggccaaacaggtcagtagtagaaaaattttgtcacagaactgacgacaaaattggaaggagcagcaagaggaatacatcacaaacacagaaagggacatagaggacagaagtgacaagtgacgaaaataagagagttaaagaaaaattgaagataacatgttagaaacatattttaagctctagattcaaataaataagatttgagtcttattctatttctataaaatatattttgttaaaagggtgcactgtgtgccatagaaaactgatccagaacagtcaacagcagtgcttattgaagcaaaattactccatcttggaagaaaaaaaaaagagagaaagaaagaaaatataatcagatttttcaacagcaactcttgattccagaagacaatggagtaacatatttagaatacttaaagaataaaaaaagaggagctatggattttatatgctaccaaactgaccatcaatatagagtccacagacaaattgccattaacatgtaacaaatattgtttccatgagccccttcttgagaagactgtctagagataagcttcagacagccaaaatgaccagagcagcattggtataagggactagtagcaagcattatatatttgtctatagagccaagactgaataatggctctaagagaggcaagacagtatcgtatgttatggaagctcctcagcttaccatggggttacatcctgataaaccattgttaagttgaaaataccataggtcgaaatgcatttagtacac

SEQ ID NO: 8776 - DNA, 1019 bp, Homo sapiens
ttaactattaaaagaacaatattttcaaattgtttaacaaagcatagccaaacattatgctgtattcgagaaatatccaaataaaatttaacaagatttaagataaaaataaaagaatggataaagcatacaaggcaaatgcaaataagagagcaaagtttatgatctccatacctaacaaggaaaaacttagatcaaaaagcttgacatgacaaagaaatatactttaaaatgctaaagactacagtttacaataaatttgtaataataattagtatttatgtatccagaaacaaatgtcataaagcagagactcagggagattcagagaaacagattaaaatataccacataataccagacaaaaaattaataaggatataaagacctaaatagcataatcagtaaggtagatcttattagatatatcaaactctgaactttgattatagaaaatacatctttttgtcatttgaacatagaatattcattcatgaaaattatatcagagcagtgaacaaattccaaggaagaaaataaaagtagcattttctggccagaatgcaaaaaataataataataataataataactaacaatataaaagccctcctacctggaaattctaaaacatgtcatttaaacagctgagtcaaagagaaaataagaaatttagaatttcttgaagatacatgaaaacaaaataacagtctgtagaacagactaaaacagttttcagagaaatttgcatagcattaagtactgtgtcagtaaaaatgaaaaataagaagaaaagatataaacacccaaaaccaggatgaaaaaataaactaaaagcaaaagaattaacaaagaaaaaggatgcattaattatacagaaaatcagtagaaacaatgcatccaaaagttgagtttgaggtatatatcaataaaatggatacatcattagctaacctaataaaggaaaaggagattgccaaaataaaattcgaaaggcagggggacatgaccataaaaat

SEQ ID NO: 8777 - DNA, 1212 bp, Homo sapiens
gctgggtaacagagccagccataagcatatggctttttcccctcaggactttcatcttaatactacttggatgggagactgaagtgagctggggatctctaacaggaaaaagtcttttgggctgaggagacaaacacctacctactagacacctgaggtcattcctgttcctcagttgtggcactctggggattctgattagatctagattagttccttatctagcattaggtctagattagttcctaatcagaattcctggagtgccacagcagaggaacaggaatgacccagacagattgagtcttgccaaactgtatgccccaacttaacattatcaggcaggaatgagttgatcagtcttacgacctctttgcctaatagaattaagggaaaaactgccctgatgaagtataatatctggagccgctgtgattcttttatacagaaagaccagaatacaatttttagaaaaaaatactagatatgcaaagaagcaagaatgtatggttgataataaggcaaagtgcagacaataggagtagatttacagataatagagatattatactcagtggacaaggactttaagataactacaattaatatattcacaaaaataagggaaaagatgaagaaagtagatgaaaaaagtaccttttcaccagagaactaaaaactactttaaaaatcagataagcattctagaacttaaaagtacagtaatgaaaactcattgaatgggtttaataacagattgaacagagcacagcccagaattggtgaactagaaaaatatacagacagaaccacagagaaaataagggagtgtggggattgataagagcataagaaacgtgatggaaaaactccaaagatctaacatacatataattagggtctgggagatagagaagtaacagaatcgggcagaagtgatatttgaagaaatgggctagaatgttccaaaatggatgaaaggtagcctacagattctagaagctcagcagaccccaagcagaataggtacaatgaaaagcacatctaggaaaattaaaagcttaagagccaggaggaaaaatattatttctgtatcagttacctattgttacaaacaaacaaatggctgtttactattacagaacttaacagccacttatttgtttgtaattctgctgtctgggctgggctcagccgggcacttcttctgct

SEQ ID NO: 8778 - DNA, 1048 bp, Homo sapiens
acatgtttaaagtgctagaataagaaaactgcaggcttagaattctaaaccagccaaaatgttcttaaaagattaaggcaaaacaaatatgtgttcaaacaaacaaaaacagagacaatttggcaccagtaggcctgcactgaaaaagtaaaggaagtttatcaggaaaataatccaagatagaaatatggacttggaagaaagaatgaagaacactgggaaacatatgtaaatgaatagtaactgtacaaaataataatggtacaccctgaggagtttcaattttatgtactgtatatctaaaattcatggtagcaataacttaaatgatgagagggaagcaaatagagtttaaaagtcctaaggcttaattggtatcagccaagtagtaaaagtaataatttgcattggccttaataagtaaaaaagcatgttttaaactctaggctaacaactaaaaattatttttaaatgtaacttaatagaaggaaaatggaatcatgtagaacatttgattaatccaaaggaagtcaagggaagataaaggtacataaaagtagagcacaaatagtacaatggcgaatatagacccaagcacatcagtagttacatggaggaagactgtgtaacttaagaattaaatgtaggctagattaaaaaaaaaaaaaaaacggctatataactatacccttgtcagaaaaagtaaactttataataagaagcattactggagttaaagtggaatattttataacactaaagggatctgtggcaggctgaatagtgcccccctacaaagatatccacgttctaatccctggaacctgtgaaaactatatacatacacagtatggaaagaagaggactttgcagataaaattgaggatctggagatggagcgattatcctggattatccagttgggtcctaaagccaatcacatgtattcttataaagaaggagacagagacttaatcctgaagagtagaaggctgtgtgacaatagaggcagagttatgcagccacaagccaaggaatgccagcagcc

SEQ ID NO: 8779 - DNA, 1046 bp, Homo sapiens
atagaagggaacaaatcaatttattaattgtgggaactaccctagtttagataccctaagttccaataaagaatcaatatcttttgtaatagcctcatgagcatagagtcctggagagggacatggcttggctataagaaccgtgacactcagaagctcaaagctgtggcttttcatcaggtatttgtagtttatttacaatcatctcagtccagataggtttaccaaccagtgttattttttaccatatgttacctgtaacagatattagatatttagggaaataaagctagaagtttcatccaacattgttttccattttaggctcacggacggacttccacgaccttgagttaaaactttagggtagataggaattacctggaggccttgttaaaacacaaattgttggtgccctatgacttacttcctagctcagtagctttagggtgaggcttgagaatttacatatctaataagttcccaggtgatactgggtgatactgctgacctgaggaccccacgttaaaaccaatgccttattcaatggcagtgataacaaagtaaaagtgcccctttcctgtttactaaagggtccccatgttcttttagcttcagcctttaaaatactagtcattatttattatttcttcaaaagcccatctctaattgtctccttagggagtttttgagttcacattgacattaattgtcactaactgtcagcagttggcattaaccagactctattttaggattaaatccacctgatccacctgcactatcagaacattcaggacgcgactcaggctgcagctcagagggctccaccggtggccctagacttgcatcaagctgctgccattgccactgcaccagcttgtatgccaggttaccacatagtcctatgtaaccatgtgggctgctgtagagtaattcccctacttttgtcccccacttcctcaggtagaggctcgtagacattacattggatgagcaggcagctcagcttggtcagagccagccgtctgctccacccactttgt

SEQ ID NO: 8780 - DNA, 1043 bp, Homo sapiens
acttgttgttttcttttcttttctttttttttttgagacagggtctcactttgtcacccaggctggagggcagtggtgtggtggtgtgatcatagccaactgcagcctcgaactcttgggttcaagtgatcctcccatgtgagcctcctgagtagctgggactacaggtgtgcatcaccacaccagctcattttttttgttttttgtagagacaaggcctcactctgtttcagaggctggtctggaagacctgagatcaagcaatcctcctgcttcagcctcccaaagtgctgggattacatgtgtgagccaccatgcctggatgtgtttttttttgtttttttttttttttctctttaaaattgaccatattggttgattattcaaatgataagtccaagtcatctacatatgagtgtacagtaaaaggcaagtgatgtaacaccataagtaacatttgtgttgaaaagatttggccccagaggaaggataattgataaattaagggaagtatttgtgtaagatttagatatgaaatttgaactggaacactggaacagcagaggatcatagtatcataattgaagtgaaatgctgacaggttcaatttaccctgggttttggattttttttttttaaatgcttaagcagaagaagtgatcttaaaagaaaatactccctttatcttcaaattctgggactcttcaaaaacaaaattaagagcagctcatcttaaacaggttcttcacatgagttggaggggtgaactgaaataatttgaaaaacaaactagcagagatgacacttgaataattagagttgtgattaaaaatattgttccaccaaagttatgattttagaattgttgtatgtaaatagtactagtaagttttttccctacgaaattactatcttaatctcaagagtctctgttcttatgcagcctttgaatctactttctagtactaatatttaatattttcctctttaaaaccaattatatattttaagtattttattagtatatgttgaattgatactat

SEQ ID NO: 8781 - DNA, 1048 bp, Homo sapiens
gacttccctagagttattgccggccctctttgggaaaacattgttacacagagatagatcagtctaggtattcagataaactcagttaaaattgccttttttaaaatgtcaattggctgggcgcagtggctcatgcctgtaattccaacactttgggaggctgaagtgggcggatcacttgaggccaggagtttcagaccagcctggccaacatggcaaaaccacatctctactaaaaatacaaaaattagccaagtgtggtggtatgcacctgtagtccccgctactcgggaggctgaggcaccagaatagcttgaacccaggaggcggaggttgcagtgagccgagattgcaccactgcgctccagagtgggcaactgagcaacactctgtctcaaaaaaaaaaaaaatttaatgaatacaataaaatgggaatttatgctttttgtaagggatgctacttttgtgcacttcttagttatcatctctcagagaccatttctgtctgggggaaaagtctgatcactgtggtatgggaagttcttctcttacagggactgagtgatggggttattgaaacactgaaactaggttattgcgttgtcatggtaactccataataccatggtgtggtagttgagaagcttgccacaaatctgtatcagaaagaacgctttgttttatttgtcgatttttgtctacaaaacaatgcgtttgccctatctctaactggcaattccaggaaaactatccagtttctggaaagttatctttgccaccatttagtgaagttatttccatttaaataacctagtcattgtggaagagaggaagggctagacagtttaagaacttgaacaattggtgcctctcaagagtattacattgggaaacagtatagctaacaaacagattggctttggagtcagtgggcaagctgtgctgttactaagctggttgaccttaggcaaaaatagttaacctctgagcataacttctttcattttttagggggatgatacttttcgggattattatgacaattaaa

SEQ ID NO: 8782 - DNA, 1049 bp, Homo sapiens
ggtgtgatctcagctcactgcagcctctgcctctcaggttcaagtgattctcctgcctcagccccccaagtagctgggactacaggcgagtgccaccacaccctgataatttttttgtatttttattagagacggggtttcaccatactgaccaggctggttttgaactcctgacctcaggtgatccacctgcctcagcctcccaaagtgctgggattacaggtgtgagccaccgcacccggcctgaacaaggctttaaaccacctgcttcctgcttccattgacctctgacctcatctccactactcttactccgttccacccacatacacctcttgctgttccttgaacaaccttggcattgttgctttggggcctttgctttttcctcttcacggaatgctcttcccccagatatccatgtgactgacccttcttactctccttcaagtctttgcagaaatatcaccttttcaatggaaccgcccctcctacctataaactcacagtcgtttctccctcactcccactcctatccattaccctgccccacttttcctttttgtcatagcacttgtcaccatctcccctactgtatactttgctcatttatgatgtttctgttagaatgtgagcactgtaaggcaaggatctttgtcttttaatctcaagcacctagaacaatgtctgtacacagtaagtgccaatgtacctttgttgaattaatggaaatatctgttaagtaaggtattcatacatatatatatatatatatatatatatatatatatatatatatatttttttttttttttttctgagacagggtctcactatattgcccaggctggcctcaaactcctgggctcaagcaatcctcctgccttagcctcctgagttgctgggactataggcatgtgtcccagctgtgtctggcttccagtctttttaatattaagggataatgatttttgtgaattatcttctctttttacattctcttatcagctacaaatctaacaaatattagcggtttcccaacctctaag

SEQ ID NO: 8783 - DNA, 1127 bp, Homo sapiens
tatgtgtgcatgtatcacttcatttgctcaaaagtgtatttgcactataatatttcatgagtgaatacttttttccttgaggttctggtgtatttcaattggggggtcagatgttttgctttagttttctattttttgttctactttgcaaaataatttgtgaactgttttttctccttcttctgaaacctcaagtgctatacatctaaaaatgctagattgaaaataaaccaaggctggttagacaaagctggttacagagttatgatagcagggctgtcatactagttttgaaaatgtatagtgcactgagatcaaaaagatgtccttgaatagtattggtaacaggctaacctttcttcatctgtggtatcaggaaattacagggagttacagggaactgaacactctgccatatttaataaacattaaatataaatttggtagtatatttattattctttcccaaatctttacaaaattgttgtgagtagattttcctttagtaagaaagatttctccaattaaagttttagtaacaccttgctaattggtaaggcttattggtaagactaattcgtgaaaaattaaattctagagtgtgttgaccaaaatgtagtttttaattttgaaattgtgataaaataagtccataccttctggaactaccattctttttgaattgttgaagactctggaccaaattccctggaaaatctctttgatagtaaatacattgaatagtaagcatatagaaccagaaactgctataaagttaaccatagagcattgagtatatagtttatttgcttcatggaaataaatgaatactacagttggttgacaatttttacacaagtttagtcagccattttgtgaaaaaacttgagaaaatgaaaaaaatcaggaggcagaagagaatcatgatagaatagcagaactggaagggatgttagcaacctcttcacttcaattattagggaaatacatgctggaaaaggtaatgacttgcccaagattatgcatccagttagagaatggccaggccagacagttcagtggcaaagggcagaagtggtggatgcatctgtggtagattgattaaaagcaacgataggagcgatgag

SEQ ID NO: 8784 - DNA, 1063 bp, Homo sapiens
ggtacatctatatgtggatacgttactgtcctttgtgcatatttctttctaattacgttccaaatccaataagaagtcaattgtattcatcatcctgggggtatcatcttaactctgccatttttccatattaatgtattaagtataaaggttgtgaaatccatttcagatgctcctggtttgggaagtataaggttacagattcaatggcatttaaatttctttttttcctctctcctctttttttttttttttttttttttttgagatagggtcttgctctgtcacccaggctggaatgcagtgacatgctcactgcagtcttcacctccccggctcaaataatccttcccacctcagcctctctagtagctggaactgcaggtgtatgccatctttcccggttaatttttgtattttttgtagagacagggtttcactatattgcctaggctggtagatttctttatttttaaaatagaaatggtggggaaatgtaccatccgggtcactgaaaagctggagcaaagatgtatggaactcagggacatggactctactttgcatccctggtggggtgggggtgtgtccttactgatgtagactttaagaaccatgagagcctgatgtgtgtgtataaatatggctttaaaaaagaagacagagattgtttatctttaatagcagtaatataaggccgaagtctaaaaggactctaggataataagaaatgaatcctcaggctggcatgatggctcatgcctctaatctcagcactttgggaggccgaggtgggcagatcacttgaggtcaggagttcgagaccagcctggccaagatagtgaaaccccgtctctattaaaaatacaaaaattagccgtcatgaggatgcatgcttttaatcccagctactttggaggctgaggtagaagcattgcttgaacctggaaggtggaggctgcagtgagccaagatcacatcactgcactctagcctgggcaacagagtgagactctgtatcaaaacagaaaaaagacctcagtctgtgaagactttggtcata

SEQ ID NO: 8785 - DNA, 1032 bp, Homo sapiens
ctttttctattgattggaatagtttcagaaggaatggtaccagcttctccttgtacctctcgtagaatttggctgtgaatctgtctagtcaccagctattgagagcttggaatgtggccagtgtgactgacgaactgaatttttaattttgtttcattttaattaaaaattaaattaatagcaatgtgtatctagtggctaccctgttggactgcactgattttaagtcctcctgctaggtgataggtgtatctgggattgaattatgactctgatggtgcatatgtgtatctgtttagtcctttgaacttttataatcctgcctgaggtactataacatgcaagcaccttgttttcaaatagccacatttatgtgaaaagaagaggaattgtgttctgaaaactaagttaagtttaggttaaacctgaaacttaacttaatttaaaaaatcctctgactttttaacaaacccgtagattaaattgcatttgccctttggatgtgtctcaaaccctgaaggttttcttctgtgcttttgagttaaaatgcaggtagcatataacaggtgactgcaaaatggagggactgatgaaaacaaaacaaaagcaaccacaaaccagaacttatatctactctgtaggaattttgtttgaaagttggtatgcttttctgaatgtccttaagtataacaagtcttcctactctgagggtaaacttgggtattataaagaggcaatttgtgcttacgtctggtaaataatgataaaatacttgagtaatactttataatttgccaggcagttgcgatttcatcttctccttggaatattaaccccattctaccgacaagagaaccatgatttaatcaaggttctcattcatttcgcaaacccttattgatcacttactattgatcaccttgctattcatgtagatttctatgttaggaatgaaagaatagttcctctcctggaggaattaacaatctagttgggacaattaaacaaagaaacaataaattatactgtact

SEQ ID NO: 8786 - DNA, 1159 bp, Homo sapiens
acttttagatgattcttgacgttgagaggaggctgaagagtgtaggggttgtgtaattatttctaaataaggtgtggaaaaagcagtgggtagggtcataaaaggttagttttccttttataatctccattcattcactcatccattcatacagtaaaacctcattaatcacctgctttttgccaggttctgtgctagcagttagactgtgatgatccagacagaccctgctcttacagaatcctgtgtgatgaatgtcatgatgatattgtccaaaggacgaccagcatggctagatagtaggaaagagagttttattggcaatatcagtttgcaaaacagagagtctccagcatgaaccgaaagcactctccaaaacaaaaagaaaaaaactagaggttttataaaaagaagaaatgttacctattgctctttgagaaagttcactggctttgggtaagggtttggggaactggcaagtcctgattggtgagcaactgctgtggacaaaattagttccagagttgcagcaaacatagataaaactggtgtcaggttacaacgagcagtttcagcagtcaagcttgcagagaattacattcttggagcaatgttttgtaccctaagggcttttccccctggcttcttgtctctgtttcagtcgggtgtgacaagagtgacccaactggcatgatcagctttcacaaagggggagttcggagtactatggggcagagaattctgtatgaggttctaagttagtctacaggtcaaggaaggcttaatgggagatgagacggtttaactgaaaaacctcaaggatgggagggaaacacagctagaagtgtgtcttagttcatttgtgctgctataataaaatacataaagaacagaaatgtattttctcacagttttgcatgccaggaagtccaagatcaaggtgctggtaagttcagttgtctggaaagggatactgtgtgtttccaggatggcaccctgttgctgcatccttcgaatgctgtgtcctcacagagcagaaggcagaaagttggctgaaggaacacttcatgaagattcttttataagggccttaattccactcatgagggaggagacttcatggcctaatcacctcttaatgtctccacttcttactact

SEQ ID NO: 8787 - DNA, 1044 bp, Homo sapiens
atattaaagtttcccagggaatatttttcctgaattctgtgggatcagtaggaaaaacatagaattccaagagcgttcattgcaatttgcccaagtatggctaactaccatgagggttagtgaaaaattaagaagaaaaaaaagacgttttctcaaaatattaagttttttctggttctatttagtcttgcaaaattaatttttgttccattggtcagcagcatgcttttacaaaatgtttaattttggaatatagagtcctataaatactaactcaatttcctggtacaatttgtcagattgtctgcttttgtggcaatgttgggttacactgagcaggaagcctgacttacactgagaatgagttgattctctgcagcatcagtaatagccaagagtccagatacagcccttgctgaggctaattagtcttttgatgatcttcctaaagactctattttctgacattcagtttatggccggggcccttagacaagcttgaaggaaatgtagcaaccacctgttaataagactgatggttaatttattataataattaccactgtcagaatggaatcccctagtgggatataatatggaactaattaatatgatttagtcagtgattatcctgagggtatgagccttatcatggacattaaaggaattgatacctccagagactttcataatgtgtgtttttaaattgccaactattaagagtattttgtacttgttgataacgtaatcttagcaatcaatttgttcatagttgtgccagtctttgcatagaatcatgaatatgtttctattcatcctgaaaagtagtacatgttgagccatatttattattaattacaccttgcctacacataattgaccagggtgttgagcttctcttattgatttaatagttcttcccatatcatgggcttgataaacaaagcaggtctcataagagagctgaactaattaaagatgtggaatatgctatgtatctagttacacctaatgtcctccttgctcagtagtgctgcatagcgg

SEQ ID NO: 8788 - DNA, 1018 bp, Homo sapiens
atgatattggctgtgggtttgtcgtagatagctcttattattttgaaatacgtcccacaatgagaacaaagacacaacataccagaatctctgggacacattcaaagcactgtgtagagggaaatttatagcactaaatgcccacaagagaaagcaggaaagatccaaaattgacaccctgacatcacaattaaaagaactagaaaagcaagagcaaacacattcaaaagctagcagaaggcaagaaataattaaaatcagagcagaactgaaggaaatagagacacaaaaaaacccttcaaaaaattaatgaatccaggagctggttttttgaaaggatcaacaaaattgataaaccgctagcaagactaataaagaaaaaaagagagaagaatcaaatagacacaataaaaaatgataaaggggatatcaccaccgatcccacagaaatacaaactatcatcagagaatactacaaacacctctatgcaaataaactagacaatctagaagaaatggataaattcctcgacacatacactctcccaagactaaaccaggaagaagttgaatctctgaacagaccaataacaggatctgaaattgtggcaataatcaatagcttaccaaccaaaaggagtccaggaccagatggattcacagccgaattctaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgat

SEQ ID NO: 8789 - DNA, 1029 bp, Homo sapiens
agcatgagcccattgtaattatgataagtaaatgaatgaaatgaaatttttacaaggaatgggatttaatgtagtcttaaagtatcttcctacagaatacaaaaacttgcaaattaaaaaggaaataatagtaacttttatagtggaggaaactggcagacactaccttaataagagacaaaagttatcatcatcagtactgggacaaatcaaaatgatgtgccacctgatgggatgcagtgagaaacacagcatcacttctgtgatattctggccaaaagtgcatatcctgaatctaatcatgaggaagcatacaaacctaagttgagggacattctacaaagtaattggcctgtaataatcaatgtatcaaggatatgaaggtcaaggacagggcagaaagactgttccagattgaaggaggctaaccagaatggtagctaaatgcattgggtgattctgacttggatccttttgcagtaaaggatattgttgggacaactagtaaaaattgacaggctctgaggattagaagatagtaattattcatcaatagtaattattcctcaatgttaatttcttgatttcgatggttacatcatttaggagactgcagtaagtacatactaaggcagcattctcaaactttttagtctcagagccctttttactcttaaatattattgaggactccaaagagctttttttttttttttacttttttttttaaattatactttaagttctgggatacacgtgcagaacatgcaagtttgttacataggtatacacgtgccatggtggtttgttccacccatcaactcgtaatctacattaggtatttctcctaatgctatccctctgcttgccacccacaccctgaacaggccctggtgtgtgatgcgcccttccctgtgtccatgtgttctcattctcattgttcaactcccacttatgagtgagagcatgcggtgtttggttttctgttcttgtgttagtttgctgagaatgatggtttccagcgtcatc

SEQ ID NO: 8790 - DNA, 1075 bp, Homo sapiens
gcttagcttcattctccactttttatgccagagttgcatttctgcctccatttctagttagttgactgcctcgagcagttcataccagtttttttcttcttggtgtttggtcttagccactaggctgagaggcagttggccaagaccatctgataattattttcatctgaaaataaagttgggatgggtcatgactatatgtaaccacaactgtaagtagtgggatgctagctcatacaatttcagataccgactgatttgtcaataggcatcaatagtattgagtatctgtatatatcatggaattctttaagtctttaagaatttacaaccacaagattttactgtgagatatttaaacaaaacatttgaataaatggagagcccggagggaatgccacattgtcattctttaattgaaatgtttaatgtaatcccaatcaaaactgagactaaacaggtgaggataagcaataagtttttaaaaaagaagaacaaagtagacttgcactactagaaatgttgaaacccattttagatgtagcataactaaaactagggcattgtgaaagaacagaaaaataagataataaacagactatacttctggaatcagaatcttgtaggtacaagctgtccaatcactttaaacattcaccgggatcagccattggatgaggatgctacggaaagagcgtgatcttggacaaggcaactctgcagctgaggctgacacccaaaagctgtctgctggtgatactcccacaattagggcaacatgagtttcactgaaggggtaattgtgtggctcatatcatattcattgcaacctccaaatccaattgtttgtgcatctttatcctacacacttgtgggatattgattttaacttatttcaactcctactctggaaaaaagagagaggctgtgtcatttcttagacctttgtaatgaggcaaggatcagagtcccagaagaagtactactccaaaaactttggtaaagtgcttattcttccctagcagtaggctgttgctgagttgtagactggtggttttatgaaaaaaaacaggtt

SEQ ID NO: 8791 - DNA, 1064 bp, Homo sapiens
ttggaaaggaaacgtggtgggagtctgctggattcttctggggaaattttctctctataaaagggacatatcacagagacatacaatctctgcctccgaacattgttgtctgcatgcgatgcatggaatggcaatggccctccaggaaaggagccagcctaagggaaaagagaggagggtgggaaaatcccagatcatttgtgccattgttgagcaactgaacaaaacagaaccaagtccttgtcttcttgaagcttaatttgagtcaagacatatagacaagcatgtacattattaaaatacactacctagtgtattagaaggtggtaagtacaatgggataaaataaagcagggaagggcatgaggagtgctgggggggatggttgcatttattaaagggtgggcaaggcaggcttctctgagaaggtaacatttgctcaaggacccaccagagacaagggatgtggaagagcattccaaacatagggaatggtaagtttaagtcccgagtgtacgtggacaacattctgtatctaaacaactgctaggatcccctatggctagaactgaggagcaacggggagagtagttggaggtgagttcagccaataaactcacaccgtttattaggctgttgccacagccttttggctcttactctgagtgagagggaaatctctggaggtttgtgaagaggtgggtatcatggtctgacctacgttaaataggaaaagccgggaacgatggtgtgtgcctatagtcccagctactaaggaggcttaagcccaggcttgagaccccatctcttaaaagaaaaaaaaaaatggaaaggctcacaatagaggcagtgaagaaaagttgttttttaaaaaaggcagtggtcactgtattagtacatgattctgggaaatctaggtatgagttcagaaattttaattaacctgaaaaacttgtaccagaagccatttgcttatgctaatgtgaatacaaagagcttgctttggttcattactaaataacattcttcgtgaaagtgtcattgaatctttttagcaacatatc

SEQ ID NO: 8792 - DNA, 1043 bp, Homo sapiens
ccccagtatttttgacccgtcactggttgaatccatgaatgtggagctcacagataataggactgatggtagttatattgtaataatcctttaaagtggatggtgctgactcatttacatacagttgaggaaatgaaggcttagaataatttattcagccttttgttcactattaccccccgagaagactttagagatttttcctaatctaactctcatgaaattttaataccacaaatacactgtatagatccgattatgtactatatgtatatctctgctttataaaaaaaaatacaaataagattcccaccccaccctgaccaaatttcatctactctgtggagctctgccccagttgaaaatggattgtttagaagggcacataaagattgagtggttcagctggggttcagtcttgtatttttttttctaagtcttataccccttttgttacatctcagctaccttgctcttattaccagaaacagatacttttattgggataatcagaatattgaactttgttatggaaacaattcagaaaattgtataggaaaaaaaatgggctttgttaactttcccaccgctctttgagagtcgtttctagaaagaaacagggcatctagttccaaaaaaaactaaacttcctcattaaatctgtttatcccactgccaaaattggtgggaaccaactaattgtcattgtttgtttagttgggctataaaagttggataaattaagataatttttaaaaacattttctaacatttctttagtcgtaaagaccccacttccctttctcatcctataaaagaatggtcttttacatgatttccataatagataagacagttgttaaaaatcagttaaacaagtatagccctgcatagtactgttgcacctggctttcacatgctatcctttcccagctcctgcctggtccatatcacacatcaccatgccccatataccgacaccactactccctcacttataggaagaccaataggtaaaaatgaatgcaaacacaggtctggtt

SEQ ID NO: 8793 - DNA, 1050 bp, Homo sapiens
cctttataagtgaacacttgctccactaatgttcttggtgaattattttttaattggtgtccttcctttttcagctgaatgcaaactctttgttatccttgcctgtgccaccactttcctcattaaaccttatggatttggggaagcaattgtgttgcatttttctcccgaaaacctagtgtttcccagaaggttctaggatagagaatagttgaatataaatattttatttactaaactaaaagatagtttgagcaaagatacccatcagagttaagatcagagtaactctgtctctgtgtatacttacattttcaaagtttcttaacaaaagacccaagagtattattagctacttggggaaaggactagttagcttccaaatggcaaactcctagttaattggtttgggatccagagatggcttccttataattcagtccccagagaagcaaaggaagagcaatagatgtaggcctaggagagagaaccaaggcactacaggaacagtgctgaggaaaacttttctaggattgcttggaaggaaggaaaatggagcatactaggagtttatgcagcttcctggtccctgttgattaaggaagtcacaaataaaagagtcttatttcttcagaggctttagaaatacataatgctacagattctcttcttgctgttctcaatgttataaatagttttaagttgctctcatttgaagtgtaaatacctctaaagggctaatggcacctgttatttaattcttattggaactagtatattcagtttattccttgtctacttcttgctgggtcagttggctattttagttagtgaaagacatggaaaagtcattttaaaatggagaacaatagtcttaaaaaaggaaactatgtggtaggttgataatcagtggggtgcagagatggagacacgcagaaggacaaaataaaattatgttgagagagcaccaaaggtaaacttaatgtagttagaattattatcccctactcccgctttttctctgtagcccagtatatgaggatcaggctt

SEQ ID NO: 8794 - DNA, 1090 bp, Homo sapiens
gttgttaactatagtcaccctactctgctattgaacattagaacttattccttctatctaactatatgtacccactaaccatcctctcttcatccctcacccacccacacacacctgccccaccttctggtatctattattctactctctacctccatgagaccaacttttttagctcctacatatgaatgagaacatgcaatatttgtctttctgtgcctggcttatctcacttaacacagtgacctccagttccatccatgttgctataaattacaggattttattcttttcatggccaaatagtattttattgtgtatatatactaaatttttctttatctatttatttgttgatggacacttaagtcaattccttatctttgctattgtgaatgatgctgcaataaacacgggggtgcaggtatctatttgatatactgatttattttcctttggataaatactagtagtgggattgttggatcatgtgatagttctatttttaatattttgagaaacctccatactgttttccacagtggctatactaatttacattcccaccaacagtggataagaattctgctttctctgcgtccttgccagcatctgttattttttggctttttaataacagctactctaactggggtaagatgatatctcattgtcattttgattcagatttctgtgatgattggtgatgagcattttttcatttatctgctggccatttgtatgtcttcttttgagaaatatctatccatatcctcagcccactttttaataagttttcttgttttttaaactattcagttgtttgagttctttgtatattctagatattagtctcttgtcagatggatagtttgcaaatatattcttccattcaacaggtagtctcttcactctgttgattatttcctttgctgtgcagatgctttttggttgaatatgttttcttatagagctatgttaaatagatgttcacattttcattgtgtgaataaatagctttgatagctttcctttgctcaattatcagagacacagctgaagactctctattgtttgtttttgtttttgt

SEQ ID NO: 8795 - DNA, 1054 bp, Homo sapiens
gggtacgtttttagttacttggattcagatcctatttatggtaagcaggtttctttggggtagagggagggcagatgtggacaaagtggctatttgtggtatcctaattctgggtatgaatatcctggattccaggggctttgcctggattctagggtgagttgttatactttattctctccatgtgtattatgataatacaggtgattaaagcatcttgaattttaatgtaatcttttaatttgagcttttgattgtctttttgaacattatgcaatcatgttttctttgtactgttctctctaaaaaatgaccaaatgccaaagattacatgatatgagaataatttgcttatattgtatcatttttcatactaaattaatgagtgggaaaatctacattggctcctgggtataaaataaagttccttctacaaactgttgattactgacgctacaggagtaaaacagaaaaagttttattcatattaggtttcttttagaaataagattgtggaggcttttctaattgtaaaaacaatgcaagattgttgccaaaagtatgagaaatatatacaaacactaagaagaaattaagtcacttttagtcgtaactgcagatggttacattttaatataacattttcaaggattttctaggccagccaatgcatttttgctgaataatctaatcatctaaataatcttaatctaatagtactgattttgattttgtataagcgaaataagcctcttatttatttcccagccagaatatacattgctataccagtaaatactagtaaatattttactcttgacattgaatcaaattctaaatttagctgtcatcaagacattcatttttcctcatatatttgtatactttttggctagcttgcatataaagtgataacaataccttaagtgtgatataacatatatattaaactatcccctttagattctaggcatctaggattttcttgtggtgaggattaatgatactgtcactgaaaatatatatgtatataaagaggaaacactttccctgc

SEQ ID NO: 8796 - DNA, 1070 bp, Homo sapiens
gtgacagaaggtagcattaggccttgtgaacagacaatcaatttctaaaattccgttaataagcaagactgtctcctctctcattctcacaacttgtttccctcaaagatcttttctccagattttccacctagtaatctggtgtgactagaagctactgtaaaaacacattagcatttgtcttctgaaatattttattttgataaacttttgtttttccctaataatgaagtataaactgtcatttcatctgtcattgtgttttgtcatatgaattcattcaaggtttaaactttgaatgaatttgatgaaaaaataaagactcaaatgtttgtgagggaaagcacagtcgtcattctgtgtgaatacatcagaatgttgaagtagaatagaaagagaacctcttattaattctgatcaaaggggcaaaaaaaatgtagtctaaatgaagctcagagttaaaaatgattggtttttctttggcggtgtttatgcccacaaattttttggactaggagtatttatcagctgattctgcctcgtactccagcccacacatgtttcctgggtgatcttattaaaatacaaatcagataatgttgctttccttcctagtcctccagtggctgcccataaggtttaggattaaattcgaactccacaaggccatctcctttcttgccactccattgtcctccccgacgttcaggccagagtggacatcccagtgtctagtacatgctctgccctctgaagtgcccatgactggctcctctgttggcatcctttccccaactcctctccagttcttctcactgtatctcctcccagccctatttgcacctgaaccctatggctgctgtccctctctcaaggcttgggccacagttcccctgccctggaaagccttctctcagctccttggcacatttggttaggcctttctttgggctctcgttggagctccttgtatacctctgcctgctactgtctggcccttccctgtctccccacttccatgtattctcgagaacagggctttttatcttatttgtctctgtgttgctggc

SEQ ID NO: 8797 - DNA, 1601 bp, Homo sapiens
gaggatcccttgagcccaagagctcaaggctgcagtgagctatgatcgtgccaccgcactccagcctaagcaacaagcaaaaccctgcctcaaaaaaaaaagaagaaaaagaaaaaaagaagtatcattgcagtgatacttcacacatgtgagataaacaatacattcactctttgttgaactaccatgcccaggttatttcaaactacagaaggacctcttgtatcatgactcaggacttgttacaatagggtttccttatactctgtgttgaatcacatccaaaatgcagcaagcttaagcaataaagaacctaacattattgaagttcctctaaaggtcatgtccagatttgtcaccctacacccatccagtcaggtgtcttttagttacccaaacagtttccatattgttagactgtgtttcttctaaaaaagaaaaaaagggaggtggttctatcttatcaataaaattgtttataaaactcagaagtagaatggtgagaaactagggaagaaaagtagtaacgcaagtctgagaaataagatgtctattttagaaggatcaaagctgatagaacaagcttaattagccataaattatggagaaagttggcattatcccattagaagaataaagtatcaaagatctcctacttggtggttctgtctcaatgttgagtttactaagtgtgaaaagtatcctatcctgaatctgtgctctctggattatttaatgctttcctttttaaaggttcaaaaaggtagatttctgcttatttttaatactttctctggtctcaaactctgttttattgagagattgatttgttacaatttgttttatggtatcatgtgttctatcaagttggctttagatagccacttctcttttcttctctctctgtaaagatacagatgtttctaccactaagagcagtcaagcaccactgtacattctgagtttgtggccttactaatcaatggcatgttttctggggtgggtgttccctttctagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatggtaggtagattttttgaatcacaaatcaatactttctggcttggggtttctttcccattgagttacaggatagtatgtaatagattagcacatatacattgtccagccatagtaacaagatatctatatcttgttataattataatggtcgtatacccaagaactttaaaatctacctataaataaaaacaacactataataaaacattaaatcatatgcttcaatttagcccaaattgtaggctataattacatatctctctcattctgtttccctagggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacg

SEQ ID NO: 8798 - DNA, 1224 bp, Homo sapiens
ttgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacattgtttgcccttttttcctctcatttcattgtagaaatggtgacaccacaatgacctggacagtattttatctgctttcacacattggttggttagttggttggttggttggttggtgagttggttttagtgtagtggtggtagatagaggagggattctcttgcaagtatacaaaatactctctttttcttttatcccagttagaaaatagttgtaggctaagcacagtggcttacacctgtaaactcaatgctttgggaggctgagacaggaggattgcttgagcccgggagttcaagcccagcccgggcaacgtagcaagctcttgtctctacaaaaaaattaaaaaataaaaaattagccaggtgtggtggcacgcacctg

SEQ ID NO: 8799 - DNA, 1191 bp, Homo sapiens
ttctatttttagtaagtatctgagtttatttgaattacctcctttgcctcaccccatgattgagtgtatgcatgtatacaaacatgtatatatacacatttttattgcttttccattcatatctttacattatgatttatttgacctgttaattattttacagtatttttaaatgcacagacttaagagttttataaatgtatttccttttcaaaaaaattttgtaatgttaatatcactattaataagacaattttatattttgtgaatcctgataaaatgtgctgaagacacaacattaattatgtgatattcctgccaaaaatgcataacatgaacatagtagagagaaatatcagaaaaagataaaatgaggaatatcctacaaagttaccagcctatacttctcaaaaatttcaagttaaaggagactaaagtgacgtgacaagtacctgcagcacgtgtttctggactggatcttggtcaagaaagcattttttaaacttttgttctttcggacatttttgagacattcggtaaaatttgagtaaggtctgtaaattattaatagcattatatcagtgtgacttcctgattttgataataatgtcatggttccttgaaaaagtccttgttttttaggaaatagacactggagcgtttagggttaacggaatattgatatgcaactgaatcacaaaaggtttaggaaaaattatagagagagaaaatggtagagtaaatggggtcagatgttaacctttggaaaatctatgtggaggtatatggatactttgtactgttttgcagatttactgtaaatctggaatcatttcagaatagaaagtttaaaaatagcttttgttctaactaattgcatgtggtcaaagaacatgcgagtatgataaagcctgggcaaatttttatagcctttctctgcctcagctttaccatctgaaaaatggaaataatagcacctatgtcatatattgtttgagaggaagttaagacacttaaagtactgagaactcatccaggcacaagtatataaatatatgttgtagtaggctgaataatggcccccaagacatcaggtcctaatccatgaaccctatgttaccttacgtggaaatgaggtgtttgcagatgtgattaaattggagatcttgagatggggagattttcttggat

SEQ ID NO: 8800 - DNA, 1498 bp, Homo sapiens
ataatggactttggaacatcataagtctgatcaaccccttccctacttacatgctattgtaggccaatattctaacctctgattttattattattattactattattattattattattattattattattattttgagatggagtctcgctctgtcaccgaggctggagtgcagtggcgcaatctcggctcactgcaacctccacctcccgggttcaagcgattctgctgcctcagcctcccgagtagctgggattacagatgtgtgccaccatgctgggctttgttgtacttttagtagagacggggttttgccatgttggccaggctggtctcaaactcctgacctcaggtgatccgcccgcctcacctgcctgtaatcctgcctcccaagtgctgggattacaggcgtgagccaccgtgcccagcctaacctctgatttttagaaccccataagttagacatttttattatcttatacacacatttttgtataaaataaattaccacctgtttatcaagttccttgtatacctttatttcctacatttgagatattctggtgcatatcataatttgacattactttttttctttactggtgctgtataaaatagtggtgtgatttagcattgatggcatcttaaagttaatgaaatactggatcatattactgacttctggcttccattgttgtttttcagaaatcagtatggtgccttttgttgtaggtgatatatctctggcctctttggcaataccttttgacttggtgttcctcagtttcatgccaaggtgtctaagtgtggaactctttatttattctacctggtttacagtatgcttcctgtatctatgaattcatgccttttgtcatttctgaaaatttatcaggcattatctcattgtatctatctgagactcaagttacaagtgccaagtcttcattctgtttttctgtttgtttgtttgttttgagacagtgtcttactctgtcacccaggctggagtgcagtggcgcaatcttggctcactgcaacctccgcctcctgggttcaagcgattctcctgcctcagcctcccaagtgctgggacaacaagcgcccaccaccatgcctgcctaatttttgtattttttttagtagaggtggggtttcaccatgttggccaggctggtctcaaactcctgacctcaaatgatccacccacctcggcctccaaaatcatgctgggattacaggcgtcagccaccgagcctggcccattcccttttaatctcacatttatactttccacccttctctccctgagctgcatgctgcatcatttcttcacatctatattgcatttctataatttttcacaccttttctgctgttaaaaccattcactataattttaatttaaaatgtttttcattttaaaaagttctatttggggccaggcacagtggctcatgcctgtaatcccagctctttgagaggccaaggtgggaag

SEQ ID NO: 8801 - DNA, 1031 bp, Homo sapiens
attaccttgcagagattcatgctggttcctagttcaaaaaacctctctgggttgaaacattgagtctttgtgcttgtcatccttcatgtgctagaggatgagaaaaaactagaactagagtaaactgaaccagagtctagcatttcaggaaaatgaactatttcttctcctaatatccctctttcccaagcttttctagctgtattccttctgtgtacaccctggtatgcatttgctgtggggctgagtccttatgactgacgagtgaggtcaatatgcctttttctgtttctcaggctcttttgctatttgtgaaaaaaaatctgatgtttttcttgttaactttgtatttattctatggctgcagttctcagacttccgtctgattttgctttggcttgtttctgctgctgcttttgcttttaaaaaatttccatgaaagtagatgaagatattctagtatataaattaagctcatccaggggatagagttaaggtccaagaaatagctccctgtttagttcctggaatcttgcctttggcaaataatgttatgttttattgaaagagactttgaagaaaatggagttttgcttatggcattgggatacacagaaatgtgacacatttcagagcttctagaaatttgtaattgcaagctaccactttactaaaatttcagggagaaaacattgactgagggaacatggccttttcacgtaaggagatagctgcatgctttggtttcaagggctgcatttagaatgtgagccagggaagtgccgagaccctttatatctgaggttgattttgaaacgtggagataatagaattaggccagtccaacatagcctgctttccttgtttctgtcagagttaatttatcttcttgtcagtagtcatagcagagaatttgaggattaaatgggctgtggggaagttctttctcattcattctagttaatcttttaaaacaagatttctcaacctcagtagtattgccattttgggctggataattctttcttgtg

SEQ ID NO: 8802 - DNA, 1021 bp, Homo sapiens
ttccctccagatccctcctatgacgcaggggaattatgggagctataattcaagatgagatttgggtggggacacagccaaaccatatcaggggctgatctcagtggatccaagctttccaaagtgttttgggagttaagagtgcaagtatgccccaaacggtccccaaagaagttaaaggcttggagagggactggggacagtggacagagggtctggggtgttctggccagaaagtgacaggccctcgcccactcctgcccccagaggctttcctgatccccaccccttactatggcgctatcacacagcacgtgtgtctctatggcaacatccggctggcctatgtctacctggacagtgaggtaagagtcttgacttcctaggtggaacctgggcctgcctgtggtcaagagtttcctgggtctgaatttgagggtggtccatgctgagggctctggggttgtgatgagtagggaatggagccttctgttgctgcatggctgcctgtgcctgggttccccagtggctccaaagttccagtctctgagatccctggggttgatgtagaagccaagagccagacccagaaacagcaaggtaggaacagagcagggtagacctaagcatgacacccaagagtgatgagggggtctctgaagtgatgggttgggggtggatggcagtaagagggagggaccccacctgcttttccagagactcttctgaggaggctggggattacaggggaggagaggcctgagagttcatatgtattttggggggcaatggtcactgaatgtggctggtggctctgatgggtctttttccaggtcactgggctagacacacgccccttccagctcacagtggagaagctggagatggccctgagagaagctcactctgaggtctggggatcaaatcaaacctgaggctgggtgtgggtgggtctgagcagggtctggacccctcttcttgtgactgatctcctcccgggagtagggttgatacccggtga

SEQ ID NO: 8803 - DNA, 1051 bp, Homo sapiens
tgcccaggctggagtgcagtggcatgatcttggctcaccgcaacctctgcatcccaggctcaagagattctccagcctcagcctcccaagtagctgggattacaggcacgcatcaccatacctggctaatttttgtattttagtagagatgaggtttcaccatgttggctaggctagtcttgaactgttgacctcaagtgatttgcccacctcagcctcccaaactgctggaattacctcactggccttatatttttttttgatagctatcctaatagatatgagacagtatctcattgtggttttgatttgcatttctctgatagttagtgatgtttagcatcttttcatacttgttggccatttgcatatcctcattggaggtatctctattccatgtggtttgcatttcctgctgctaatgatattgaacaggttttcatgtgtgtgttgcccttttatgtgtattcttttgtgtggtgtttaagaattttgttcatttaaaaaattgtctttttctaattgaagtgtaggagttctttatatagcctggaaatgagtcctttgtcagatgcctttaaattatcaacattcatagttaacaaagtctaaattttaccttctttatcctctacctgaacatgaaatgacctcagaacattgagctcttactcctttactttggtctcatttgatattgttgactggtgtattagctacacctagtttgttttttttttttgaaatggagtcttgccctgttgcccaggctggagtgtaatggtgcgatcttggctcactgcaacttccacttccagggttcaagctattttcctgcctcagcctcctgagtagctgggattacaggcgtgcgccaccatgcctggctaatttttgtatttttagtagagacagggtttcaccatgttggctaggctggtctcaaactcctgacctcaagtgatccacctgcctcagctgcccaaagtgctgggattacataggcatgagccaccatgcccggccctagtttttaaatttctaaattatt

SEQ ID NO: 8804 - DNA, 1031 bp, Homo sapiens
ttccttacccaaatatattgcactatctcacattactcaaatcaatcaaattccataatttatttcgattgtgtctagcatttcgctatgattagaaagaatgctgtcatggaactttttgacaaacattgttgagaatatccatagggcaaactccgtacagagagcttgttggaatgaagggtaccagcattttccgtttgatggatagtaccaaattgccctccaggaatgttatacgctcaccagaactgattataataaaacgtctacatatttgttagttttataagcaacgcgtggtgtctcgtttgggtttaaggattctttaattatgaatgaggctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggtaagcgcggctctccagggcggcggccgggcgggcgctgaagcgagggctcgggcctccgggggccgctgctgggtcgggacaagggccgagggagcgcggccgcgcggaggctccgtggaggcccgtgggctgcgagaggccacccccagccccgccggggctgtgacaatgactgcccgcttttggagcgctccgatttccactcctgcttctccttctcctccggcggcggccgcgctttcagcatcttggtacccacctgttctcctagccaaccttcgcccccagtccgctccttcctttcctcctgcgacccgccctccgccctccgccgtgacccctcccttcctgctgccaccttcccgccagccacagggatc

SEQ ID NO: 8805 - DNA, 1098 bp, Homo sapiens
acagggtctccattgtcgcccagactggagtacagtgacgcagtcatggctcactgcagcctcaacctcccgggttcaagaaaccctcccacctcagcctcccaagtagctgggagtgtagtcgtgcaccaccacacctggctaatttttgggtttttttttgtttgtttgttcgtttttgagacggagtctcgcactttcatccaggctagactgcagtggcgcgatctcggttcactgcaagctccgcctcccaggttcatgccattctcctgcctcagcctcctgagtagctgggactacaggcacccaccaccatgcctggctaattttttgtgtttttagtagagatggggtttcactgtgttagccaggatggtctcgatctcctgatcttgtgattcgcccgcctccacctcccaaagtgctgggattacaggtgtgagccactgtgcctggcttaatttttatattttttagtagagacagggtctcgctatgttgcccaggctggtctcaaactgctgaactcaagtgattcttccgcctcagcctcccaaagtgctgggattacaggtgtgagccactgcgtctggcttaaatatatgctctggatttggtattagatgctaggaatactgagcagagatgaacaactgattacaggaaaaatcacaaccagtagaggagacagacttgcaaatacttaaccaattcataaaatgtggcaagtgctagaatgcagtgtatgaaaggtgatgtgggtgctcacagggaagatcctctctctgtaaagcactgcttagtaaggggcttttcccctttcttttctcattctttccctctcatttcttctattgtttattccacctcaagtgcttgcttttattcctcagagtttgatacagatgtgtgggagttcgcttagcttgtgtcgacacacttcacaagcatggaggagtttacgtgtctgagggcatccctcagccagtgcggggtgggctttggttgttgaatgatgtggcttccctccaaagggacagctctgaagtgtgttctccgtgcttctccagagggatcctagaaggactgggtatt

SEQ ID NO: 8806 - DNA, 1029 bp, Homo sapiens
agacggggtttctccatgtttgtcaggctggtttcaaactcctgacctcaggtgatccacccaccttggcctcccaaagtgctgggattacaggtgtgagccaccgcacccggcctcacattcttgatagtgtcctttgatgcacaaaagttcctcattttgatgaagtcaatttatctatttttcctttggttacttgcagttttggtgtcatttttaagaaaccattgcctaatccaaggccatgaagatttacccttacgttttcttctaagagttttacagttttggctcttacatttagatttatggttcattttggttaatttttgtatgtggtataaggtgggggtccaacttcattcttttgcttgtgtatgtctagttgtctgaacaccactggttgaaaaaacaagtcttcttctattgaatggtcttggtacccttgttaaaaatcaactggccatagatatatgggtttatttttggattgtcaattcgaatctgttggtctatatgtctattatgccagtactacattgtcttggttaccttagctttgtattaagttttgaaataaatgtaagttctccaactttgttcttcctttttcttgttttaagagacgaggtctcgctctgtcaccctggagtgctggatcgaatgggtgggatcataactcactgcagccttgaacccctgggctcaggtgatcctcctgcctcagcctcccaagtagctaggactataggtacatgccaccacgcttggctaattttttatagagatgggttcttgtgatactgcccaggctgtgttcttctttttcagagttttcctgactattcaggtcctttgcattttaattaactatttttgttataagtaaatataaatgaaaaacagtctaaactctttgtgcttatgcaactacaaaactgaaacaaatttacaaggttaaatataagcacatctacaaaactaataacattcagattaacataattgaatatgatagctgatgctgtt

SEQ ID NO: 8807 - DNA, 1033 bp, Homo sapiens
tatatgccagataaatgaatagatttgcatagatagctaaaggagaaaagtatttgttaacttagaaacggaataaaggaagagtgtactaggtgggtgggatttcacatgcaaaggccctctggtagggcagagcatggtgtgttcaagtgactgaaataataccagtgtggctagagcacactagtggagtggaggcagggtgaaagattaatggagtagggagtgggaggtaaaaaaatggagctgtaagagaactcctttgagaagttcagccagtgaagaagggaggggaaagagataatacttaccggaagggatgtggggctgaaggaggtttgggatgttgtttctgcttgtgaaatgaaacaagactgtgtgtagaaatgctttctgtgaagggctgtgtgtatgtaaactgttttgctgttgtctccagagcatctgtggttgtaccagaagaaaagatgtcagatgtgtacagtattttgcagagcatcccccaaagacagattgaagaaatgcagagacaggtaagaggccaagtcttggggaggtgacatgggtggtaccgaaatggtggccttgactggatacagagggacaggagctgaatgcctgagtggggtttacttcctccactagatcaactagccaaactgaaacgataggaaattaatgttaggtgagttgcatcaaataaggtttgaaataataactctcagagaactgtgcagaggtaagcctactgcaattttagggtcttaccatagcagatgcaaagctgaagctctttggagggtttgtagtcacagcaggtgatagtcgtagtgactaagacagccatggaagctggaccatttcagggcaatacttctgtgtagctattgaccatgatactattgctgcacaaactagcccagcttcccagttcagtcatcctttgtaattcgggaatccttccctctcttctggaacatttgccattttcctgcctctctttccaaatttctcttctaccttctgacacccc

SEQ ID NO: 8808 - DNA, 1024 bp, Homo sapiens
aaggcaaataaaacagcttcatgaataaggaagtgaaaaaaagccgtctcatgttttatgcggcaaggtgttttacatacaactaaattaacaaaataaatattttaagtaaagaaaatgattagtatgtggataaatcccaggtatattaacctttttgcttcaaaatccctttttatgttaaagaaagtaagttctattaattgctgtttgttggatccccaagttaaagggatatcagatatttgtgaacttcctctgctcttctggagaaactggtaacatgggcatagtaaatgtcttcaaaaacctccagtccacaagaagtgcctttaaagggttttgctgatatttttttccctcgaattttaagttagttgtcaggtaactcttatatttatgaaaatggagtatgtaaaagaataaacaaaaaaatcttgcttacagtaattctaaactaaaagtaaggatgcttgggttataatttggccttattattgagctttttgagctgtcagatgaagattattagagcctatctctgggaccttcagactgttatgaggttgtccaagaaggacaccagactccctgctcttgtgctgtcaaaaggaccagtgagcaccaaagagcctgttggacacagggctttggaaagttgggaatgctcgttgctactattttgttaaagccaacaaatgaaaaggaataattagcctttggcatatgtatttggaaaggcttagaatctctttggaagttttcaggcttatcttcagacacagctttgaaaaataaatccgtgatgcatggaaatattttccagctgttcacctgaaataaatggttctgtcaatgttagtgtgttaagagtaagtttcctgtagctcggatctcttgaatctcctcatttgctaagagggagaagatttgcctttttaacagtgcagctgtttcttaaacttcttgagggagcaagtgaatgctttatttaatctgtcttggttctcttgggttttggggt

SEQ ID NO: 8809 - DNA, 1050 bp, Homo sapiens
taccagaaaccaggcaaattgcaacttcaatgagaaaagataattaacagacgccaacaaggtgacacagatgttagaattatctggtaaagatttttaaaaggttatcacaaaaaaagcctctaataagcaattatgactactgtcaaaacaaatggaaaacagaaagtttcagtaaaaagacagaagatataaagaagagctaaatggaaatttcaaaactgattacaatacctaaaattgaaaactcactggatgggctcaataggagaatggagataacaagaaaaaactggagaacttgaagataaatcaataggaattctccagtgtgaacaacagagaagaaatagattggcgaaaaatgaacagagcttcagagacttgtgggacaatcacaaaagatataatatttgtgtcattagaattttagaagaagagaaagaatgtgggactgaagaaatatttgaagaaataatggctaaaaacgtcccaaattagcaagagacataaatgtacagactcaagaagctgaaccaaccaccaacatccaaagaataaatagtataaatttacataaattgtgtaacctgaataaattgtagcaatacttcttatttcaaatagtaattagaaaagaggaaaaataaactggtttatatatccaaatatatatacataaggaaaggagaaaatatgcataggtgccacattctttgcttctgttgcttgatctccagaccataggtgatatttgtaactttcttcttcttcttcttctttttttttgagacggagtctctctgtcgcccaggctgtagtgcagtggcgcaatctcggctcactgcaagctccgcctcccgggttcacgccattcttctgcctcagcctctccgagtagctgggactacaggcgcccaccaccacgcccggctaattttttgtatttttagtagagacggggtttaaccgtgatagccagcatggtctcgatctcctgacctcgtgatccgcccgcctcagcctcccaaagtgctgggactacaagcg

SEQ ID NO: 8810 - DNA, 1050 bp, Homo sapiens
ctttgagtggggtttcctgatgcaggaagcaccaagaagaaagacaccaaaggagaatgagcttggtgtgtgtggtagtacaggggacccatcatcatagcggtgtggcagagtaggaattttgttttggtgagcagtggaagctaggctgcttagggtaatagagggccagcggaggtgcaggctgagaggtcaactgaaaagtttaatgtgacaggcagaaaagaggtgttgtaggtttttagagaagtatatggtaaaagccatcagatcacaagatgacttagaggttgcagagactggagattgtgctagtggaaaatctatagacttagtgtttgaatggattgaagaaccaaggagaaggaaaagaccagcttactccatagctcagatttaattagtgatgagggggcctcactaattggagaattccagagctgagatgctgtataacgtttatattttaaacagaattagtaaaacttatggctatctatatgtgtattcaaggagagtaagagattatagaatctgcaattcttttttttttttttttttttttgagatggagtctcactctgttgtccaggctggaatgcagtggcacagtcttggctcactgcaacctctgcctcctgggttcaagtgattctcctgccccagcctcccgagtagctgggattacaggaacctgccaccatgcccagctgatttttttgtatttttactagagatggggttttcaccatgttggccaggctggtctcaaactcctgacctcagatgatctgcccgcctcggcctcccaaagtgctgggcctacaggtgtgagccactgcacccggcctagaatctgcaattctaaataaatgatcccactttttctcttctcactacaacaattgaaaaatagaaatgacatatcctagaattagacttcataacctcctttaaaaactagcagatgactgagcacagtgacccattcctgtaattcctacactttgggaacctgaggtgagagaatggcttgaggccaggagttca

SEQ ID NO: 8811 - DNA, 1025 bp, Homo sapiens
tcattgcctcatgaaaaatagtatttggggttaatctttcatttagctgctttttgcttgtgtttccttctctgcctcagagcctcacagattacgaggttccagtaggccctcagatgtcagatgtggagtctcactagtttgctgcacagctgactggagttctttcttttaatggtgtgagcatatggctttctttgctagatggaaaccacattcacaaagagcctgtagcttttagaaatgaagactgatgggagcaaagggttttttcgtgttccctgcctcctctccctacctggttctattctgaatctggtcattcagcaggcacctgtgaccctcttcatatctgccactggcaccacagagctgaagaacattgaccctgaatgtcgtttttgacatcataatctgacttctttgttttcaggtgaggggctgagcttggggacaataaggtgctttttagaattagcatagtaggaagtcagatgacttcatgaatagaagattggactgggagttcgggccaatttagacttgacccagcactgtaaccttgggagaaccatgtctctccaggtctcagttttctcatctgtgcaatgagggaactggaccaagtcacctctgccttctacatgatctctgaggttgcagatctctgagatagcttggacagtggtcatcagctccaactgccaaagtgtgagtcttcttattatccacagaaggctcatggttatgctgtccagtgagctggtacagatacaaggatgaggcacatgtttaaagacactttctttggcagtatcttcctagtagtggtaattattgaaagatttaatggcacagatttttttatcaactatggccaaccccagtctgtctctttgccatcttcatggcacctggccttaaaaaataacttgcaaagaatggagatcaggtgccccagtaccaaggtaccaacctctagccagactggagcaaatgggaatgctgcccaaaccccagaagcc

SEQ ID NO: 8812 - DNA, 1557 bp, Homo sapiens
aaaattatgaaggctgtcctatgtgaacttcagctttcacagaagattgtgcagattgacataattcccagaaattgccacttacaggccctctgtcaatgttggttgaatgaatgaagtgtttattgtttgaaatttggccctgtcacctttttttttttttttttttttttttgcctttcatcattttgtgagcaagatctctcctctgccttttaaacttcagtaaactgaagctcagatccaagtagttttttttctttccatcctttgccttctcttagctggcagagatggggttaagaattgttggcagctaatccaccttggtttgaggccctctcacactgagctggaggaatgactggaatttgagggggaggggaaaagatactctgacctttgcaggcccgtggcctccaagcagcatctcctgttcacgttctcccactgaactaatagtccaagtacccccagttcaccgcttttttccacacctgtcaacctttttaagaacctgggagcagactgtggctacttgagctttttttgttgatgttgaacattatgtattttgctgttatctctcaacctcttgaacatactatcttttctccctgcccccatccttctcattctgctcaaacccctcctccccacctcctctccaaatcccacaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtctt

SEQ ID NO: 8813 - DNA, 1051 bp, Homo sapiens
aagattctgctgtcacatggcccagccagcttgtggagccctggggttggctgtgttgcctgtagcaagacctgggacaatgggattggtgatgagctgaaggcaagagtggtttctgctggggttggcaccaaggcaggaaaggagctgtcttcagccagtcgctgaagctggagttgagagtggagggcttaagggcatgaggattatccagggatgctggagaaagtgggctttgagcccagggacaagtcgagaagcttccagatgtgcactcttggacacaggacctcttgcgccatcttggggagctggcctggtgctgaccagtgctgtcccaaccccggcaacactaaataaacaggccaggtttactgccgtggccacagctcatcttgaatgcatgtgaaccctggaggaatggggtggatgaggttcatggtcaagcagaggctctgacactccaggaagatctctagtgggctgagtcagcttccagctgtctgtaaaacgaatccctgagtgtcctctgacctccctcctcccacccttaatcaaaacagagcatctctttattctcaccttcccattcattcactcattcgcacattacctaacattcttattctctcaggcattcggatgtgaacacagcctgtctcctctttgggatgtgaggaagtcagatggataaatagatatacggtatcatgtgccatcatggtattatgacacaaacagttttgtggaggccagaggggcagcctttgacctaggggtggaagttgaggtgagggcatgggcttaagaaagagcttcacagagggtgctatcatttggaggatacactgcagagtggctgggtgcattggaggggatctagggaggagatagaggcattctaagaagagatagcaagtccagtggtgtggccaggtgaaaaggcctagatggcttggggaacaacaagctgtgctgggtggtcagacccagtgaagggctgagccgtagtccacagtcagaggaggccctgctggccctggccttgtcg

SEQ ID NO: 8814 - DNA, 1020 bp, Homo sapiens
gtctaatatggctgcttcaactctaaccatcacatctccattctagccagtgggaattcagagaagacagggagggggggagcaaaaggcagcctcttgttctttttttttttttttcattctagctatattttcatgggttttgtgtgtgttttttttaaattttttatttccataggtttggggggaacaagtggtatttgtaacttacatgagtaagttatttagtgatgacttgtgagagtttgatgaacccatcacctgaacctcttgtccttttaagggcataacctggaaattattgaaatagagctcagataaaactttcttttaaatactgcagtcatggataaagtttatcatatggcccagtgacctgatacctaaggaccccagcaagcaaattcctcttagacccaggataaaggtgagctctcctggtgaactagaacgttttcttttttctagctctttcttcatttcttcttccttcactgccagcaaagtgcttgggctccagaaacagcctgcaggcttcctgactgggctggtgataaaagggccacactgggatctgggactggcaccatagacttggggccctaataagggataggaaagccttctagcagaatggaagggagagatcttggcagatagcaaatgttgggtctgcttcttaaaacacattcctagtgggccaatattaacatgtgatgtcactgtttgaaatactagtgctatggtttggacgtgcatcccctgtaagattcatgttgaaacttaatccccactgtggtggtagtaagaggtagtaatcacttctttttgaaaagtgactaaatcatgagggctccatcctcatgcatggattagtaccttataaaaggactggagggaaccagcttagcccttcttgcacttccatcccttctgccatgtgagggcacctaaatggcaccatctatgaggagcaggtctttgccagacactgaatccaccagggcttggttttggact

SEQ ID NO: 8815 - DNA, 1018 bp, Homo sapiens
tgatgataatgtagctaaagttgtgtgtgtgagttcgtgcgtgtctgctggtgagacatacgggattaacatgaaacgtgctgctagaaggaagttctgaaggcagctgtagagtcctcctggcatttgaatgggtgctgtgagcaagagaggtgaattctagttttggagtcccatggatctgggttcaaatcctgggtcggtccctaccagccacatgacctttggcaagttatttattccctctgaacgttagtttcctcatctagaaaaaagggacagcaaaaacaagatcaagtgcctagcctggtgctgggcatgggaacgacctgccaggttggcccctcccctcccctctgcacccttctccttcctctcctctctctgctctctccccactcccttccctttttttcctttgcctctccagaaacagcagagtttttccatatacacaccagacccatatacgttgtagctcattcaatgcccagcaatccaaccggagtgggatttttatctccattttacagaatggaaacctgctgcagctatggaatcgggtagatcacccagcaggtggagggggtatgagaaagtggaaatatttgtctgaagcatagcaagacctggccttttccgttgtatggaaatttttgcctgggaggtatgtggaatgcagaaagggtccttggtgttgcttcttgtagcctgcctcacccctcccctccccttcccttccctttttcccttccttctttcttccctccctccctccctcccttttttcctttcttcctttcttccttcctttcctccctccctccttccttccttacctctttccctcccccattttttcttttcttcgttccttccctcccttccttcctccctcccttgcattgtgtgcactagacttttgccgaaggtttgaagctgagggtcatccatccagaaggtagtggcatagtcatccagcccagcagtgcacagtggactggtctgtcttagaacc

SEQ ID NO: 8816 - DNA, 1030 bp, Homo sapiens
gcatgacagcatctgcttctgaagaggcctcaggaaacttacaatcatggtggaaggggaagcacgcatagtgacagatagggacaggagaaagagagagagaggggaaggtgctacacacttttaaacaagcagatctcacggtatctcactcactatcatgagaacagcactgaggggacagtgctaacccattcatgagaaactatctccatcatctaatcacctcccacctgcctggatggagatctgaggccccatctccgacactgggaattatgattcaatttgagatttgatggggacacattcaaaccatatcaccagtcatgggtgccccgtctggcttctgtgcttgcagtaatggaagtggggaaaggagaccttggggagtgggagccacatgtggactgaggtggtccccaaggactcctgcctttttgaaatgtgtttctctctcttctttctctagagtgtatccagaagctactgtcaggaggacactgtaagagaaccttggcacctctgggcccaaagggaaagacaccagtggaaagaggtatgatgtggcaacatggcagggtggcatcttcacttactcgaacaagagggtctactcttctctcttcttctcttcctgccctccaaaccaccacttccatgtgagagggctctcagctcttgcccaaggggtgcagggcaggagaagggtggcttcactcttgtcctcacccctagacatttactcatgggtgagggcaacggggccaccttggtgcaggaagtgagtgttgatggatggcagggagtgagcccttcaaggaagagtagagctcctgggggctccaggcagggtcatgagggctcatggaatctgtatcaaggacccctccctgacctcagcctcccccatacccaccacagtcttgggaccgtgataaggagatcgcttcctagggtgattaccttccctctgccctcgataatcttttggacaaagtctaaatccacaagtactaggatcaatcac

SEQ ID NO: 8817 - DNA, 1027 bp, Homo sapiens
gtctcctgatgtttttatctcccctgcccatagggcctgaggcaggctgagtgagagaaggcaatttctatggattccccaggcttcagtttatctatttttttgttattgttgctcaagcttttggtattctaagaatccattgccaaattcgagatcatggagatttactcctgtgctttattctaagagttttatttagctcctatatttaggtcatagattctttttgagttaattttcatatatagtgtgaggtagggattcagtgtcattctagtgtatggggacatccacttgtccttggcactatttgttgaagagactgtctattctccagtgtattgccattgctcctttgtcatatatcagttgacatatatatgcggctctatttctgggctttcaattctgtgccaataatctatttgtctgtactttcacaaataccacaccattttattactgtatctttatagtaactcttaaagttgggtagtgtcaggttttccaacattgttcttctctttcaatttttgattggctattctgggtgttttgcttctccaaataaaccttagaatcagtttgttgatatccataaaacaacttgcaggattttgattggggtcgtcttgaatctgtatatcaagttgggaagaactgacatcttgacattattgagtcttcctatttttgaacactgatcagtgttttcatttatttacttctttgatttcttcaatatagttttgtagttttcctcatacagatcttacacatattttattagatttattctcaagtattttatttctttaggtgttaatagaaatggttttatgtttttaaatttcaaattccacttgctccttgctggtagataggaaagcaatgacttttctatattaacttcctatcctacaaccttagtataattgcttatttgttccaggattttttttttgtaatttctttcaggttttctacataaatgatcatatcttctgcaaaaaaagacagtttt

SEQ ID NO: 8818 - DNA, 1025 bp, Homo sapiens
agtcctctggaagacagccagggcagaagagccaggaaccttattttgtcccagcaggtcctccaacctactgtgtgacttcaggctagtgagccgcagtttcctcatctgtaaaacatgactgctcacctcgcagggtagttgagagggtctgatgacataaagtgtataaagcactttcaggagttacctacgtgcaggtgtaataagtcctgggaggctgcctcaattggtgggaagagcagcgggcttcatgtcaggaggtcctcgttctagctgtgctgtgtgactctgggcaagagcccgtccctctctgggcctcagctcccgcagtgtgaaatgaggagttggagacaaccttcactaagatgcttccttctttgacgattctctgatggccctgtgggtgttctacatgggacagaggaaagggctggtggcagggacagggtgcccatcctggctcaactcacagactagagaggggtccttcccagagcctgcagatgctctgtgccaccttgacattcacagctccatgagccggcgggggcaggggaggctgtcatttaggatccaattgcatccacagcaggctgtgctcctggttaatccttaaggcacccgcccctcaggagcctaattagattttatcccccgctcagctgtgaccatgtccccatgttggtgccagcaccaggcacgccaggatctcaggccaattgcttgtttatgagaccgtctgtcttgggatgaggcccagcaggcacagccagtgagcaaataagtcctccccatcagccttgaacctgatggcaagaatcattgttagtcttctaggcctcgggccggcgtcctgaccaaggaaaagatgtgggtttgcagtccagcaaaacctggctacaaatcccagctccatctcttcccagctctgggacctttctagccccatgaagctttagtttcctcatccctaaaagggaatgatgataatatcgtctactttgtagagctttttggaggat

SEQ ID NO: 8819 - DNA, 1043 bp, Homo sapiens
agggtttctgactttggtgaggggatcaagaaaggctcttagaggaaataaggaattagccagttggagatttgggggtaagggtgtattctgtagaggagggactgagtgttcagatgccttgagttaagagagactttttttttttggttgttttgtttttgttttgttttgacggagttttgctcttgttgcccagactgaagtgcagtggtgtgatcttggctcaccgcaacctctgctcccagattcaagcgattctcccgcctcagcctcccaagcagctgggattacaggcatgcgcccccacaccgggctaattttgtatttttagtagagacagggtttctccatgttggtcaggctggtctcgaactcccgagctcaggtgatccgcccacctcggcctcccaaagtgctgggattgcaggcgtgagccaccgcgcccgaccaagagactgttaaacatttcagaaacccaaagaagtctgtcttggaccaagctcaggacagtgggaaggcgttttctcctctcacccccaaaacttgcatttcctgtactccttctctaggtttgtagcgcaggcatgtacactcaggatcatatttaaccatatttaaaccaccaccccctccattctcagtcaaccccccttagtcacccagttaccaagttctgtcattctcccaccaaaatctctctgcaaactgtctccttgtctccttgtctcctttcccaccaccaaagccctgatctgatgcgggctctttattactcagccgaatttgtgaaatagcttcctaacgagtcatcctccagtccctccctcagagaaagacacagatctgatcatgtcttcccaggcctaaaacccctccatggcttccagaggcctgtgggacaggctgcttccttctcatggccttcagatgcccttctttacctgatcccaacgtacccccagttctccactctgagatcacgagccacaccccataggcctccatacttttgccattctctttgtctgaaatgcccttcc

SEQ ID NO: 8820 - DNA, 1030 bp, Homo sapiens
gccgctgctgggagaggaagtgcgttcagttaccaatcgggttattttcataacggctgtctcaggctgcagggaggagggtgacaagggggagggggcagaggagcagccacggctgctagctctccaaactaggacttgctcagcagaggccgccagcccggagctggatccagagcccggccttggggaccccagctcccacctgcgccctgccttccagatcaggtcaaaaggggcccccagcccctccttgctttctgcttcctccctctgtatctggctgggtgggtgcggggagggttggatccgggcggacccgggccccaccatccctaggcaaggagcctgccctgccaggttcctgaagctgatggaaaagggtccccccgagctcctgctgagccagggcagaccctgccgactaaacactcactggcctggtcgccttcttaccatccagcctggcccacctgctccccgaggtacattttgtttgttgtttttgacaggatccctgtggtgagtctcagcctggggaagggaggaggactctgcctccccagcccctaggctgactggggagggactggcctcccttccagcttccccacctccttccctccaacccaggtctgtgggagcagagccgagggggttctggggaggcagctgcaggcccttgctctggggctgctggaggtggggtcgccatgcaccatgcccagccttcacggagcagaaggcggacgaggccctgcccagggtgtggagtgggcgctctgggtcagtcccatggggtatcctgtgagagcaactcagggggccaggcctggtaccgggtgcagagggcattcctcatggcacgagcagatacccaggtgacacctgtggccggctctgttcctcatgcggtgggtggtggccaccctgggcactcctgcttccctttctgggttcctggcctcactgtgggcagacagaccccaggaggtagcacaatcacatgctctggtgtctatggtgggtg

SEQ ID NO: 8821 - DNA, 1070 bp, Homo sapiens
ccaggagaccatccgcgtcaccaagccctgcacccccaagaccaaagcaaaggccaaaggtcagcgaaaggagaagggggtggggctgtcgcggggggctgcccccccccccccccgcctgtgaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcaggtgaggaggctgaggatgcccagggctgctgtgaccaggactaggactggaaacttgaaggttttctgatcccaagtggaaataggaagctggggatgtcccatgtccacatcacaatggctgccccatcccctgcttccgagtcagctgattggaaaccactagggggcagaatcttctccttccctgatgcccgggtgtttgtggagccggcggtctgcaatgggtcagcctaactgctgatatggtattaatatttctttcttgttttacagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattcca

SEQ ID NO: 8822 - DNA, 1034 bp, Homo sapiens
tgcagtggtgggatctcggctcactgcaacctcctcctctcgggttcaagctattctcctgccttagcttcccaagtagctgggattacaggcgcctgccaccatgcctggctaatttttgtatattttggtggagatggggcttcaccatgttggtcaggctggtctagaactgacctcatgatccacctgcctcaccctcccaaagtgctgggattacaagcgtgagccactgcacccagcccccaaaaattttattttattttattttttaattattgtttttttggagacggagttttgctcttgttgcctaggctggagtgcaatggcgcaatcttggctcgtgcaacctccgccccctgtattcaagtgattcttgtgcctcagcctcttgagtagctgggattacaggcgcccgccaccacgcccagctaattttgtatttttagtagagacggggtttcgccgtgttggtcaggctggtcttgaattcctgaccttaggtgatccgcctgcctctgccacccaaagtgttgggattacaggcgtgagccaccgtgcctggccaaaaattttttttaattagctgcacatggtgttgcgagtttatagtcccagctactcgagaggcttaagtgggaggattgcttgaggccaggagttccaggttacggtgagctatgattgcgccactacactccagcctgggtaacggtgtgagaccctgtttccaaaaaatatatttatatgctatataaacagtctcttttaacttgtgttgtccccaaaaccttgattgaattaataaaattagtttcttttacttcattaagaccacaaataaatgaaagcaattttttagtttcctaagcctgaatattgaaatcctggactttggtacaggatcaccttttgccactttcagtgactagactctttgctgaaagtgtcagcaggcctctgatcgcctttttgaagtcacataacctattttctcagctgagtttgcctgggattttttttttcttttt

SEQ ID NO: 8823 - DNA, 1081 bp, Homo sapiens
caagaccagactggatgatagagtgagaccctgcctctaaaatgcatagatagatagatagatagatagatagatagatagatagataggtagatgtttttagtgaaaagcctacccctttgcctccatctgcccagtttccatccatcctcagcctcccaaaagtaaccactattattgttttcctgtgtatctttccagagtttattatatacataaaggagtatacagtgcatactttttcatttaatacatcttgaagtaatttccgtttcttttgttttttcttttctttctttcttgagacagagtctcactctgtcacccaggctggagtgcagtggcaccatctcggctcactgcaacctccacttcctgggttcaagccattctcctgccccagcctctcaagtagctggaactgcaggcacgagccaccacacctggctaagtttttgtattttgggtagagatagggtttctccatgttgcccaggctgcttttgaacttcctgagctcaagcgatctgcccaccttggcttcccaaagtcctgggattataggcgtgagccactgcgcctggcctcgaagtaatttctcagtcagtagggagcttcttcgttcttcatgaaattcatttttagctatatagtatttaaataatttatttaaccagtcccgcactggtaaacaagttgtttttagccttttgctgttactaagaatgctgcaatgaataacctgcagttttgttcctttgcaagtgtatctgcaagaataagttccacaaagtggaattggtggattaagggcatatgcattgaagtacttatagatattgtcagattgcccttaataggtgttgtaccattttgccaccagcaatgaaagagaatgcctgtttccccattgtgctgacaacaaaatacatcaaacttggatttttttcaatctaagtgacagatagtctgagtagatttaatatgcatttttaaatgaagttgagtgcctttttaccaagtttaagggctgattggtctttgaaagctatatatatacacatatatacatgaacatata

SEQ ID NO: 8824 - DNA, 1032 bp, Homo sapiens
ttaactttatgttgcctgtcatttctctgtgtcacttcctgtcctttgtaaacatttccaataatcagaatagttcctctctatactctagtgagtcgttcaccttagtgagaacatgtaattttagaatttttagttctttataattggtttgttgctgggcgttggaggtaactttgctgctaaataattttatttttctattgagagttagagacccattgtagaaaccaaaatcttgtttccagagagctagttttacaataaagaaagatatttatcttcctagactggagagtgatttgtaagagatttaggaggagagtgagaaaaaggcagtgccacagacactggggacgtgggggtggagagtttcaagatggaggaagtgttcaatgataccagatgcctcagagaggtcaaagaagatacgggctgcaaggcaggttgttagtggcattaagggaggttttcatggagtagtgtggcaagatgcctgattttgctggattgaagagtaaatcggagggtgaaggcgttgagaataggctagattcgtttcaagaagtttgaccaattagggaaaggaggagagggggtgatagcaagaggaggaagagagagtttattgtttttagtttttagatgggagaaacttgagtatgtttttaggctgaagggaaaggaaccattgtacagggagagagggaagatccaagggaaggaaaggatgatgaatacttgatggaacatttttagaagtacgaggaaatttaggatcaaaggcagaggtgcaaggctattttgaagttgggagtcaggaccatatttatccagaaggcactgtttgtgtggtgcctaaccaacaaactgttatgggatctttgaaaatatttgagacctaaaaaaaaatttatcaaccctaaagtatggatatatgttttattatatatgtataaaacaatataatgtcaactttcattattacatgtaatattgacagacattttgccatatttgaaagcaattcat

SEQ ID NO: 8825 - DNA, 1069 bp, Homo sapiens
tgcagaaattttttatgcatactttctagtttgtacatagaatattaaaaaggcatgtacttatggggcaaggggtaagatttaatgaaattaatatttactgtatcttcaagaatatttgtaagtgaaactggctgtattagtcagcttgggctgtcataacaaaatatgcaaactggggtggcttaaacaactgttttctcgcagttctggaggctcagaagtccaagatcaaggtgctggccaatttggctcctggtgagggctcccttcccttccagatttttgccttctcggggtgaccttatatggctgggagagacagactctatggtgtcttttgaagagcaaacatttaaaattttgataaagtgtaacatcaaattttttctttaatagctcatatattttatgtcatatttaggaaatttttacctaacccagggtcactaagattatctcctatattttcttctggaagttttatagttttagctcttacatttaggtctatggcccattctgagttaatgagttaatttttctaatggtgtgaggaaaggttcatttttttgtatatgagttgtatatgaatatcgaagtattccagcaccatttattaaaaagattatattttctccaatgaattgccttgccaccttgttgaaaatgaattggccatgtatgtgcatatttctagattcttatattccatcattgtatatatgtatctttatgctaatatcacactgtcttaatgactgtagctttaccataaatcttaaaatcaggtagagtaagtcctccaacttagtttttctttttcaaagttgttttcgctatttcatgtttcttcatagctatgtgatcttgggcaggttacttgtcttctctgtgcttagtttccagatttgtaaaatgaagaataatattagactcttaggaggattaaatgaataaaactcttacaactgtgcccggcacataggaagaactccataaatattagctaatcttagtaattttgggtatatttaatgaggtaaatattggatttatccttaatcct

SEQ ID NO: 8826 - DNA, 1499 bp, Homo sapiens
acagttacccacagctatatggataaaccccacaaacataatgtttttttttgagacagggtctcactctgtcacccaggctagagtgcagtggcatgatctcagctgactgcaacctccgcctcctgggttcaagcgattctcatgcctcagcctcccaagtagcagggattacaggtgcacttcaccacacccgactaatttttttgtatttttagtacagacatggtttcgccatgttggccaggatgcacaaacataatgttgagtgaaagaagccagaggcaaaagactgcatactataatagactatatagatagtttatatatgtatacacacatacatatataaaacaggcacaatttaccattgaggggttagggactagacagtggctgtaggatgttttctagggtgctgattataagtataaatttacatttttctgtatattattatatttaaatagaaagttgtaaaaaatgtttggtagtaaatttctaacttaaaactaagcaaatgatacacaattgagatcccggaaatagatgccaaagaacaaatctatttaatctgtgacaaactaagtgtaacaaagtaagcatggcacatgtatacatatgtaactaacctgcacattgtgcacatgtaccctaaaactttataataataataaataaataaataaataaataaataaaattcattaattgagataactagatttcaatatggcaaaaataaatttaggttcatgcctcataccatatggtacattgaattgtagtttgaattaaaatattaataaaatattaatgtattttttataactaaagtataattatggctgagataattttacatataaaaattgatatagatctgtaagggcagattgatgcataaatagatgttggtttttaaaatttgtgtacaacaaataacacagataaaaggaaaatgacagaataaggacgattatgatgaatatgatgaataaagcttaatatgatatgtacagaaaataaatgacacaaatttatgttacagtcctgtcaagcagtcaaaggaaatgatttaagagtttgttcatgtgcaacattcttcataaaggtgaaaaattagaatcaatccacatgcccatcaataagggaacaattaataaattatggtatttctatgatagatactacgatgtagccattacaaagaattagatttgttaatatggaaagatgtacatgaagtattaagtgaaaaaatgagttgtagaataaagtacatatgtatagtgtcattacacttttctacaaaacaagttaatgcaacatttgtcaacaagtatatggtcacatgtagtgtaagttatggaaggtatagatcaaactgttagcagtgaatactctggggaattggcataagagggcgcttatcctgtttttacttcacaccctcctgtattgttctgtttcattgatgtgtgcttttacaattaaaa

SEQ ID NO: 8827 - DNA, 1084 bp, Homo sapiens
ctagagctaccagtgatataataataccttatttctgaagtggtgataagtataaatgatattgtgagatatctggtatgacagtaatgttatatgaaaatatctgaggtttctttttttttattttaaagttttttgtaaagatttggtcttgctatattgcccaggctactctcaaactccagtcctcaagtcatcctcctgcctcagcctcctaaagtgctgggattacaggtgtgaaccactgtgcctagccaatatctgagatttctattattgaaagagtcacaggtactgttaattctgctatgcttatattcataatagaaggaaatgccaaattccagttagaggttagtaaaaataaacataaaaatttccctggctcatgcctcccagcactttgggaggctgagcaagcagatcacaaggtcaggagatcgagaccatcctggctaacacggtgaaaccccgtctctactaaaaatacaaaaaaattagctgggcgtagtggcaggctcctgtagtcccagcttctcaggaggctgaggcaggagaatgccaggaacccaggaggtggaacttgcagtgagccaagatcacaccactgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggcca

SEQ ID NO: 8828 - DNA, 1122 bp, Homo sapiens
gtgacttttactttgtagggaaaaagaggtatgattggactgttattcttatttacaggtaatatttagattttgtttgatgttaacactgtccctggtaaatttttttttcttctctcaagcttcagtgtgattccccaggaaaatcttggaaattgccaatagagaagatgtattactaagtatcagaagttttcttggaaggacatctaataagtttcccaagatgtgattctgcctgttcagtagttgcttgagtgctgatgaaattccccccaaacacttcctaatatattattgaaatatttgagataaaggaaagctgaacatattaaaactaatttttaagtggtgagagaagtggaattgaagtctatttgaggaatttgaaacatttatcacccacggtttttccaaaaatatacatttgtgtcagtctgtcaaactttttatcaaaaaaaactgtgaattatccatttaaaatacatttttattacattttcttctgtatctgagaaatatgccagatggtagaaatttcctagaagtctctgacacttacagattgaaagatgaatgacgagaagacaagaatttgggtatccagattaatagatagaactttacaactattgacttcttatttgctcttgttgagttttgaaaaggaattaggcaaggtagatgaaaatagagattcttctcccttcagtacccatgtgatttaacacagccatagaaggctccaagttttggggtgtgggcacaatttcaaagatatatttctattaagcttcttgagagtgatatgaagaagaaacgaagtatagagtctctcagatgcaaaaatcacttagaggtaggccatgtatccatccttatcacacttcactttttccaagaactacgactggcttgtcttttatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggat

SEQ ID NO: 8829 - DNA, 1031 bp, Homo sapiens
tcattgtggccagtatttaacacataataaggaaacactaccacagtcaataggagataatgcggaatgcttttatgtgccatacactgagcaaaatgtttacatgtattcattcatttaatccacacaataaacatatgagttgatatgattactatcctgttttatatgttaagacacagagtccgctgggcgcggtgactcatgcctgtaatcccagcactttgagagcccgaggcaggtggatccttgaggtcagaagtttgcgaccagcctggccaacatggtgaaatcccttctttactaaaaatacaaaaattagctgggtgtggtggtgcatgcctgtagtcccagctactcaggaggctaaagcaggagaattgcttgagtctgggaggtggaggttgcagtgagccaagatcatgccactgcactccagcctaggcaacagagcgagactctgtctcgaaaaaaaaaaaaaagaaaagaaaaagaatcgaaactgagagtcagaggattaagtaactcacacaaggccacagcgcttataagtagcacagctcatattccaacctacgtcttcacaaagttcacattttcacattctttctcttttcttttcttttttttttttttttttttgtttgagactgagtctcactctgttgcccactcactgcaacctctgcctcccgggcccaagcaatcctcccacctcagcctccctagtagctgggaatacaagcacataccaccacacccagctaatttttgtattttttgtagagatggggtttcaccatgttgcctaggctggtctcaaactcctgggctcaagcagtccacccgcctcagcctcccaaagtgctgattacaggtgtgagccaccactctcaagcccacaaagtccacattcttaacaactctgctgtgcctgctaccccaggttatgaagggctttgtgtgcactaaaaagcataagaatgatacaatggactttggggacccggggaaaggatgggttgggggtg

SEQ ID NO: 8830 - DNA, 1025 bp, Homo sapiens
attgttgcttctgtaatgttttaaacaaacaagaactgttccatgtggtctcttcagtgatgtgggccccaccagccaattatcttcacctgctccagccagtgcatctcctcttctcattttctcccagaaaccagatgtagacaatcaacaagaatttcagtgcctgtttcctagctcccgttttgtttatttctcctgagttcctaattttccctttgtttttcatgtttatttccttcttcaaaatcttttctccagggagaaaattgacaattgatggcccctcaaatcattcacctctgtacctccaataactttaatctttccccctatttaatgttctcttttttttcaatgttggttatttggggctcttacgcaagcattcctggaatgcttttgtcactatcttctctcccacctgaagctcctcaaccctccatacataatacctgtaggttttagttttaaaggtcaggtccttaaagaagccttctctgtgactcccttccttatctgaattgggtccttccattataatttttcagattatcctctgatttttatcatatcatttattacagtttctgactcagtatttacttgaatgacttttaatgtccatctcccttattaaaattataaactttatgagtacaggaaccttgtttgttttgccagtaattatatccctagcacctaatacaggtgaatgatttttttgttatataatatgaaggcttaccttttcccagtaatgatacagaagatagattattgaatggattatattatcattcattttatcagaggataggttagtttttaaaatctgctttacactaacttttctatattgtataggaacttctgatttaaattaataatagctaccccttattgagcaaatgctatatgccaggtactaaagttcatgtttaaagtgttccactaaaaaccagcctaatcaaagctatactatactaaataacacctaattaaaataatattcagtattccaa

SEQ ID NO: 8831 - DNA, 1050 bp, Homo sapiens
tcaactgtgaggataaagttgtttttttttttttttctttttagacagagtcttgctcttgtcgcccaggctggagttcagtggcccaaactcggctcactgcaacctccgcctcctgggttcaagcgattctcctgcctcagcctcccaagcagctgagattagaggcacccgccaccacacccagctaattttttgtatttttagtagagacgggtttcaccttgttggtcgggctggtctcgaactcctgacctcaggtgatctgcccacctcggcctcccaaagtgctaggattacaggtgtgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtttaatacttcagttgaagaagcactgattaatacttaaaaacccccacaaaccgagaaagaaataatcattctaagaaaaacaaaaggttgtataagaaagaaaatataataatataccttgtgtttttgctgtgcataatatttacatagtcataaatgagtaaatactgaatattggtaagccaaaattagtatcatgaaaagatggacagatgggaagtatatgtgtgtggtgaaaaagataatttgtcatcttcaactgaaagttaaaagatgtctaacatttaaaaatcaagaaatagcagtataaacatattatttaaagaagcaaagcaaaaaacagaggactcagtgagttttgttaagtatg

SEQ ID NO: 8832 - DNA, 1054 bp, Homo sapiens
ccaaggtaatcaaattgaaatctattataaacattatgcttcagcaaggtagatggacaaaatatactaaaatcaataatttattttaaaaaataataagggccaggtgcagtggctcacacctgcaatcctagcacgttgggaggccgaggcaggcagattgcttgagcctaggagttcgagaccagcctgggaaacatggtgaaactctgtctctacaaaaaatacaaaaattggccaggcatagtggtgtgtgcctgtagtgctagctactgggaaggctgagatgggaggatcacttgagcctgggagtttaaggatgcagtgagccaagatcagaccactgcactccagcctgggcaatagagcaagaccccatctcaaaaaaaaaaaaaaaagattacatacctaggaagaaatgtaacaagaatatgaagagagctttaaaacactactggaaacaaaaaaaagacttggacatatggaaaggcatggtatgttcttaggaagatttaaaatcataaacctgtcagtgctccttaatttaatctataagttaacatgatctccctaaaaaaaaccaataggactttttgcttatttgcttatttttttgagagaaatgattgtaaagctcatacagaaaaaatatgtagactaaaataaccagaaatatcccgagaaagaaaagaaataatgagataccagcctcgttaatatctataatagatattaaaatctgttataaagctataataattccactataattgctaacaataaacactgtgtgccaggcactgttctaagctctttaaatataacaattcatttaattctcataaaagcccgttgagattaacctactcaaactcacactgccaataagtggcagagctcagatttgaactcaggtgctagctccagaacatgtactctctccatcaccacactcttcatcaccagcacatttgttattgacatattaatagacaggcaatcaatggaccagaatcagaagcttagaaattgactcaaatatagaaataaaatt

SEQ ID NO: 8833 - DNA, 1030 bp, Homo sapiens
gaagacctccgagattgtattacgccccaggaacaagaggagcaggagtcccctggagctggagcccgaggccaagaagctctgtgcgaagggctccggtactgcctgtgcctgctgcttgaatatttccgccttttagggtgctcgcgcaggaggctgcagcgggggatgggtgctccgaggctcccgaggcccgcgcaggtcacgggtgcctccggctgtgcattctacctgcaggtcctttgacaccagagtgtttaggtttcaacacctctcccgctaggtaacaggaagcagatgagctccgtaacaacagacacacggacttgtcagattccttgttcgtatcagggttcttgcacagttaggacggcttcagagaatcctacctttcctggcgctgtgtgtgctggatttcatagtcacgcttgttagctgcacgtcctcggtggtcagttgtgagagcccccaattccttcctccttagaaagctcattctctgaggtttactggggcttgaacctggggctataaggagtttcgagacactcaaaaacgagctggggcttgttaatcaagtggtttttgtccatgagaagaaagaattggttgtcaagacgtcggacctatagtgattgggtcctcaaatacagtttggtgatcaggagttgttgctttattgctattctaatttcacttacctccccagaagtaacctagttaagagcatttccaggccttcctattccttcttttcctaaacggtgacttctgccatgctgccctaaaatctttttattgtgcattatatgtgatttataaaattgtgacccagtcccatctcgagttttgcagcccaaactgggaagagttctgcattgtactttatccttgtgtgtttctttggctggggtctcaggaaccctgcacgactgtatttactttcacttcagacttactgtttgtgggagtgttttggggaaggggccaaatcctcactcatttttttatttctggtgctcgttgagac

SEQ ID NO: 8834 - DNA, 1358 bp, Homo sapiens
tccgatcacccagactgtggtgactggcctactgggcactcagccaggtaaaaaatgtcttatgttgtaaaggtcccagctggaatgcactctgccccttttgctttccaagattattcgttcgtgtacattgcaaatattttcatgcacagggcaggcagttagctttcctttggtgggaggacttggatctagggctcatccatgaaggaggcagagattggcagtttacccagaacttgggttttaattcaacctaattcatttctctctgtggcaggggctccagcagtcctttttgcacactctggattcttaccggatattacaaaaggctgccccctttgacaggagggctacatccttggcgtggcacccaactcaccccagcactgtggctgtgggttccaaagggggagatatcatgctctggaattttggcatcaaggacaaacccaccttcatcaaaggggtgagcagttccccatgccaggtcgtgctaaagaagtgtttgttggctgggtgcagtggttcgcacctgtaatcccagcactttgggaggccaaggtgggtggatcacctgaggtatggagtttgagaccagcctggccaacatggtgaaaccccgtctctactaaaaatacaaaaattagctgggtgtggtggcaggcgcctataatcccagctactcaggaggctgaggcaggagaattgcttgaacccgggaggcagaggttgcagtgagccaagattgcaccattacactccagcctgggcaacaagagtgaaactccatctcaaaataataataataataataataaaagaaaataaaaataaggagtgtttgttgaaggcatgaaaggaatattgatgtcatccagtaatcatcaggaagaggactgggatcaaaattaactgtgggcattttcaaatacgtaaatgatgatgatatatatttttctaatgcctgtccttaaaatactagaagatatagactattgatcacccatagaattgaagccccttctgggctgggcgcagtggctcaggcctgtaatcctagcactttgggaggccaaggtgggctgaccacgaggtcaagagatggagaccatcctggccaacatggtgaaaccccgtctctactaaagatacaaaaaattagctggatgtggtggtgtgcgcctgtagtcccagctacttgggacactgaggcaggagaatcgcttgaacccgggaggcgaaggttgcagtgagccgaaatcacgccactgcactccagcctgggcaacagagcgagactccatctcaaaaaaaaagaattgaagccccttcttaccacattgacctcatct

SEQ ID NO: 8835 - DNA, 1047 bp, Homo sapiens
tctcttaagtggagggatttggagagcagaccaccagaaaaggccaggttagacaggtgtgggagactggaattcaaagtgtgagatgggtgttcaaggaacaagtgccagaagcccccagaaaggcagtcagaggagtgccgcggacagagtggggtaggtttcctgcccagctaaagaggcaggtgaccgctaataaggcagcttgaagttgaagtcagaacccagagctcagacaggaagaaatttgttttcttgttttctccaggagtctaggacatgggaatagaggaatttagcttatgcctggagatgggaagaagcagtgtagggtattctaggggaagagcttcctgactaacaggataatgacaagtgctttgaacttgtgccagactgagattgctttttttctttgttgcatcaccttatgacatgcgtgtaaccttctttacagtgtaaactttctttacactgtaatgaagattggtctaggcattgaattttgtggcttgcatttgcagggagctaggttggagcagaggaagggtatggcagtctggaagagacctgtctggttttactcccagatgctgacagcagaatgctgatttgagaccagttactggaggagcaacagtgcctcattttgtcacttctttagtcatctgaccttggctgtgacctttacattcttcaggcccttggcaagggaacatgtattacagtttcacaatgaagatagcttaattttattcctattataaaaacaatgtatggggccaggcgcagtggcccacgcctgtaatcccagcactttgggaggccgaggcgggtggatcacctgaggtcaggagttccgagaccagcctgaccaacacatagtgaaaccctgtctctactaaaaatacaaaaattagccgggagtagtggtgcacgtctgtagttccagctactcaggaatctgaggcaggagaatcacttgaacctgggaggtggaggttgcagtgagctgagatggtgccactgcactccagcctgggcgac

SEQ ID NO: 8836 - DNA, 1046 bp, Homo sapiens
gagatctcagctcactgcaacctccacctcccaggttcaagcgacccttctgcctcagcctcctgagtagctgggattacaagtgtgcaccaccacgcccagctaatttttgtatttttagtagagaccaagtttcaccatattggccaggctggtctcagactcctaacctcaagttatccacccaccttggcctcccaaagtgctgggattacaggcttgagacactgctcctggcccgatcctgtgtctttaaaaaaaaaaaaaaaaactctaacaagtaatactgctttttttaaaaaaaattgtgggccaggctcagtggctcacgcctgtaatcccagcactttgggaagctgaggtggacggatcacaaggtcaggagatcgagaccatcctggccaacatggtgaaaccccgtctctactaaaaacacaaaaaattagctgggcatggtcgtgggcgcctgtaatcccagctactggggaggctgaggcaggagaatcacttgaacccgggaggcagaagttgcagtgacccgagattatgccactgcactccagcctgggcaacagagcgagactccatctctattttaaaaaaaaaaaacaaaaaactggtagaaaacacgtaaaacaatttacaatctttactatttttaagtgtacagtttagtaatgttaactatattcacattgttgtgcaacagatcactagaacttttttcttgtaaaactgaaactctatacccactgaacaagcctccacttctccctccccttagcccctggcaaccacagtactactttctgtttctgtgagtttgactactttagatatctcatctaagtggaatcatacagtatttgtctttttgtgacaggcttatttcacttaatgcagtgttttaagattcatccatgttgtagcatgtggcagaatttccttttttaaggctgaataatgttccattgtttgcgtgtaccaccttttgtttatctgtttattaattgacagacacttgggttgatttcatcttttggcta

SEQ ID NO: 8837 - DNA, 1059 bp, Homo sapiens
gaggctgaggcaggagaatcgcttgaatccaggaggcggaggttgcagtgagccgaggtcgcgccactgcactccagcctgggtgacagagcaagactccgtcttaaaaaaacaaaaaacaaaaaacgaaaccttatttgaattggtttgtgctatctgacagtttcaggggcttttctgaatttgattttttattttttttattttctgagacagtgtcactccgtcacccaggctggatggagtgcaaggtggtgatcttggctcactgtaactgccgccatccaggctcaagtgattcacatgcttcagcctcccgtgtagttggaattataggcacataccacctcgcctggctaattgttgtatttttagtagagacggggtttcaccatgttggccaggctggtcttgaactcctgaccttgagtgatctgcccaccttggcctcccaaagtgccaggattacaggtgtgagccactgcacctggcctgatttttttgttttctctggatggtatgacgaaatatttaactgtggtaggaagtgcagtgagaaacatgtatttttttttttttttttttttttttgagacaagagtctcgctctgttgcccaggctggagtgcagtggtgcaatcttgcctcactgcaagctccgcctcccgggttcacaccattctgcctcagcctcctgagcagccgggactataggagcctgccaccacgcctgcctaattttttgtatttttagtagagacaaggtttcaccgtgttagccaggatggtctcgatctcctgaccttgtgatctacccgccttggcctcccaaagggttgggattacaggcgtgagccaccgcacctggccaacctcatgtattctttaactgacctctcattcctagtggtaaaaaatgtcaggttacttgggtgcagtagctcacacctgtcatcctagctacttgttaggcagaggcaggaggttcatttgagcccaggagtttgaggtacagtgagctataattaggccagtgcactccagcctggacgacagagt

SEQ ID NO: 8838 - DNA, 1288 bp, Homo sapiens
gattttttttctatttctgtgaagaataccgttggtattttggtagggattgcattgaatctgtagatcacttttggtagtatggtcattttcacaatattcgtccaatccatgaacatggtatatctttccattttttccctatactctttcttacatcagtgttttttatttttcctcatggagatcttttacctccttcataaaagataaatttctcctaagaatttattcttagggcattaatttgtggctatcgtaaatgagattgccttcttgatttctttttctgctattttattgttggtatatagacacactactgatttttatgttgattttgtatcctgcaagtttattgaattcacttattagttctgagttttctagtggagattttagggctttttttttttttttttttttttttttagatggaaccaggctcaagcagtccttccatctcagtctcccgagtagctgggactgtaggcatgcaccaccgtgcccagctgatttttgtattctttgtagagacaaggtgttgccatgttgcccaggctggtctagaactcctgggctcaagcagtccacccgccttggccacccaaagtgctaggattaacaggtgtgaagcacaacacccagcctaattttagggacagtttgacttccttctgtccaagttggatgccctttatttctttctctggccaattgctttgattagcatttccagttgaataaaagtggtggaagtagacatccttgtcttgctacagattgtagaggaaaaactttcatctttccccattcagtatgatgttggttgtgggtttgtcatatatgacttttattgttttgaggtatgttcgctctgtacctaacttgttgagagcttttatcatgaaggaatgttgacttttatcaaatacttttgtatttggtattcgttcttctttaaatgtttttagaattctgcattgaagctattgggtcctgaggctttcttttcttttttctttcttttttttttttttttttaagacggagtcttgctctgttgcccaggctggagtgcagttgtgcgatctcggctcactgctacccccgcctcccgggttcaagcagttctcctgcctcagtctcccaagtagctgggattacaggcgcccacgaccacgcctggctaatttttgtattttcagtagagacagggtttcaccatgttggccagggtggtctcgaactcctgacctcaagtgatctaccccccgcccgccccaaa

SEQ ID NO: 8839 - DNA, 1025 bp, Homo sapiens
cccaggctggtcttgaacttctgggcttaagtgatcctcctgtttcatcctaccaaagtgccaggactatagatgtgagctatcatgcctggccaaagtgagctgctttaataagagtatttgaaattattccagtgtgttttaattccaaatgtattaaaataggtatgatggagtatcggtcttgcaggaagccattcagcttcagtgtgctaccttttctggcatctttctgggacaaattcgtatttgttctatgctggtgagcaagggctctttatacagagctgctgagtgtagcgacctaaatttttttgctcaaacaaggctgttttaataagaaataaattatataaagtcacgtgatccatttagtaaaatattgggctgtgaaccaggagactggtatttagtcacactgattaggtcttacccaataacctttgatcagttgcctctctacttactctatttcatgtgttgtgaaatggcatgatattacctacctctgatctagttgaaaatcttttttttttttttgtgagatggagtctcattctgtcacccaagttggagtctcactctgtcacccaagctggagtgcagtggtgcaatcttggctcactgcaacctccgcctccagggttcaagcgattctcctgccttagcctcccgagtagctgggactataggtgcatgccaccacacccagctaattttttgtatttttaatagagacagggtttcaccatgttagccaggatggtctcaatctcctgacgtggtgatcccaaccaccttggcctcccaaagtgttgggattacaggcgtgagccactgcacccagctgaaaatcttttaatgaatagaaaatctactcagaagtagcagatgaagttagtgatattttttagggtcagtaagagttgataggaaagaagaaatgaacatttctcagttactggccaggtgctaggcactgttaggtgccttatatgtatcttcaaatttaattcttgtaaagt

SEQ ID NO: 8840 - DNA, 1040 bp, Homo sapiens
gggcgggcagcccaggccagcagcagggccttcgggttgggtttgaccattcaaactaacgccttcatttctctcccatgctttctcctccggccaggagcggaaggtacatgccctttctgctatcttcgcttcttagcgcttttgagttgtgtgcgtgtggattcttctgtcctctctttgggaaatagactttctttgtgtgggtggggctgtagctgggagagtgtgctgtgtggggcaggggtggagcctgtgggccttaccccggcctccctccctctcttgcaggttttcatagagctgaatcacattaaaaagtgcaatacagttcgaggcgtctttgtcctggaggaatttggtaattacactattttgctcttaggtctggactcacatggcagtaactcaaacctcggagctccagaggagggtctaggggcagggagaagaagaacctctgtagagaagtcaggaggagcaggagtgacaaggaagaaaagggacccctgagatgagagccgggatgtggaagggaaagatagataatggatcgcagaagagcaaatggggcctcaggtgggtttcgagtttagaggtggtcctgaagcagctcagtgaagtagcaccacctccccgtgctgggccagccagtggtcagaaagtttgggacacagcagactggcgacccccaagctccactatgtccatgtcacctgctgcaatctctctagcagcccagtgcgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctg

SEQ ID NO: 8841 - DNA, 1063 bp, Homo sapiens
cgtgacagatgcttgcggaggggcgcgttcaaactcagaccgtgaccccgctaggaataaggggatttacacaatgacactgcctcccaattaataaacgacataggccagccgtgtgcaaagggccaaaaaggcatgccacctcagtccgcatttttacaattatttaagtacaagctggccacccggagttacgggagggaatcattaaccagctttaaagagaaatcgctgctgctcctaacgtcagagcaggcttcacggaattgtccacgtgggaagaactcaattgaccatcagcctctacgattaaaaacattatgactcgggccgggcgcggtggctcacgcctgtaatcccagcactttgggaggccgaggcgggcggatcacgaggtcaggagatcgagaccatcctggctaacacggtgaaaccccgtctctactaaatatacaaaaaattagccgggcgtggtggtgggcgcccgtagtcccagctactccgggctgagccaggagaatggcatgaacctcggaggcggagcttgcagtgagccgtgatcgcgccactgcactccagcctgggcgacagagcgagactccgtctcaaaaaaaattatgtctcgtatctgcaattgtttgttttctctgaccatggttagtaatctcagtgagcagagcgggtctccggatcatgggagactcattcgttgtacccttgtcggctattttaaatgatctctccttatcctttgaggtgagccctggagcccctttaaagggaacttcatgtaagcaacatagcttatatttcaagtcaaaccatcacaaacactctgttaacctgatgaaaatctgtgcaatcgttgccttttttttgtttgcttgtttgttttttgttttttgagacggagtctcgctctgtcgcccaggctggaatgcagtggcgcggtctctccctaccgcaacctccgcctcccgggttcaatggattctcctgcctcagcctctcaagtagctgggattacaggcacccaccaccacgcccaactaatttttgtatt

SEQ ID NO: 8842 - DNA, 1026 bp, Homo sapiens
ataatacaagcagcatgatttttaatgcctgcaaaatagagtttccaaagaaatgaaatctcagagtcctttagcacctgctcatgggtcaagggcaccttgacacctgcttctttctttctctgctgatttcccaaccctgtacttcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttacccctt

SEQ ID NO: 8843 - DNA, 1052 bp, Homo sapiens
actgtggagtaattttgagaagaggtgaacaccccagctgctatagtaagagtctttctgaggaccgtgtagttaaggtggcactttccccaagttttcatcactgtattccctagaagggaaacctttcacatgcacctttctcaaggtgcttcagggagcctttcctggatttgacatcccttacaagcctaagagactgcatgcagggctggcttttgccttctccatttcttttttaaatatgccttttccttccagccactgtcagaccacggaatgatgtggcccacaagcagctctcagcttttggagagtatgtggctgaaatcttgcccaagtatgtccaacaagttcaggtaatacttactaatgttatttgggtctgggtcaagaaagaaccatgttcgcagggcatgtgggagtgggcagacttgtttcaaagaaactacagattcctccatcccaagcttggacttttctctcagcattaaaccaggtgactccagctgaagttagctgttccctcagtagctctttgttccctctcccctcactttcatgtgtgcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgaggtcagttgggagatctgagaaggttttgggggtaaggatattaatttcagtttgtaacatacaatagaacacagcagttaaactggaacttcagagtcaagtagatctgaagttggatcttggttctgccactaaatggctgtgggacctcagataactcaaatattttgtttaattttttttttttttagacggaatcttgctctgtcgccaggctggagtgcagtggcatgatcttggctcactgcaacctccgtctcccaggttcaagcgattcccctgcctcagccccttgagtagctgggactacaggtgcatgccaccacgcccg

SEQ ID NO: 8844 - DNA, 1659 bp, Homo sapiens
atgcctggctaatttttttgtatttttagtagagacagggtttcattgtgttagccaggatggtctcaatctcctgacctcatgatccgcccgcctcagcctcccaaagtgctgggattacaggcatgagccaccgtgaccggcggaaagtgttgggattacaggtgtgagccaccgcgcccggccccatgaaacctcttatattgggtttgagattaaatccacaatggattgtgtgtattatatatacacacacagacacacgcaaatgtattaaaatgtataatatgaagcagtggaacttccctgatagcacaatttaaatatttcctttttgacaaacgtgcatagttaaataaattaagtgaccaccaggtgtgactgaagagtggccagtgtctattcctagccccgaaggagcacagggatattgactgtgtcccttaaaaaaaacaaaacaaaacgtagggctttctttgtattggtttgaacatttctctttatcttgtgacctggccaactctggctatggctgcctcctgtctctcggtacattttctgtggcggtcaagaggagttattttaagccaccaatgggaaagtttaaagacataatccttggctgtaattgcgggagacgggaggctgagagtctgtgctgacttgccacctgtttccacggcagcaaggtgattgtgcatttcctgctgctggctgaggggccagcaaattttcatgtcgttgtgtcatggggaagttttcctgtctcaatgagagcacaccgtgcttgtggtcttgttcctgtgaccaggacatggagaactatggggagattgttctgggtgtgaagggaaattgctggccagtgcttagtgcacgggctttggagtcagagccaacttctccacctcctacctgtgtgaccttgggcctatccttctaatgcttggagtctcttctgtcctcatctgtatgatggggataacaagaatacctactttataggattgctgtggaggattaaatggatctgcatgacaaatgcttagcatgaaaaaatccctcaacagatattggctgctattttattatcttattgtgctgagacactggcataatttacaattcaaaaattaaatttttttaatcttatactgtagtttacaaggccctttcacatatatgagcttgttcaatcctcacagcgtccttgagtttgtcattgttattgccatttaaaaaggtatgactcagagtggctgtaattgacttgtccaattcaggtttcatctgtcttttgcagaataataatcatgtacgttcatagtataggccacctctttttttttttgttttttaagacatagtctcgccctgtcacccaggctggagtgcagtggtgcgatctcagctcactgtaacctccgccttctgggttcaagcgattcttgtgcctcagcctcctgagtagctggcattacaggagcccgcccaccatgcctagctaatttttgtatttttagtagagacagggtttcaccatgttggccaggctggtctggaactcctgaccttgtgatctgcctgccttggcctcccaaagtgctggaattacaggtgtgagtcaccgcgcccaagtataggccacttttaagaatt

SEQ ID NO: 8845 - DNA, 1046 bp, Homo sapiens
tgcgccaccacgcccggctaatttttgtatttttcatagaggtggggtttcaccatgttggccaggctgatctagaactcctgatctcaggtgatccacccacctcagcttcccaaagtgctaggattacagtcgtgagccaccatgcctggccacaccccggtttattgcatttgcttctaatagagaaatcaacccagtaaacaaatgaattattgttagcaaaactggggggtgggttgggaaaggaaagtagttccttctataataaaacttgctgatatttcgttgaaagtcattgtcttactcatccttgtataagataagtcacacaatgagtggtatcagggttgcagggtttccccctgtgaggacacaatgggatgaaccgtgtgtgggatggtctgttaaagaaaaacaagaagccatgtgttggaaacaacctaagtattgagcggtggaggattgctgaaattgtggactactatgcagtcattaccaacgcactgaaaaaatgttccatgatatggcaggatgtttatgctataagaaatttaaagacgcgagcttcaaagtaaagtataaacctaatttggtcaaacaggctgggcgcagtggctcacgactgtaatcctagcactttgggaggccgaggcaggtgggtcgttggaggtcaggagttcgagaccatcctggccagtatggcgagaccccatctctactaaaaatacaaaaactagctgggtatggtggctcatgcctgtaatcccagctactcaggggtctgaggcagaaggatcacttgaacctgggaggcggagggtgtagcgagccgagattgtgccactgcactccagcctgggcaatagagcgagactctgtctcaaaaaaaaaatattggttaaagaaacaaacgttagacttgaagccgtgctttatatggatatgtggtgcactataatgtggtgcttaaaaagcaacttaggcagacctgggccaagtctgggctctgccacgtaactgctatgtgcccctgggcaagtcac

SEQ ID NO: 8846 - DNA, 1062 bp, Homo sapiens
ttcacacatatgatgctcactaagtgtctggcacccttttttctttttctttttggggcagagtcttgctctgttgcccaggctggagtgcagtagcacaaacacacctcacttactgcagcctcaaactccctggctttaagtgatcctcccacctcagccttccaagtatctgggaccacaggcacatgtcaccacacctggctaattaaaaacatttttttgtagaaatgaggtcttaccaggtcgcccaggctgatcgtgaactcctgggctcaggtgatcctcctgtcttggcctcccaaagtgctgacattataggtgtgagccactgtgccccgcctcagtttttaaaaatacttgcttaaggagagagcactgaaggaagatttagatctgctctgttgaagtgacagagtacggtggtttccatttatgcgtattttgtagttcggatggcttcttgtggggagtcctgtgagttcacacttgggggcatggtgtgggggacctgtgaagtgggtgttctggggtgagtgcgatgctagtcactgtcccagttttcttctcatttctttttttgtgagtgcttggctagtggcagccttgcagatcagctagttttgacccacatcctccctctaagtggtgctcattgaattgagccacagccccaaggtcatgttttcaaggttggcatttgggaggccttgtcagaaggtcttataccatattccagtcacccaaagtgctgcccgccatgcctgttcgttcagcaggatttccctgagcacctgctctgtgccaagccctatgctaagcaccaagggagtaaatatggagggcagtgtccccagagtccaggaactcgtgatctagtcggggaggagaggggtacctactctgtcttttacacagcaagtgtaacctctgaagaatgatgttccaggaggcaagagcaaccctggcggactggtggagctgggaagggaaagatgcttctggaggggccttgggagaagagtcctccagggtgagccccttgagagaggtttcagagct

SEQ ID NO: 8847 - DNA, 1027 bp, Homo sapiens
aagtcacacggtgcaggatgggactcaatatagggtgggatagggcggtgggtaaaagccgttacaattttgtccaaatggtatgggctgatttacttattagggaggtacaaatggcttcgtgttataaagtgtcaagatccttatttggataaggcaaccagagtgtagacgagagagtaagagtaagaaaacaaggagaaaaatgagtgtcttaaggatgtagaaatttagtttgctggaagtctctgcagcctgaacaaaacagctgttaggtttgccagaacttaaaccagagggtgcctgccagtggttcatattcttgctacctcttcctcctcttgtcttgtttttcctttccattctaataatcacgatgagtttccctgacatgcacgccccttcattcatttgtatgatcacttagagatgaggagctgccttgccaggtagaaaaaccattctcaggatgaatctttggctttctgaatcagagttttctttgggttttagaacttcattcttattaaagtgggaatttaccggccgggtgcggtggctcatgcctgtaatcccagcactttgggaggccaaggcaggccaatcgtgaggtcaggagttcgagaccaccctagccaatatggtgaaaccccgtctctactaaaaatacaaaaattagctgggtgtggtggtgcgcgcctgtagtcccagctacttgtgaggctgaggtaggagaatcacttgaacctggaaggcaaagattgcagtgagccgagatcacaccattgtactccagcctaggcgacagagtgagactcggactcaaaaataaataaataaataaataaataaataaataaataaataaattggaatttaatatctcttatcatttcttcaattccagtttttattagatccacaacttttttggtcaaaaccagaattttgattatgtgtgccatcctaggctacctcaccatccaaaaatcctcttggaaaaccccacgcttatcaggaaaaggag

SEQ ID NO: 8848 - DNA, 1056 bp, Homo sapiens
ggtgtggtggcgggtgcctgtagtcccagctacttgggaggctgaggcaggagaatcacctgaacctgggaggcagaggttgcagtgagctgagatcataccactgcactccagcctgggtgacagagcgagagtctgtctcaaaaaaaaaaaaaaaagaaaaagactattggtaacaaccctcatttttttgagcacttgctatgctgctaactgctttatgcacactatttctttaatccttaacactatttctttaatccttatatctacccatgagatagggttttgttattcaggcagtggcaaaacctgcggcttagagaggttaaaaaaaaaaaacaacaaactgcctcaaacaaagtcatatagtaaatggcagtgctggagattaaatttaggtctgtcttgttctgcagtccatataccatataactttgccaaatacaacactatggtgtgtgtgtgtgtgtgtgtgtgtgtgtgtgtgtgtgtatgcacatgtgtggcctttattgaacactgtggtgtgtgtgtatgcacgtgtgtggcctttattgacttattgaattgatcctgaatcttccctactcctttcctgtctcttttctctttctgaataacatcatttctttttctctactggacatggtctctgtgggtttcacccctcacccctcttatttttgaagttttattgaggcactggttgaggctttagggctcccactgttaagtttgacagtaataggtaagtgtccccccagtctcccttttgccctttctttttttttttttgagacagagttttgctattgtcatccaggctggggtgcagtagtgtgatcttggctcactgcagcctccgcttcccgggttcaagcgattcttctgcctcagcctccccattagctgggaatacaggcgcacaccaccatgcccagctaatttttgcatttttattagagacgtggtttcaccatgttgggcaggctggtcttgaactcctgacctcaagtgatctgcccgctgcagcttcccagagtgctgggataa

SEQ ID NO: 8849 - DNA, 1028 bp, Homo sapiens
aatagattttatttttagagtagttctaggttcacagcaaaattgagcagaaggtgcagagatatcccatatacccctggcccccacatatgcacggcctcccccgttagcaacacccccaccagagtggaacaatcaatgaacgtacattgacatatcactatcacacaaagtccatagtttctgttagaattcatgcatagcattctacattctgtgggtttggacaaggtatgatgacatgtaactgtgatttcctcaattcaatatgtatagttcctgttcacacatttcttcacacatttgttcctcagtgctcaaatgcctgctgtattccaggctgtatttgaagcccctgagcctttatttggagagttcattgaacattagagcatgcagtttgctgagatgtcttgtacttagaaaatccaatttataaaaaacctcaaatagaacagtaaatttagggaattttttttttctgatgataaaattagataactctgttgcatggattctgtaaaacacagctccctcctgttacgccatgaattgggttcaatttacaacacccctttaggcatactttttcagcaacacatgtctgagccgaggtgcactgtgcctctttctgtagcaggcagcttttagggggtgtcctagtggtcttatgttttatacatctcatgggagtggctggtttctaggaaatagctcacttgccagttttggtaaccctaacagagctgttttgccaaggcgtctggtgaatatttctgtcttccagtcaggactaatatagtacttttcagaggtgatagccagttaactgatgactttttttttttttttttttttttttttttgagatggaatctcgctctgccacccaggctggagtgcaatgatgcgatcttggcttactgcaacctctgcctcccggattcaagcgattctcctgccttgcctcctgagtagctgggattacaggtgcgcaccaccacgcctggctaatttttgtatttttg

SEQ ID NO: 8850 - DNA, 1035 bp, Homo sapiens
cttttgtttttgctcctgctggtgatctgattttaaatgtgaacgtgccattgctaagagtttttgttctatgtattattctgtgtggaaaatttcttaaatgggattattgaagtatacttcattatttatcttctggcaatttatcaacaacagcaaatatcattcattattgtttggaggacagaactatttttatattctttaattaaaaatggctttgacattttcaaattcagagggaagttgataatttagtgctgtatgataggacctttagttggtctgaatgtcacataattgtacaaattgctgttaaagtatattattacttattttctgagaggtagagggacttggttatcctgggattgcataattattggttcactagaactacagatgagtgaaaagaagggttagatactctctagttcacttttcttccagtgcagggaacattctatggggttccgaacagatataataagctcataataacagtggccattgattgaactctttctatcaaacaatgtgaaaaacattagtagaggtgatatcttagtctgcttttgctgctgtaacagaatacctgagactgagtaattttttttttttgagatggagtctcactcttctgcccaggctggagtgcagtggcgctatcttggctcactgcaccctccgcctcccgggttcacgccattctcctgtgtcagcctcccgagtagctgggactacaggctcctgccaccacgcccggctaattttttgtatttttagtagagacggggtttcaccgtgttagccaggatggtctcgacctcgtgatcctcccgcctcggcctcccaaagtgctgggattacaggtgtgagccaccgcacccagcctttttttttttttttttttgagatggagtctcgctctgttgtgcaggctggagtgcagtggcgccatcttggctcactgcaacctccacctcccgggttcaagcaattctcctgcctcagcctctccagtagctgggacta

SEQ ID NO: 8851 - DNA, 1026 bp, Homo sapiens
tttggaggccgaggtgggtggatcacctgagatcaggagttcgagaccagcctgaccaacatggtgaaaccatatctctactaaaaataaaaaattagctgagcgtggtggtgtgcgcctgtaatcccagccagctacttgggaggctgaggctggagaatcgcttgaacccgggaggcgaaggttgcagtgagctgacatcatgtcattgcactccagcctgggcaacaagagtgaaactctgtctcaaataaaaaatattatttttctaaaaagctcttattttattgtgaaacacttaaattagcaaatctcaggcttgctgaataaggcttcccaggcaaaccacatcccacatgtgcaaatgtctggtgacacagtgcttcatttttttccactagtacttactactacctgacattatagtgtaagtttacttgtctatttgtgtatggtctgcctctcctatgagaatgtgagctgcatgaggtcaggacattgttttgttcactcatgaattcccagcacccaggacagtgtctggcatgtagtgagtacccagtaaatatttgtggaatgaatgaatgaatacttaagtgggtgggaagttcttggaccttagtctagacccatggttctcaaagagtggtcctgggactcttggggattcctgagatccttttagggatctgtgaggtctgtgaggtcaaagtatttttataataatagtaaactatttgtcctttcactctcattccctcatgtatgcaaatctcagtgaactgatattttccaaataaccaatgcataaggccacaaagccatgcagggtaaaaagagctatgaacaaaagttttctagagaagaatttggaggaaagagagtttattctagtgaacagatcgcaaactgggagatgctgcgttggtgtaaaatgaaggtgcattccagagagcaaagagagaatctagttttttgttgttgttgttgttttgttttttaaattttgagatggagtcttgctct

SEQ ID NO: 8852 - DNA, 1030 bp, Homo sapiens
acttgggcacagtgatgtgtgaaaaatgcccacctttgctcttggtgtccagtgggccttctatgggccctctatagaggtcatcacctggggattcctgactctggccaggtcctgaggtctttccatgttactctccatgttacttgagtaacataagagcttcttatggctcttatgttctgcaggacggatgaactaggtacccaggacaggtctgtttgtgcacaaggctgtctccttctccccctccttggtttttctactgaggctttgttgtgcttggctcagggtgatgttagcaaatgcactctccaccctgctgtgccacattaaggaaacgcatgttgtattggcttctgccaagtcagctcacatgctttgttttagtgactctgtgaagagctcatcatctattatttattcaggtaacacacttctatctcctaatttcggtgctactcccatttttcatccccggttagcgtgctgtgcgccaggagggctgcctgttgtctttaagaaccactttgaacatttttgctttggttatttattcataccaacatgttgttgttaaatgacgtgaaataaaaccccattttaaaaagaaattgtaaaaggaagctatgtcctgtgtggaaatcatgacaagcccagaaacatgttacaaaaacattaaccaggagcggtggctcacgcctataatcccagaactttgggaggccaaggtgggcagatcacttgagaccaagagtttgagactagcccggggaacatggtgaagcccatctcaactaaaaatacgaaaactatccaggcataatggtgcaggcctgtgattccagctactcaggaggctgaggcaggaaaattgcttgaacccgggaggcagaggttacagtgagccgatattgtgccactgtactctagcctgggcaacggagcgagactccatctcaaaaaaaaaaaaaaaaacaaaaaaaacccacacacaacaaaaaataaatattgcctgtacctatcacct

SEQ ID NO: 8853 - DNA, 1047 bp, Homo sapiens
agaattgcttgaacctgggaggcgggggttgcagtgagccgacatcgcgccactgcactccagcctgggccacagagcaagatttcatctcaaaaaaaaaaaaaaaaaaaaaaagaaaaagaaaaaaagaaatgcaggtaggtgcttctagctactgctgtgggatagcaaggtagttaccaaactgataagggtagcatcttacttactgctgaaaaattcagtgtcttttttctttttttttgagacagagtcttgctctgttgcccaggctggagtgcagtggcgagatcttggctcactgcaacttctgcctcttgggctcaagatattctcttgcttcagcctcccaaggagctgggattataggcactcgctaccacacctggctaatttttgtatttttagtagagacagggtttcaccatgttggctaggctggtctcaaactcctgacctcaggtgatccacccacctcagcctcccaaagtgctgggattacaggcgtgaactactgcgccgggcttgagtttgactttttgaaaatattccacctataagtgaagttgtgcagtgtttgtctttatgtgtttagcatatttcactcagcataatgtcctccaggctctgatgggcacttggcttgtttccatgtcttggctattgtgaatagtgccgcaatgaacatgggcaaattgccgtgttgagttaaggaagctcttttccagtctgagtttgcaaatagcttttcatatatgagcgttgaatattatcaaatgcttttctgcattcactgagatgactttatgtatttaaaaaaatctgatggcctatattttctatttctaaactactcgtgtattcctggtataaatcaactcagtgtgttactctcgtttttatacatagctggattcgttttcactaatattttgtttgagatttttgcctcagtgatcatgtatgtgattgctctgtaacttttcattcacattttgtccttgtctgtcctggtatcaaagttatattggcttcatagaatgaggg

SEQ ID NO: 8854 - DNA, 1024 bp, Homo sapiens
cctcctctcatttcctgtgaatgattgtgtgcaatgtaagcacagagcttctgcactctcatgatcaagtgctctctccatggccagaaacagcagtttctgaggggctcatgttgtaggtgatgatacaaagaagacagagagagggatcaggtgtcctaagtgtacatttcatctcagtattttctgaggtggggcatccctgtctcctggagaagtatatttttaatctagttgtttactttctttgcatagcccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggtaagcaaataggcttttctgttaaaccatcatgtttcttaaaggaaatcagtataattaataaacataatgtttccaaatattgtttttcttttaattatctaagaaaaaactttaaaaattttcataacactaatgcttatttattatatgaaatacagacaagtaagtagaaaaaacttacatggaaaccatcaagcagagataatcacttttgatgtatgacattttacaatttttaaacatatacatatagatacacaaatatatgtgtgagtatacatatatttaatacatatatatttaatatttaatacacacacacacacacacacatatatatatatatatatatttttttttttttttttttttttttttgagacagtcttaccctgtcacccaggctggagtgcagtggcatgatcttggctcactgcaacctccatctcctgggttcaagtgaagcgattcttgtgcctcagcctcctgagtaattggaattacaggt

SEQ ID NO: 8855 - DNA, 1056 bp, Homo sapiens
aatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtgtatatatatatatatatatatatatatatatatatatatatatatatacactaagctctcaaaaacagtcattcctatgaattgaggtgtacaaagtttgaatttgtatcaaagatgtaattattatttttaaaaccttttcactatactgctgctgtaattactttgatttttaaaatgtagattaatttttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagtccctggagtcctgtggctgttgccacagtaatgtgtcctgctgtaaacaggacag

SEQ ID NO: 8856 - DNA, 1034 bp, Homo sapiens
agcatgccataagccaccttggtgccccctttcagccacaccctggcaaagctaaccactatcctggctgctaaccttttaagttggttctgtgctcaattttttgaaacttgcttcttttttaaaattaaaaatttttatttttagagacgaggtctcactctgtcatgcaggctgcagtgcagtggcactgtaatggctcaccgtagcctcagactcctggactcaagtgatcctctcacctcagcctcctgagtagctgggactacaggtgcgtgccaccacacctggctaatgaaacttgctttttttttttttgagacagagtttcgctcttgtcacccaggctggagtgcgatggtatgatcttggctcactgcaacctctgccttccgggttcaagcaattcttctgtctcagcctcccaagtacctgggactataggcatgtgccaccatgcctggctaatttttttgtatttttagcaaagacagcgtttcactgtgttggccatgctggtcttgaactcttgacctcaggtgatccgcccacctcagcctcccaaagtgttgggattacaggcctgagccaccgtgcctggctgaaacttgctttttatacttgacatattgtgaactctttctgtgttattaggtattcatcctgttcaccattttaagagctgcataatactccatagtatggacacataccactctcgagttaactactcttttattgattgccattagattatttctgattttactctcctgtgaataaggatgtggcatctatcacagtagccagatctttgcagacatcacaattaatttcttagtaaacttttctataaaattaatgaatcgaaatatataaaaaggtagggctttaggctggtcgtggtggctgatgcctgtaattccagcactttgggaggccaaggcaggtggattgcctgagctcaggagtttgagaccagcctgggcaacaaggcaaaacgtcatctctaccaaaaaatacaaaaaattagc

SEQ ID NO: 8857 - DNA, 1035 bp, Homo sapiens
taattttttttattttcagtagagatggggtttcaccatattggccaggctggtctcaaactcctgaactcaagtgatccatccaccttggcctcccaaagtgctgggattacaggtgtgagccaccatgctgggccgactaaagcctttttaaatgctaatggcttttttccaggatgtctgaaacttaggtttgagattgtggaaactgagagtattggaaaatttcagaattgatttataagatacaccaatgagagagttttggcttttagtgctacccagatggttttctttgtactcttaagaacagaagcctggagaagtgaaggccactgagaaaggaaagggtaagttgtatttgggaagagagtcctaaaagagtccctttatgttagtttctgccgagggaatgacagtaattttcccattacttggttctgttgggaaaagcagttggtatgaaaaaatttcccatttaggatctaggatctgcatcattctcactttgatcttcagactttcttcatttacttgttattggaagagactgagtgatttaaaccttccctttttcctcagttttttttttttttttattaagctcttgaccatctggaaggcatccttgctgttacctgtttataaattaacatgtaccaggcttctgagccttatactgttgagtcattgatttagtgctctagttgcagctcttggaatcatcagagcatgctggatcttctgggaagttactttgtcatggttcaggctcaaacctagttgtgaagtgttattcagagcaacatgaggttgctggaaagaggaagaagtgaattgaagtggtagggaataaaaacacttgggctcattgaagtagagattattggggtggaggcaattatacacaagttaaatctgaggtaggagggaaggaaaactccccatatttagctttagaagccaaaagatattctgaaaaatgtgggtcacattgtctaaagagtcagcaaagtaatactgatgtatttctct

SEQ ID NO: 8858 - DNA, 1045 bp, Homo sapiens
tctttttcccttctaattatcttcccaggctgtaggagtcaagtgagtcaccctttctcttcttccccaggcggaaattgaagtgacaacttagtactagggaggggctctgacctggatgactggttttcagtttctctccctccttcttaaggaacctaggaggtcaggctttggggtgaggcggtgcaggaactcttctttttgcttatattccactccaaaccctgccaatgtatggagacatcttttctgaaccaaagaactcacagaggaagaagcttccatggggggctttctttgaggatagtatagaactatgactgaaggtctgtttagtccctaaaattgatgcccttgctccagcttcgttattttgtctgctaattgtgtactgacatatcaagagaaccaaacagctaatggatatttactatctaaaaagcctggcatataataaatactaaaaacttttcaaaatgaatggctgaatggaatttgaataaatagatggtggtggtaaagatttgtgagatgctttgtgacagttttgtctcttatcttgatttgcttgtatctcgttaaggaactgagttcctccaaactgctctgagtcagtctcagggctgtgctttttgttttggtgggtgcagataccttttcttcacagaatcccagactgctgtggtttaattctctggaatcatatgctgtcttgttctcctgtcctcttcttcctttccttcagtgagttcttcctttgctttgactggttcagataaaggggacaaggacagatgctgtcctcattctggagattaagttctcagccacaaagtagattagagtatttatccactgtcttggtagtgggaacttctccctgagctgagacgagagtgtttgatactactgacaaaaaagtagcacatcaggttcttccaaaacttccagctcccaggaaatcagcagagaaaggaagagctcttgaagcattcctacgtagattcaaatcctgaaagaaactgagtttaattctggacta

SEQ ID NO: 8859 - DNA, 1046 bp, Homo sapiens
cccggctaatttttgtatttttagtagagatggggtttcaccatgttggtcaggctggtcttgaactcctgacctcgtgatctacccgcctcggcctctcaaagtgctgggattacaggcgtgagccaccgcgcccggccaatttttttttttttttttttttaagagatggggtcttgctatgttgcccagtacagtggctattcacaggcagtcatcatagttcactacagccttgaactcctgggctcaagccccagccccccaagtagctgggactacaagtgtgcaccactacgcctggttggccttggcctttgaccaacctctggaaggtctcccttgcagatttatagagcaaaataaactggatttaattttgaactaattggtgaccatgatcaaaacttagctgccatttgtttctcttcttgacagaagtaatttaatgctatggtccagggatgcctctcatctgtctctctttgtccctaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacgtatccttcaaggccttttagattgtgggattggaagggggaggaatgagggctaaagggaaaatggctgcagtaggggccggggaaagtgaggtcatgttgctctgttctccttgattgtttggcatcagaatggcagtaatgtgtgtggctggcttattcttcatccctgtagctggcctcacgggatttcacgtggttctggtggccaggggacgcacaaccaatgaacaggtatggagaaaagtgacgagagacccctgaagagcaggtcatgtctctttagccttctgattagtgtgcagtgtagtgcttccacaaagagatgcttaatgaatacttttcatgattatgtagagattaatggtagggagtgag

SEQ ID NO: 8860 - DNA, 1023 bp, Homo sapiens
ccactgcactcctgggcaacagagcaagactctgtctcaaaaaaaaaaaaaaaaaaaaaaaaacccagcaaactcttattctgaaatcctggatttaaaccagctgaatgagtggttttccacccactgattcaggaacaaccttggctttcacggcaacagattttaactgtgttaaatttaaagtcagattacattaattcaggttttctcatggatgttttcagttacctaaccagctggaaaaactaaaagtgttttttgtttttgtttttcacattttgatggtttaggctacattttgttgctgttttagaaatgttttcacatcagctaaataactttattgtcttaactaaggaccgaagcaggtcaaaagttcttgtaaagagaagggaagctttacctttgcttgccagaagttcatctcaaaagatcacaggcttctgacctaaagaaccaatcttgttgaaacacatgggtgactgtccatgtgttttcagttggctattctctttcgacacaaaattgacctagaatacactgttgagccctacctggatcagctcttcagatggagcctgagatcaccgaggcgcttggttctcaacataatgggcagagtgttacgtgtctgctgtggagtattagtaagcttgggtcacttttcattttggttggttccctgcctgctagtgagatcatgtaatgacaagacccaaatcccctcaagtcttaggaatgccttgtcttaaatcctgattcacagaaaggcacatacctcttaacaggcagtcacacttcagccagtttgataaatgtaatttttttttttttaaagaaaacacagaacaagtcctaaatcagacaaattgcacaaaagagagagaagaaaattgtaagcttcctgggagaggaagagatgtccatgagaaaaccaactgggatgagcctacaaaagcatgtccctctctctcctaatttacttagtctcaactgagcccaacaggagctggcctctgt

SEQ ID NO: 8861 - DNA, 1047 bp, Homo sapiens
atatggtctttgtgcacatttgcattaagaaaaaagagtcctaaggtcaaactgaaaactatagagttctaggttctgtttttttttctgcctgctttagatcggctgttacttttcgactgagataaaaaccactgttctctgtttttttgcaagtcggtgaagttgtatttgtctcatggcaaaagtattgaattaatagctatgggaactgtgtgtgtgtgtatttaaaggcctttataatagacttatataattttacgttcaattggcaattgaaacccttttaatttccctctagcacaccagactttctcttcttaccttatgatgtaaattttgctatctgattttcacctgagttgcctttaatatgcaaatttaaggctgtttagctgacagctgcctagggtaggatttttaaaaaacggaacaaaaaggaggttgttatgagtctatgccatgtgcttctatcggcatacctaataagtctatatatttatgtgtgtgtatacaatattttcactactgaaaatatataaagagctctaattaattggcttaaaaatatataaaagcgggtagggcgcagtggctcacgcctgtaatcccagcacttttgggaggccgagacaggttggatcacaaggtcaagagtttgagaccagcctggccaacatggtgaaaccccgtctctactaaaaatacaaaaattagccaggcatggtggcatgcactgtagtcccagctactaagactgaggcaggagtatcgcttgaacccgggagatggaggttgtggtgagccaggatcacaccactgcactccagcctgggcaacagagcaagactccgtttccccccacaaaaaaaaataattatatatatatatatgcatgtggtggccatggtgcctcacgcctgtaatcccagtaactttgggaggccgaggtgggtggatcacctgatgtcaggagttcgagaccagcctggccaacatggtgaaaccccttctctactaaaaatacaaaaattagccagccatggt

SEQ ID NO: 8862 - DNA, 1047 bp, Homo sapiens; identical to SEQ ID NO: 8861

SEQ ID NO: 8863 - DNA, 1047 bp, Homo sapiens; identical to SEQ ID NO: 8861

SEQ ID NO: 8864 - DNA, 1019 bp, Homo sapiens
ctgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccagatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgta

SEQ ID NO: 8865 - DNA, 1113 bp, Homo sapiens
aatctgtctgccttggcctcccaaagtgctgggattgcaactgcacccggctgtttttattttttagagacaaggtctcagtacattgcctaggctggtcttgaactccttgcctcaagtgatcctccttccttggcctcccaaagtgctgagattataggcatgagcaactgtgcccagcctctaattaagtatcaggtttttttaaagctaatatttgttgagtcattatgttccatcaggcattgttctaagtgttttaccaatattaatttatttaatcttcactgtaactctgtaaagtagctactgttattataaatgagtaaactgaggcatagttaagtaacatgcttacaactgcaaagtagcagggacaagatttgaattcaaggccgggcacagtggctcaaacctgtaatcctagcactttgggagactgaggcgggaggatcacttgagcacaagagtttgagactaacctgggcaaaacagtgagaccttgtctctaaaaagaaaaaaaagaaaaaaaaaaaagaatttgagccagaaagtctggctacagagtctatgcccttaaccacttcagcaacttttgtaaactctctttaatagctcatatttttatcttctcaatgccttaattcaggtcatcatcatcccctctctcctggattatgaaacagctgcctatctaggctcagtaaccaataatggctgaatgttgtttctaaacaacaagctgaatgttgtttctaaagcaggtattagattataacctcctgcgtaaaactgttcagtatgtctcccagtgtcctgagatacctacttcctttgtatgacacttcagacctcacatgtttactaatttctcttttcctctctggtcaatacatgttttatagtctgctctaataataacgaacaaacccgtggtcacatctctgaacctgtatacgtgctgctgtctgccaggaaaaatccctgcttcctcccacttgtttgtctttcagatctcacctaaggggttattccaagaaaagttccctaacccttgtctcccagtctcctcaagtctgtgaaggatgtttcttttttatcctcctaagtctg

SEQ ID NO: 8866 - DNA, 1032 bp, Homo sapiens
ctccaatctgcagtgtacagagggatatcctacaatgtagcaactcgggattccagagaagatggtgctggcaagtgagacagttcttccttctaggttctaagtctgcagtacaggagttaggactgtgccattccagccatccttatatttagattcatgctttcaaagagcctctaatctagactgaataatgatctgagctgtctggtgagcagtaaaactggcccaaataatgtattttataaccagtgcccttttagcaagaaagtcagtgggttgttagggataggccactacagtggttcacaacaggccataagagtctatgagggtttatttatttatttatttatttatttatttatttattttgagatggagtcttactctgttgcctaggctggagtgcagtggcgtgatcttggctcgctgcaacctccgcctcccaggttcaagtgattctcgtgccttagcctcctgagtagctgggattaaggcatgcgccaccatacctgcttaatttttgtatttttagtagaggtggggttttgccatgttggccaggctggtctcaaactcctgacctcaggtgatctgcctgcctcagcctcccaaagtgctgggattacaggtgtgagccaccatgcccagcctatgagggtttttttttttttttaagacatgaattcccagacttccctgtagaaactgatgtagaggggggatttaattttttcaaaaagctccctaggtgattctgatcattcacgtttgaggatcacaaaacctgaatatttgaattaagcttacatgtatatgttatttctcaggtggatggttatttagttaaggtgagaagtagagccaggcacggtggcctgtgcctttggtctcagctacttaggaagctaaggagagacttgagcccaggagtttgacaccagctttggcaatatagggagaccccgtctcgaaaaaaaaaaaaaacaacacacacacacacacacacaaaacaagagaagtacagaa

SEQ ID NO: 8867 - DNA, 1042 bp, Homo sapiens
caggcttctccttcctactgaccagtcaattgtattaagtgtttgatgtgagtttgaactgaggtctcaggaggggagggagcgagggagggtggtggtggaaacagctggtgccttcatcaagctatctcaattactcttcagagtgtttgggggtgggggttggtggcacaggaattagatgtgtgttagcagagtctcagcaactcttatgtagtgggtttgaattctcaggcactcttaatgctatgtgggatgttggctagttggaatgtagctaaacctttcccagtcacattcttctgcctcgcctccctgtaattctttcagcattgggcctgctttggagaaagaggggtgtgggaagttagacagcaaaacagattcatccttcctacccattgagtattcagcttaggtcttgggccctccagaggctttcttcatatccattcattattcctttagttgggctttctaaatatgtctgcaaagagtctgagatacaattagaactgggacctctggtgaagttaagttgaattgtaatcagttggctatacttgtcgtcttccctccctcacaccccaggattactgtatttctgagtcagcactccttttctatctcacctgctcaatttgatgcagagaacttgccaagcatccttttggattagcagcattgatgtgggtgtgttcagttctctgtctggggtgtgtcttttacaactttttttttggtatctcagaaaactctcccctactaaaagctactatttttatctactttagtatatctacttcacaccgtggtacttaattaactcatttatttggtctgggctatgcataaggaagaattggataagaatactaacagtcataactaattgttcagtattcttgagagataaagggagttagtctgataccatgccaagtaagagactgttaactttttttgtgtatgcttcagtgatagagtttgcaatggctgggctctgctgctgaagttccatagtgttgctaaatattctttt

SEQ ID NO: 8868 - DNA, 1042 bp, Homo sapiens; identical to SEQ ID NO: 8867

SEQ ID NO: 8869 - DNA, 1042 bp, Homo sapiens; identical to SEQ ID NO: 8867

SEQ ID NO: 8870 - DNA, 1034 bp, Homo sapiens
cataatgggatgtgtcacatgtagctgagctgaattaacagcatcagtagctttaaaatccctaatgcagtgcctccaaagtgaagaaacttgccaagtaggaatcttaaaaattccctcacccccttcaaacttttagatccacacacagtctttctgctgattcttaaaggcctgagctttgtcctacgtagtgttggcttggggcagagaggagggttgttttccctgaacatgataaggagctgagcagggcaaagtgggggctctggcccgtgattggtagacaggatgccctggaatgcagttggcctgcagcccagaatccagcactttgtatttgtttgtttctgggagactgtggtctggtgctactgtgacaggaagtgagaaagctgggagtgggggaacagagagggtcgatgtctttgtggttctcctgtgaaatctctttgtccctggagagcagctctgctacagagctctgctgagaagagagcagcctttgtgtgtctaatgggtctcggagcatctagctactccgagggattagagagtgtgaattctgactgtggccttttgcgttttagcacttaagttatataaatggtcctgatctcttagcactgggaagcttactgagttttgtgtgtgctgctattctttgtggatctctaggatttaattaagaaaggaattctagaaggaaataaatgttaagtaatgttcatttgctgtatatgttgcaggtaccttgttgggtttaaaagggacagaaggaaacaggtaatgctgaggtcctttacattttatatctcatccttccaattggcaccctactgcatacagatcaggagaaacctacccgcttagtattaagagttactagcaattctctaatgtttgatcataactagagaatggttggtagtttcctgggatttttcttccctatgtctagactgaaatagcacctgtaataccctctctcttttctgccctcttttctctcttgttttgtgttttccctgcct

SEQ ID NO: 8871 - DNA, 1034 bp, Homo sapiens; identical to SEQ ID NO: 8870

SEQ ID NO: 8872 - DNA, 1034 bp, Homo sapiens; identical to SEQ ID NO: 8870

SEQ ID NO: 8873 - DNA, 1053 bp, Homo sapiens
aattgagtaaggttttgttctttaaagtgaagataagacccaaaagtctagctggctccattccaccttctcttgcctccttcccctctccgtaaaaaaaatgtcaactttgggttaacttcttaattggaactagaatgactttttttttttttttgagacagggtcttactctgtcactgaggctggagtacagtggcacaatcttggctgactgcagcctggaaccaccaggctcaagtgatcctcccacctcagcctcccgagtagctggaactacaggcacatgccaccacccccagctaattttttgtattttttgtagagatggtgtcttgccattttgcccaggctggtctcaaactcctgagctcaagcagtctgcctgcctcagcctcccaaagtgctgggattacaggcttgaaccacctctcctggcccgaagaatgacttttaaccccaggaaacatagaaaattcatactctttccactttatcaagaaggagcatggacttggaataaaataggagttttcactacttactactagttgatgagcttgggcaagatactaaatacttctggtatataggtagtatacttatttataaaaagaggccattacctcagcaggtgttgaaaggattatatgataacttcaaggggaagagcaataatgcacaactttcttccccttcaagatgggattttcttctttcagataaggagaaacatttcctcctgctatctgtcctaaagccaagaaaggaccttaacacttctgattgatttatttatagattgacatgctctgtctccctgttgcttatctcaaaaggaagacatactccaaacttgatgaaaagaatgccttattggtcttttcagggttttgaggaattgggactgtgtaaatctggctcaattacatgcttccaccttttccaagttattttcaaatgatgggcaaagaggtgggggaatgccatagattgaaagtttggtgagaagctgctattttctttctttctttctttttcaagatggagttt

SEQ ID NO: 8874 - DNA, 1053 bp, Homo sapiens; identical to SEQ ID NO: 8873

SEQ ID NO: 8875 - DNA, 1053 bp, Homo sapiens; identical to SEQ ID NO: 8873

SEQ ID NO: 8876 - DNA, 1246 bp, Homo sapiens
tttctttatgggttggtgagagggtgggaattggggagaatatttatttcaaaacctgtctttcaacattgtatattttggactggcataaagtctttcatagctataagagagaaaaaaacccattgagtccaacagagtatcactaatgcctgtaaaacctcctgtttatataatggtatggagaactcttcatttttatataactatcttttattgtatagatagcacacatagaccctctagatacttggatatttatcctgagttggaacaaataaaagggtaaaaagatagtctatttaaaacaagagtgtccaatcttttggcttccctgggctacagtggaagaagaattgtgttgggccatacataatgtacgctaaggatagccaatgagctaaaaaagaattgcaaaaaaaaaaatctcataatgtttcaagaaagtttacaaatttgtgttgggccgcattcaaagctgtcctgggctgcatgcgtcccgcgggccaagggttggacaagcttgagttagaggtttctgcaggattacagagatgtgggaacttccagccattgacgtgtggaggttaggatatgaactactgtgaggtgcactttcagaggttgaggctaatactccttttcctacttcccaaggaggtgaagtttcctgaagacagtgcttttttacatgtagagttttttgtggttctgttactctgttgtctccattagtcaaggaacacgttttgccatcaatataatatttaacaaactatagtagtatagtttggaaagtagaaacgcccttttatgaatgtattattatatttttggaggcagagtctcactctgttgtccagcctggagtgcagcggtgccatctcggctcactacactctccgtctcctgggttcacgcaattctcatgcctcggctgggattacaggtgcctaccaccatgcctggctaatttttgtatttttagtagagataaggtttccccatgttggccaggctggtcttgaccaactgaacctgacctcaagtgatccacccacctcggcctcgtaaagtgctgggattacaggtgtgagccacctactttcatttctttctttcttttttttttttttttgagacggagtcttgcattgtcgccccagctggagtgcaatggcgcgatcttggctcactgcaacctccgctattctcctgcctcagcctcccgagttgctgggattat

SEQ ID NO: 8877 - DNA, 1246 bp, Homo sapiens; identical to SEQ ID NO: 8876

SEQ ID NO: 8878 - DNA, 1246 bp, Homo sapiens; identical to SEQ ID NO: 8876

SEQ ID NO: 8879 - DNA, 2042 bp, Homo sapiens
attgctcacttccttaattagtttttctttttcttgtttcctacttgcaggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggtaggcaagaataggggaagagaaaagggtctttccaagaccagggacaaggggtagcttttccttcaacttctaggggctttttgggatcagagatactcgtggcctcctcccctctgcttttttttggggtgaaaagctaccctgtttttcccttttctgacttggcttagtattgacttgctatatatatataatataaatatatatataattttttaaatgaaaataatataattttattttttatttttttgagacagagtcttgctctttcacccatgctggagtacaggggtgccatcttggctcactgccacctccgcctcctgggttcaagtgattctcatgcctcagcctccctagtagttgggactacaggcaagcaccatcacgcctggctaatttttatatttttagtagagatggggtttcaccatgttggccaggctggtctcaaactcccgacctctggtgatccacccgccttggcctccaaaagtgctgggattacaggcgtgagccaccgcgcctggtccacaagttgttttctataattgaatatatgggccaggcgcggtggctcacgcctgtaatcccagcgcttttggagactgaggtgggtggatcacctgaggtccggagttcaagaccagcctgaccaacatggagaaaccccgcctctactaaaaatacaaaattagctgggcgtagtggtgcatgcctgtaatctcagctactcgggaggctgaggcaggagaatcatatgaacccgggaggcagaggttgtggtgagccaagatcatgccattgcactccagcctgggcaacaagagcgaaactccacctcaaaaaaaaaaaaaaaaaaaaacaacttgtgattgttattagtctgtgtcctgaagaatgaactttgcttctgcttctatgctgaagtttttgctgtttctggctaagatgtgacccccttttggtgtgttaggcagaggattctgatgtctggggccatggaattcttgctcacttcttcctgggaatttctttagtttctgatttggtattaagaacagagtccattgggcacggtgtctcacgcttgtaatcccagcactttgggaggccgagttgggcggatcacgaggtcaggagatcgagatcatcctggctaacacggtgaaaccctgtctctactaaaaatacaaaaattagccgggtgttgtggctcgtgcctgtagtctcagctactcaggaggctgaggcaggagaatcacttgaacccgggtggcagaggctgtagtgagccgagatcccgccactgcactccagcctgggtgacatagtgagactgtctcaaaaaaaaaaaaaaaaaagccaaaaaaaccccaaaacaaaacatagttgagggttttaggaattcagaaccaaaagagacagttgaggacgtgtataagaactt

SEQ ID NO: 8880 - DNA, 1075 bp, Homo sapiens
cgcaagctccgcctcatgggttcacgccattctcctgcctcagcctcccaagtagctgggactacaggtgcccgccaccacgcccggctaattttttgtatttttagtgttagccaggatggtcttgatctcccaaccttgtgatccgcccgccttggcctcccaaattgctgggattacaggcgtgagccaccacacccagcctgagcgttgcttatagttaaacattgtttgtttcatgatctgtatgtttattttgagctataatgtagaatatgtttcttggtgagggtcgcaaacaaagcttgaatattactataaggtatttggtcactggggaagactgagaagtgatacgatagggggattctctttgacgttcttcagacatattgtcttgaatgctcaagagccatctgatgaattgtctcttccaggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggtaacagtagggactttgagaatatgaagatgaatttttgaggactgacttaaatttcctaaaaaaaaaaaaaaattaaaattctttagcctattctttagcctccattcctatctgtattgcatactgtaactccaacctttctatctttgttgctattctctcatgtataccacatgtacctatatcagttttcttgctgttccccacacatcctcttcacttttatgcctctttgactttgttcatctactttggtaagcttttgttcagcatctaccacatgtaaggtggtctagtcctggacttgtgtgtgtctatgtccttgccctagttatttgtatttcaagtcaggctgtgataaattcagcaaaaggggtacagagtactaggaggttagggcatgggtgaggaaggtctgttctttctgtgatgcctttctcttcttatttat

SEQ ID NO: 8881 - DNA, 1030 bp, Homo sapiens
atgcgataagcttgttgctttgaggaaaataacacagtgtttgctgcctgagctttcaagtggaaattgtagttttgaaaaacttttatttgccactgtgagcctggtaacttcccaatactgaaaagacttttctaggctgagtgtagtgtctcatgcttataatctcagtactttgggagactgaggcaggaggatcatttgagcccaggagtttgagaccagcctgagcaacataatgagaccatgtctgtacaaaaaaattagccaggcatggtggcacattcctgtagtcccaattactttgggaggctgaggcagggagatcacttgagcccaggtggtcaaggctgcagtgagctgtgattgtgctactgcattccagcctgggcaacagagcaagaccctgtctcaaaaaatacatgattaaaatgaaaaaagacttttctaatgaaataaacagtgatgttaacgaatgtgatttcaaaatattgtgtaatgctatgtgttagcattttgaatatctggataacttgaagcagtattttgcaagtgacaaatacatatgtcaaaatcgtacataggtaattgatccgttaaaagtgcaagatggaccaatggattttaactaaacagaatatgaagtgattgttaattatagattccacattactgtcaacctttaagaaactactactaattagtatactattaaagaagaataaccacaattatctgaaaagactattaaaatcatcctcttttccaactttttatctgtgtgaggctggattttcttgatatacattaactacaataacatatcacaaaagattgaatgcagaagcaggtatgagaatctaagccaaatttcaaagagatatacaaaaatgaaaaggatgttattaaagattatttatgataacatgtaagaagtttaccattaagtgaaatagatactttaaacttgtcagtatggtaacaattaatacataaaactcacaccaatgaaggttctttagatccttat

SEQ ID NO: 8882 - DNA, 1030 bp, Homo sapiens; identical to SEQ ID NO: 8881

SEQ ID NO: 8883 - DNA, 1030 bp, Homo sapiens; identical to SEQ ID NO: 8881

SEQ ID NO: 8884 - DNA, 1551 bp, Homo sapiens
cctcttgtttagctttattatgtcatattctgggtattttatacatattgtcttccatcttagattcaagttctttttttgagacagagtctcactcgttcacctgggctggagtgcagtggcgtgattctcatacctcagcctcccgagtagctgggactacaagtgtacaccatcacacctggcttattcttatatttttagtagagatggggtttcaccatgttggctaggctgatcttgaactcctggccttaagtgatctgcccgtctcagcttcccaaagtgctgggattacaggcatgagccaccacggtcagccagattcaagttctttaagtcggggaccatcagactttaatgcctttgtggagcatttgacaagctcagttcccaacagtgatgcctaattacacctatctgtttgatatacgttttacactagaggggaatgtcatatttctgtgtacttttttttttttaaccagataacaactattccacaccaaatgagagaggagaccacaatagaacactggatcgatcgggggatctaggcgacatggagccattgaagggaacaacacccttgatggtaaattctctttatatactgctatctgtctaaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacacactcatgaggttcctgtctctactcatactaacaaattgcatgtgttcacagcaggacgaggggcaggaatctctggaggaagagttggatgtgttggttttggatgatgaggggggccaagtgtcttacccctccatggtatgtccttcagtcacccccaagattgttcttgaggaaggaggctcctgagtgccagcaacttgtcaatcacgctaatctgatcaggccagagactaagtagtctcagccacatggggctcgaggggttctgcttttgtgattattacctcttacgagtctgggacatgcagctggtgatctgattctccgttatgtgctgctttcctttctccagatttgctcaacttttttggggggggtctccttaatcccaaccccattaacattctctctttctcttttttctccacagcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctt

SEQ ID NO: 8885 - DNA, 1035 bp, Homo sapiens
tacatcacatgccctttagggaatacacagcccgatcatagccttcaaaaatgattcccccccgccttcgcgttagctcaagagccagatgtactagtgtgtttatgtagctttttttttttttcacttttctaaatttttcgcaacccttctcattcttttgagaaatttgccacttattatggtcaggttaaaagcccactgctacgattttaagtatggagtctttcatataaaattatatgagcattctttaatgtttgtttttactaagtagcatatgttttatctttgtgtttcgtgtttttaaatgtaggaacttcatccttgaaattagaatcatctgagaggaattcctttattacctagacgtaatagaggaaacatgaacaggtggccaggagcattgtcttaaattgttcgttaaaataatactcatgttaagaatactgaagcacacaagtttgtaaattctagaaattaatcacattgactattcaattcatgactgaaaacatcattagtgacctttgatttttgagtgaaaacagattagtaaaaacagagaaaattgaagtgagggggagtcagttttaagtgttccctttcttccagtagagatagtggcaaggtttgacttacaccagacctaatagatttaaaacttgaaacagacttggtccaaaattaagagttaagcctgtgtcttggcatgcttgccttagaagcctctcagaaagagaaataaaattcagaggtaatcatattgtggtattagatatgctttcaaatttttgaatgtcagctaagttaacataatttagagaatttgttgtaagaactgcagttctgtcgacagcaaaaatctgtacttacagattcagctgcaattagacttctaattgctgtagatgcatttcatcttacaaaaattttatagttctatattgtttaatctcatgaatttgaaaagatacatgtatatcattgacctcatttggatatgaattccgtgagcaaattccttaacctacc

SEQ ID NO: 8886 - DNA, 1035 bp, Homo sapiens; identical to SEQ ID NO: 8885

SEQ ID NO: 8887 - DNA, 1035 bp, Homo sapiens; identical to SEQ ID NO: 8885

SEQ ID NO: 8888 - DNA, 1739 bp, Homo sapiens
aaccatctagaaattgtatgccttctttgagttgaagagaagaacctttgacatacacataaacaatattgcacacacagagtaggcaactttccattaatttgcaaagctgcaaattaagttgcaaagttgcaacttaaaaaaaaagttaagttgcaaagtgctacattcatttttttcaaactgaaataataaacatgagtattagttcctgtttttgctacccttttttaaccgtgattggtgtataaaacaaatggaaagctactatgctaaaatagtgttaattcattcaacaggtaattgttgagcatccactatgtgtctggcgctattctaggcactggattctactggtaatcaaataaatgaagaagtcaaaacagtgtaataatgtttgatgaagttggagctgagaaagctaagtttagatgaaatgataagggaagaccttttggtggaggtgacatttgagattacacctgaatatgcagatagttaatttggacaaggaacattccacacaaaagttaaaaaggaaaaattacttcaaacttgaaagcttagtttaccactggcagaggattatcttcatgattgtggagtttccaagagtgttagtagaaatcttaagggatggagatctagttcctttttaacttggctttatgttttcattgtttctctgttttgaaccagtgttgtactttgattataaagtaaaagaatagtctacctacacgtaatttttagttatcccagtgttcattttaacttatttcactttctaacctctgactagacatgttatgaagcctaatttttttttctcccatctgttatgtccttagtgaggaataatagttaaaactgcctctcaagataaaacataaaaatggagaccagaataccttaatgtttattaaagtatgttttaaatgtttaatggaatgataataaatactgtagaatcaagtagatgtgggcagtgcttcagttattaatgttagataggttatttattgcagaacttctcagaaactttgatttttgagtaatgtgcagtgtaaataccaaaattttgcagcgattacctaacctatttgacttataagaccccctttttaaagagcatttcgtaaaactggagtttacagaaaacatacttggaaatactgcatgcttgaaaatttgattgtataaaactctggatctcaaccttttattcaaaatcattttactcttttcagttgctcttatgaaatagtgatgtttgacagtgattactgtgagtctctaacttgtgtagtcaggaaaaaagaagtcagtcatcagataaattcataacagatctcagcatttacttagattatttggagcttaactgttaagtatttaccttacctagtttatcataatcagcatactatctgtaattattactaaagtattagtttattttgattatttttcctcctgtctggatgacatcctcagtttttttcttatattgatacagtctaatttatagcttatgcctctgtgctccatgttttaaaattagaattaatttgttattaacagttttcatagatttcaacagttttatttttcatgtattgaaatatctttgattatcgtatcctctcaaatcagtctcttgtatcccattcatcttggcctcttgtcaacttgcaacctcaatataacattgactgtttttacttcctttacagatg

SEQ ID NO: 8889 - DNA, 1739 bp, Homo sapiens; identical to SEQ ID NO: 8888

SEQ ID NO: 8890 - DNA, 1739 bp, Homo sapiens; identical to SEQ ID NO: 8888

SEQ ID NO: 8891 - DNA, 1047 bp, Homo sapiens
aggttcacattgtaacatgttaagattgcattcctttttatggctggataaaaattttcgttgtatgtatatatgacattttgtttatccattcactggttaatggatatttgggttgtttccacaatttgggtattgagaattgtgcttctatgaatattcatatgtaataagtatttctttgaatagctgttttcaatttttggtgtatgtacctagaagtggaattgctggatcatatggtaattctgtgtctaagtttttcttaacatttttcttaacactgttttcttaggttttccataacactgttttcctcattagctgcctcattttacatgtccaccagcaataaacaatggttccaatttctctgcattctcaccaacacttcttattttctttttttattatttttagttagccattgtagtatgtgggaaatggtaatctcatgtgattttgatttgcatttcgttaatgactgatgttccgtatcttttcaagtacttttttggccttttgtatatctctggagaaataatctgtttaggttctttgcccatgttttaattgggttgtttctctttttgttgttaaatccaaagactttatatattttggatattagacttttaccagatatatgacttgcaaatatattctcccattctgtagggttatcttcacttctatgcattttttagtgctagctcctgtgtttaggtctttgatccattttgagttaatttttatatatggtataaggtaggaatacaacgtcattttttgcatgtggatatccatttgtcttagcaccatttcttgaagagactgttttcacctactgaatggtcttagccaccttcttaaaaatcagttgaccacagatgtatagatttatatctggacctttaattcagttagttgattcaattattattagttttatgccggtaatacattgtattgattactgaagctttatagtaagtgttgaaattgagaagaaaaaagtgcgtctttaattctgtttgttttcaagat

SEQ ID NO: 8892 - DNA, 1047 bp, Homo sapiens; identical to SEQ ID NO: 8891

SEQ ID NO: 8893 - DNA, 1047 bp, Homo sapiens; identical to SEQ ID NO: 8891

SEQ ID NO: 8894 - DNA, 1040 bp, Homo sapiens
tatgccttattcataatggtaaactattgttatcaaattggcatcatttatccagtgagtaaaatctacagtataggaggttgtgggcataccatcctttcatcatgaagaagaaaggagctttgttgaggacaggaggttatggagtgagttcaaagtccaactcggtacagttgggttaaggaaaaaaaagatgtgtctattattaaatgttgtaatacttcataggtggtgttgaattgttctttttgatgaaattgttttaaaagtagtcatgacctatatgtaaaagtccttcattattaatctcaaaatatgatttctaaatctaggtgtccttagctaaccttgtgattttgaataagcttcttttttgggcttccagatactttatgggtaaaacgtaatggattgtgcttagactgaatggcctttgaggtattttcacctatattaatgttttattttttattttttctattaaaatagctcagataggagggtgatgcaataatgaatggaaaaagacagctgaaaggaaatgcacaactgattttgatggttgtttagaactgttcgcactgctatttatctctgtgtttcaaactaatttcattacttcagtatattgtcataaaactttcagtgtaattaaagctaaaatagcctatagtcaccacattgctccatagtaaactattttttaatgttaagcaaaaatgttgccatactgtatatatagttttgtgtcttttttatacatttaacaatatttttgctgataattccatgtcatttttaacataaacctacctctatatagtattcaatcatactaaggtatcatggtttatttaagcactttatctttgacagagggttaggttgtttctgttctttgctattataaacataatacagttaacctccatgtggtagtttatatttctagggcatatacttaaaggtgaaattactacacatatttttggacctaccttggaagtaaccagtacttaagaatttcttgtacttcttcc

SEQ ID NO: 8895 - DNA, 1040 bp, Homo sapiens; identical to SEQ ID NO: 8894

SEQ ID NO: 8896 - DNA, 1040 bp, Homo sapiens; identical to SEQ ID NO: 8894

SEQ ID NO: 8897 - DNA, 1056 bp, Homo sapiens
agatcaaagggattatatctgtgaatattgtgctcgggccttcaagagttcccacaatctggcagtgcaccggatgattcacactggcgagaagccattacagtgagtattatttactggtgaacatctgggtgagaaggatatatgccctacttgaaggtttgccgctttacaaacatattagttgccactgctgtttactttcatcaaataaatgagtggatattgattgggggcattagttagtagcctttttcttagtttccctctgtttttcaggcaaacagaagaagatcagattagttttccatctagtaacatttcccaatccttcaaaagaagtatgttactgattattgtgtgtgtgtgtgtgtgtgtgtgtgtgtatgtatatatatgctctaaactctaaccctgatcctgaataagagcactctttatttctctgttggatcagccatttccttttctcctctccttagatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaa

SEQ ID NO: 8898 - DNA, 1066 bp, Homo sapiens
tattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaa

SEQ ID NO: 8899 - DNA, 1028 bp, Homo sapiens
atcagcacaaacttgaaagccaagcatggaataaaattagccttaagataatcaggtttaagtgaagggagagttttaataaaaatggaaaatgtaaagtcatagctctggtattgctgttatttcaagctgctatggatcaatgcccaaaggatgactcattgttgtgatcacttgtcagacagggagaggactagtaaatatttcaggaagacatatctgaaaagttatttagattgaattttgtttgtgaatcctcagctcctcatgaggtacctgagcatctctgttaaggggtgaaatagagacacgggaagcagagagacctccaccaggatgtaaaggggattggtaaagaggaagggggtaggggggagtagaattttgatttcacttcagttgattctgtgtgtgtgtgtgtgtgtgtgtgtgtgtgtgtgtgtgtgcgcgcgcgcgcgtgtgtgactaatgtactgttaatgtactgtttaggtcaggacatttcttaaaaggaatgctttggcctcctgcctcatcccacctccactgcaagcgtcagacccacccaagaatgagctctctgaatgtgggtgcattcaaaagcgaaaaatgataaaaacttcatttcttggcttctgtagccctctgagaactacagataaagacagaataagataatttgatggtttgatgaagtgtctgggtgtgagataaaatctatgtgcttatgattcttaatataaaagattatttcgatcaatctggtttgaacacatagaaaacaaaagatgcaagaatagctaacaataaagttcttttctcagcaataccataagttacttcttttctgtatctttggatgaatgaggggaatttcaagtgacttcagcattggatgaagcataatcctcctagccagggccaggcccaatcaagcgtgctgagtaaatctccatggtgccaggccactcacactgggcaaaactcccagggccagtcagcctagaaaaggtagattgcccctatat

SEQ ID NO: 8900 - DNA, 1028 bp, Homo sapiens; identical to SEQ ID NO: 8899

SEQ ID NO: 8901 - DNA, 1047 bp, Homo sapiens
cacagcagagctgttggctttgcaggctgtctgcctcctggagtcatctgtgaccgggtccattagcctctccaagcccagctgcaggagtgtgggtgacagagaggatggcgcaagacccagacccatgtgtcccatattttccaagtcagcgctgtgggagggccgcgcctttcccaggcagctgtgccatctcctctccagcctggctggagttgctggggagaaggacagaaaggggaggaggctttgcctaatatttatatatgtctcagggaaaaggagaagtgacagctgttctagcagtggttccaaatgttaggctggggattgctacatctgcagcttctcaggagctttgggaaatgcagcttctcgtgctccacaggtggatattctggtctggatctgggaccttgtccttctaaaaacatcttaggtgactcttttgtacaccctggtttgaacttgcttctttgttttttcatccttcaacaaatatcaattgaatgcctactagtgcctggctctgaacaaaacagacaaagatattttgccctttgtagagcctagattctagaagggggcataataagcaataatttcttttaaaggatcctaagtagagcaggagtcctggcgtgggatggaggggtgggtagcaatattcaatactatggtctcaggaacctcacctgataggtaggatttaagccaggactgaaggagttgtaggaggaaactaagcagttgtctggtggaagggcattttgggtacagggaacagcatatgcaaaggctctgaggcaggagtgcacctggctccttgagagctgagtgatatgagaggaagcaagatgaataagagaagctgggtggcagtgttggcagatcgtgctgggctctgtaggccttgctaggactttaactttgactctgagtgaactgaggaacatagttctgaggttctgagtggtggcatgacatggcctgacttaggttttgaagatgtcacttcctgctgtctgctgtgttaagcacttaact

SEQ ID NO: 8902 - DNA, 1048 bp, Homo sapiens
agtgtgctcccatcagtgagagagaaggaagttcttatcacagcgctagacccatggtgagtattcgttcataccattgtaaatgggtttcccaatcaccctttcttccccagggttagtgattttcagctacaattttctttggacaatttcaaaacacccttgattggcccttcaaaggtactaaagactgttgccaaagtacacctggtaatccctgccctagaatcccactgttggaagaggggaaggctgtttgggatgcttgtcttgtctattatctgacaatgcaatggtatcccctcattagagctggttctttggaatctggaagactccataggtgatcattctctccttacagtgtctgagcatttcctaagtcattgactcatgttctttcgtgtacctgagataacttttactccctatttccatgagtacttatttctccaggccaagcttagattacatcagagtctgagatctccctgatagctcccaacctctcactaagcaagaagtatgtctggattatacgtctgtctggtctggtctatacgtctcttactgtgggaaagaagtagaggtaagagaggtgggagacctgagcttgaatcctggcttattagctgaatgaccttggacaaggttttccaatctctgagagagactttccatctggaaaatggagattaaaactatacctactttatggggtcttatgctattattattcaaattgatatcgcctttgtattaaaggctgtaattttttccttcatcttcatgtagcctatttgattgaagttcccaaagtgctttcttggtgtccctgagagacatgcttatagtggtggtcagtcattgatgggggatgcaaatctggatcacttgctcactttcccaaccctgggctaaaaggattcattgggatcttgcatttcaagaagttattttgggcttaaaggggtttcttagcacatttgttccctatttgatgtctatattcaagaagaatatggtaactctacatttatttccatgg

SEQ ID NO: 8903 - DNA, 1102 bp, Homo sapiens
tgcctcccctgatgtgttcatcgcggagaggtcgcacgtgtctggctctgtggcgcaatggatagcgcattggacttctagatagttagagaaattcaaaggttgtgggttcgagtcccaccagagtcgctttttgtttgaagaagagcaaacggaaagttaggcggagggaatggatataaaatagatgaaacgagaactgtctaccatttaaaatttccggaatgatgtgaattgcagctaattgcagttcctggttatgtcccttcacttgaaggcgtaaagaatcccgttcctctatcgagccttttctccttcacttttacctggccccagtttctagtggcgagataaagaaattagggaaatataatcaaagttaccaagttttttccccatattattcttttatatcaggaaaaaaagtaattttaaattgttccgaaactttagtcgcctagtgttacccgagttgctttaaaataaaacattgttttatcagttaccagaatggccgagtggttaaggcgttggacttaagatccaatggattcatatccgcgtgggttcgaaccccacttctggtaaagaggagttgtttttcctggcaaaaaccttttttcctaatccttgacaatccattttgcaatcttaagcgtccagataacaataactatagttaatatcattttgccagataccttacatatagcgacagcttcacagtttatggtttgaaaagtagaaagaaaacgtctgaaaaaaagaaagaaaacgtctgggtccagctatatgggagtgagggagcacagagcgagaggcacattgtgctgcaaaaacgttcactccgagtcgacagttatttcttgagatcctattacgtgccaagtactgttctaaacactggggttgtggtgatgtaggtttggttttttttcttttaaagcaaaacaacaaaaaatacaagagccttaccatcaagaccactgcccaatgtcacttacatgacaaagtgacagaagaaaaatatggtttaaaaacaagcagacagccgggcacggtggctgacgcctgtaatcccagcacttcgggaggacgaggc

SEQ ID NO: 8904 - DNA, 1078 bp, Homo sapiens
agctcagctgattcttccagcccaatctgaccttttcagatatgtaaaggtggttggagatacataagttactttacgtaccagataagtaaagagaccttgtatctaatcctctcaaccctgcaaagcagagtgggtttttctattattctcattctgcaagtgagtgaattgaggcttaacaagaaaggcaaggatcctagattgtcttaatcactctcgcattggtgtataaaccatcaagcatataaacaactcaagggagcatcagcagggtcgcatgtgcatggtacctgctgaccaccatgatcagagctttgtgacctctgtgtgcctagcatcctgctgggcgtcaagtttaggcaggattgacaaagtcctagtatcaaagggtaaatgatcacatagggaagacaaagacatgtagtatatgacaagagggccaacagtaatcaaagccatatggtggtaatggagaagccagtgatgtatggaatagaggttgaaggctttggactcccttggagacggatctgtagaggactggaaatgacgtggatgtaatggcccttcaaagaccagcactaataaggacacactaatgaaatcaaccacctggggctctaaaggccagactaactttttactctctctgtgtcttgctgcttcctaaatggctgttattggcctccttccccactggaagctccaggatctttgtggaatcatagttccttaggataacattataaccccatcagcaacatggagctgtgtacttctcctttaaagcttaatttgttaataaatatttatcgagccgcttttatgtgccaggtgctttggatcataactgaaccttaacataccaatctgcgcttcactgagattctgtctttctctagtcataaaatttcattcaagtcaggattcctgcctcccctcttctctgtacctgggaggattcattctctggaagagctgtttttctgtgagcagacgggaaccagagctgagagtgatggggattgagtagggattacagccccatcagccggaggccagaaaatgcttggat

SEQ ID NO: 8905 - DNA, 1798 bp, Homo sapiens
ccaagctccgcctcccttctctttttctctaccttgtacctagctcatgctaactgctatctatacattatgtcatatctgatggagcacctgttatttctactttataaatgagacagttgagggtcaggggctcagtaactggcttcaggccacctagtaagtagaggcactgggattcaagttcagatcccaatcattctgtttctaccacaccactgtatttgcccaccctctggtgcccctgccgcttaaggacttctaggcttctgtgctcacgactgtggttatccagctctggtggcgtctgctttttagacttctctcctttgactggttctcttgggctctgatattgttgttgtttagttctttgtttttcatccaactttacctattgcttatgcagggatttaggggactgggaagttattttacatggtgaatccaggctgggtggcattttctgatatccaggcagtgtactgggtctgacaggtaggagtatgggcaaaagtaggaaattagaactctatcaaaaatgcctttacattccctcttaaaatggaaaaaatcagtcagtgactttttatcttggccaactgctccttagagaccccacgatagtggctctgattctatctgtccacatatacagaactgcagtgtgagctgagagctgagagaggccccatatttccctctgctggcattcctagcctagaagtaatttaagaaatttaaactgtcctaggctgggtgtggtggttcacacctataatcccagaactttgggaggccgaggtgagaggattgcttgagcccaggaatttgagaccagactggggaacatgggaagatcctgtctctacaaaaataaagaaaatgagctgagcatggtggtgcatgcctgtagtcctatgtactcaggaggctgaggcaggaggatcacttgagcccaggaggtcgaggctgcagtgagccatgatcatgccactgcactctagcctgagtgatagagaaaaaccctgtcttaaaaataaatgaagtatcctagaaggatgtctgtatgtagagatgtaggcctcttactcagactggtaagatattttctatgtagaggtgacaggggttaggttttggatgagttgttatttttttggttgtttgtaataatgatttgtttttgtcttattcctctctccagaaattgataattatcattgtgctagtagttgtgttgctgggcattttagcattgattattggactttccgttgggctgaattaagagtggcctaagaggctgctgcactgaaatgtaagtaaacgagtggttcttggggactctggatttggctcctcaagaggaaattagcttgggatttcaaattcctcttctttccccctatgattgtccttggacacactgagctttctaaaactttcagtagcctgtggattctttatctccttatagttctattggtttctggctgcagtacgtggatgagctctccgtttgttcttatcctgtagattctgtccccaatctctgtcttgtcgtattaccacttctcccagcatacctgagcaccccaggtgactccccttactcaggaagcatgcttctaagttgggtacatctctgtcttggatctggagtctgtcttctgaattcttactgattttcatggatgttgggctttactttctgtatccttttcaatgtaaatgaaactctgaattgggatttggatctgcagagttttctctgttgctgagtggttgggtctta

SEQ ID NO: 8906 - DNA, 1032 bp, Homo sapiens
atagttaacacacttttgagtgttgtgttgtaccagacaatgtactaaacaccttatacacatatcattgaatccttacaacatcctttgagacagatacagtgttatgcacattttacagacaaagaaactcagtcaaagagaatgttgaataacagggccaagttcacacagctaatagtggacctagcttctctttgtaaaagaaggtagccacttatcattaactataaagcctggagaaccttagaggatagcgatgctaaaatttagactattcattttcttgaaaatttgttaaaagtgatagacttaccactgaatcactggtttttttttttttttgagacggagtcttgctctatctcccagcctggggtgcagtggcatgatctcggctcactgcaacctccgcctcctggattcaagcaattctcctgcctcagcctcctgagtagctgggattacaggcacatgccacagcgcctagctaatttttgtattattagtagagatggggttttgccatgttggccagaatgccttgaactcctgacctcaggtgatttgcccgcctaagctgggattacaggcgtgagccactgcgcccggcctgaatcaaaacaaacaaaaaacgtttttgttgttgttgttttttgtttgtttctcattcttgtcccccaggctggagtgcagtggcgcgatctcagctcactgcagcctccgcctcctgggttcaagcgattctcctgcctcagcctcccgagtagctgggattataggtgcctgccaccacgcccggctaatttttgtatttttagtagagacgaggtttcaccatgttggccatgctggtctcctgacctcaggtgatccacccgcctcggcctcccaaagtgctaggattacaggcgtgagccactgcacccggcctgaatcacgtttaatagtagtgagcatatcaatctggttattgggactattaagacttttgtgactttaaaacaaacaatttttttttgttgttgagat

SEQ ID NO: 8907 - DNA, 1001 bp, Homo sapiens
attcatattcagaatatataaaagtcttttgcaaattaaccttaaaaatacagacaacgaaatagaaaatttggaaaatgatttcacaatagagggtgtccaaatggtcagtaaatgtttgagaaggggctcaacctcattagtagttcaggaaatttaaaattgaaccacaatgagagaatgatggtgagatgaaatcacaaatgtgtcacctgtgtcagtctcctgatgctttttaaatcctagggctcttgttccttacagtttaattaataagtatcacaggtaggtgtgtaggacttcactgagacacatccatatacctagagatgtataatagattgagtaactttatttacatcatgatttctaattttaaaataatttttaagaagttggtagtcaagtggcccagactaaagctatgctaagaaaaatgcctctcaaatttaatatgcaggtgaactacttggaaatctcattgaaatgcagtttgtgattgatactgtaagtctagagtgaaacctgttattttgcgtctaacaagctcccaggttgcctatggcacaggtgaagtgttgcagctactgccagctgatgggccatgttttgagaagatgctaaggggtttccctgggctgccccagcagagggtaattgcagacagctgaatgtggccaaaggtttataagcactcaaggaacccccagctccttgccatttcttgttttctatgttgtgtcttggagtctggagcaatgaagacctctgtgctcttaggtaggtccttcctcttttctttattgttttggaattcttctggattcaacccaggtatgcataagaaatatcttcagaggtggtgatttaaactgataagattactttctaaaacactgctgtgtaaaaagctgagatttttttttttccccctgattataaaccaacaggtagggctgcctgtttctattactcagttaagaaaaaattactctttctgg

SEQ ID NO: 8908 - DNA, 1050 bp, Homo sapiens
ggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagaggtcagcgggaggggagggccggggcgaggggcggccgggcccggccgagtgggagcgagtgatgcccgggagccaccaacctttgggttctcggactgaaccctgagcggggtcgccccgcagcgccctgaaggtcggagagttcttgccctcgggaacctgcccccagccactcgcccctaaggcttccttcaccttgcacgacccggcaactccttcctgacccggggcagcccggcgcaggggcttccccgtcccgcaccttctgcgagggacccctcagcccgggcatcgaacccggcggccccggtcccgggcgcactagcgtcatccccactccctcactgtggtctgtagcgctgcaccctcctagcctccttccgccgccaccaacccacccccctcgggagtggaaagcagcccctttgcctgggacctgcaacagacgcaagccctccctcccccttcccccagggctccctgaccttggcgtctccagggatggccgcatccttgccttccagaacctttgagaggattcctgtcactgcgggaaagggcagcaacttccctgtgcttcggggtgggggtcggactcccttggcctgggctagctgggctgtggctgcaa

SEQ ID NO: 8909 - DNA, 1087 bp, Homo sapiens
gggctgaaacaatggcagttattgctgttataatatgatgtaataattatacaatggtaaaaattattattattattattaccggtgattgtgaagtgaaataaaagggagggtggtagagcaacttcctctatcttgaagttctaagaggggaagcatggagtctgcatgtatgcaaatcccagccacctgaagggggaaggtgcctttccccacttgtggtcctttgctcaaatgtgtgtggttcctgctggagggccttggtgggagatctgctttgtcccacctctgcctacctggctgtagctggttgccaggtggctccaagagcaatgtcaaaggccagcatgaataaggagccaaagttttgggttcacacccctgctctgccaggaggaagactggtatgcaatggccagttcccctgactgagccccagggaacctcaaggaatggcccctacagtaaaatcttaaacaaagaacaggggcttaaccaacaatcctgctgcaacatgcattccagtgacacacagagctgaactcagtgggagcccgtcctacggcctgaggtcagggctgctctcttctggcccatgccttttttttttttttaatctatttattttgaaacagagtctcactctgtccccaggctggagtgcaatggtacagtccggctcactgcagtctcagctacccaggctcaagggatcctcccacctcagcctccccagtagctaggactacaggcatgtgccaccacacccggctgatttattgtattttttgtagagagggagttttgccatgttgcccaggctggtctcaaactcctggactcaagcgatccacccacctcggcctctcagagtgctgggactacaggcatgagccacccacccggcccagcctcacacctgtctttagtggcttagcccgcccacctgccctctgcccttccataggtgtctgaggcctgtgatgccgtgttcgtggctggcaaggagagccggggcgcccggggggtgcgagtggacttctggtggcgccggctccgcgcctcgctgcggctgaccgtgtgggcc

SEQ ID NO: 8910 - DNA, 1127 bp, Homo sapiens
tttcactgtctcagttcctccagatccagctggtgccctcgcctgacgtttgaacgaccacctgctcacctcctcccttttgcgcgttgattcttcagacttcaaagggcccaccggtctgcttgcccaacgttattagtgcccctattgctctacaaattcgaacctcaaacacaaaaccagtatttctccgtagggaaccttaatgagccaggagagccgtcagccctgcagcctccagggtaccccacatcaaacaggctccccgggaacaagaggaataccacgtggcttggcacactcgcagaatgccagagaggagccaacccccattttacagatgaggaagctgaggcttagggaggaattggtttacctaagaccctccccacaaccccaagtaggctgaggcagagctatgttgattcttcctattgtgcacccacacagaggccaacacgctgctgaaccaggctgaactgaggaaaagctagaaagtcatcgtggtttacatcttgcctttcccatagcagagactctgcctgactttggaggcactgaattatcagtagtaaaaacacactctgtagaaaaactagacattggtttagattctggctgttacctgtattaccttggacaagtccctagagctctctgagtctgtttcccagaagtaaaatgggtcacaaacctggctagctccccccattcccttcccttttggtgccaaggccagtgagggcaagcgtgtgacgagctttgttaactttttcgctgcatgtgatgcccgtgtaaaagatagttattctgaggatcactgtcctttagtgatgaagtgggtgctgttcctggacataaaggcagacctgtgcttgacatggattgatctgtcttctggcagtgaagtgcaggcatgaaccttggtcagccccacactcttctccatccgtagcccatgtactagagtttggacttggaccgaagtctggggcagctccctaattactagggtgctgaaggcgtgattgtgccagtcgactgcgagttccttccgcagcttgtatcgttacccactcctgcaggtgctgctgctgcctccactgtactcagacccaggtagcaca

SEQ ID NO: 8911 - DNA, 1091 bp, Homo sapiens
aataatattgaggatcttttcaagggcttatcagccctttatgtatatttggtgacatgtctcttcaaattccgccccccaccactcctcccttttttttttttttgagacaggatctcactctgtcacccaggctggagtgcagtggtgcagtcatggctcagtgcaggctccacctcctgggctcaagcgatcctcccacctcagcctccagaatagctgggactacaggccggcagcaccatgcccagctaatttttgttgttgttgtattttttgtggagatgaggttttgccatgttgcccagactggtctcaaactcctgagctcaagcaatccacctgcctcggcctcccaaagtgctgggattacaggtgtgagccaccatgcctggccagattttccattttggaagatactttcactggatatagaattcgagggtcacaatgttttttcttctgttaaatagaaacacttctaccgccagctcttagtgtacaagatcgggtagtcaggagttccgctgggtttggactttggttttgctctggttaccttcagtgcatcaccagcttcatattccctccggtgttaccatgtgctgttttctcatttccatagtttgtgacgaggtctgctgtatctttgttcctttttatgtgtcttctctttctgaatcttttcaatattttgtctttggtttctagccgtttcaatattatatacataggtatttatttgatatttatatatgtaggcatttgatatttatcgtgcttttgggttctctgggcatcttggatctgtgttttcatatcttttattattgttgaaaaattctcagctgttaccccttcagctatttcttctgctttgttttctccctcttttccttctaggattctagttatacttagttaaatggtttaatattgtccaacagctgttgtgggggttttgttttttgtttttttgagacagtcttgctgtgtcaccaaggctggagagcagtggcgcaatcttggctcactacaacctctgcctcctgggtccaagcgattcttgtgcctcaggctcctgagcaact

SEQ ID NO: 8912 - DNA, 1046 bp, Homo sapiens
actgcaacctctgcctcatggattcaagtgattctccggcctcagcctcctgagtagctgggattacaggcatgcacctccacgcccggctaatttttgtatttttaatagagatggggtgtcaccatgttggccaggctggtctcaaactcctgactttaccacccgcttcggcctctcaaagtgctgggattacaggcgtgggccaccgtgcccggcccttgaatttttaaaaaggcagctgcttagtatagatcagattcttgtgaacttagtatagcaatcgcctatgaacacacatgattcctactgatctatttgaacagcagcaataacatttactgagcacttattccagagcagacattaggctaacaccatacatggcttgtcctgctgaattccatagcagtctgatgaagttgcttgtattgttgtcttcattttgccaaagaggaaacaggcccagagggactgagttactcacctatggtgacagtggcttagcacttagcaaacaaactgatataggacccttggaaagttggaggtctgtgttatgcattagcaaaatgtttgataaaactacagcccactgtagcttgggagggtatcccatgtgctttccaggctgacagccaaaggcaacgcagttggaaagcagaaaacttgtcatctctcttggctactgtaggctgtatttgttgaggatttataaggaagggatgagctcaggcgaggattacctggtgtttgagcagtaatgaaaggaaataaagtacagaaacccacggtctttcagggttggaaaatctgctacaccccaaataggaagagatgagatataagactcatctgggcaagaaaagcctggtaaaacttttctcttggatgcagttactcaggacaagcatcaggttaaaggtgggcctcctatttattgttccaaatagcctcaagctagccattgagtagaaagggagagacatggaggatgaacaggcaaaacatattagacctaagaactggatctaggaaaagacttg

SEQ ID NO: 8913 - DNA, 1019 bp, Homo sapiens
agatcatgccactgcactgcagcctgggtgtcagagtgagactccgtctcaaaaaaaaaaaaaaaaaaaaaaaagagctaggcatggtggcacacacctgtggtcccagctacttgggaagctgaggtgagcagattgcttgagccccatgggttgagcctgcagtgagcaataatcacacccctgcaccccagcctgtgcaacagaatgagaccgtgtctctaaaaaaacaaaagaaaaattggtatataagtggacgcatgcagttcaaacttactgttcaagagtcacatgtatttcaatacgctggtctgaacatgtcttccacttccttaaaacccttctatggctgctcattgctgttaagaaaatgaaaattcttaacacgacctacagtggcccactgcaaccttgacttcccagactcaagggatcctcccacctcagcctcccaagtaggctaatttatttatttttttatttgtagagatagaggtctcactatgttgcccaggctggtcttgaactcctgggctcaaccgatcctcctaccttggcctcccaaaatgccaggcttataggcatgagctaccgcacccggcctaacttctccattttatttatttatttgtttgtttatttatttatttatttacttttgagatggagtctggctctgtcacccaggctggagtgcagtggtgcaatctcggctcactgcaacctccgcctcccaggctcaagcgattctcgtgcctcagcctcccaagtagctaggactacagatgccacaaccacgcccagctaattttttgtattttagtagagacaggatttcaccatgttgcctagggtggtctcacactcctgagctcaggcgatccacctgcctcggcttcccaaagtgctgggattacagatgtgagccaccacacccggcttccattttttttttttttttttttgagatggagtcttgctctgtcacccaggctggagtgcagtggcacgatctcggc

SEQ ID NO: 8914 - DNA, 1052 bp, Homo sapiens
ggaccaggaagcttcctgaccttgccccaggagctggcagcccccagtcccaccttgtccagagatcactcaggggaaaccactctggctgagggattcaggtgctggtgccaactaggagaagcagtctagggcgcctcccagtggacaccaagggaacgtctattctggctggcccttggtccagccctgtgattttagcccttggcatgcagtcaggctccagtactgaccccagcaccagcagtggcaaattgcacctcatttgaggaatctcagtttcctcttccacaaaacggaaataatgataacatcaccacacaagaccacagtgaggcttccttcggacgacctaggcgacccgccttccacactaatgttttccaggtctagagaggccagggcttgcctggggaccacagtgagatgtggtgaggagccaggggttcaggctctcaggctcctggtccactgctctttccactgctgggaggtgcctcaatgtaaccttggactctccaggcctattaactcctccgtgtagctctggaagttttcagatgttttagtgctattaacatgcctgtcccaggaacaagcttacaaatgcatccaattaaccttctgccaacaattctgggacgtgatttcttttccagcctttgcagggagatctctcttcccatctccttcctggaagacagaagccttgtgcgagccccttgtgtgatgtcaccccagctagggccaccggacgttggtcctcagcagggagactttgggtcctccaccaggacccagggctgacctgcatggccaggccccatggcctgggtagaaccttgtttctgctccaggtaaggaattgcaggggtgagggtgtgtggaggaaaggggcctccacagtggggaagggggctacagagggaatcccagccccagccccagccccagaggacccatttatttgctctctaactgtggtgaaggggccctttctgaaatgcaagcagctcccgagttcctctacggcagtgtcgggctggtgctgg

SEQ ID NO: 8915 - DNA, 1174 bp, Homo sapiens
cctccagtctcagcccctgaggggcctgagctggatgcagaccagctgctgggcccttcctctctcctccatcaggttccagaggcctcttgctgggaaatagtttccatgaagtgaacacgctctcatctaatttttgcacagtcctatgacataaatgttgtcactcccattttacagatgaggaaatggaggctcagagagattaggaaacttgcctaagatgtgtctgattccacagttcagacatgattctgagatcctgatagaatgaggaaatgggccaggcgcggtggctcatgcctgtaatcccagcactttgggaggccgaggcgggtggaccacttgaggtcaggagttcaagaccagcctggccaacatgacgaaaccccgtctctactaaaaatacaaaaattagctgggcctggtggtgggtgcgtgtaatcccatctaccctagggactgaagcaggagaatctcttgaacccaggaggcagaggttgcagtgagtcaagatcacaccattgcactccagcctggacaacaagagcaaaactccatcagggatgccccggggacttgagagcacagaagctaggagaggtggtgggcacattgcaagcggtcattcaggggccaacaggaccaaatggtgacaggacgggcttggggcctgggaggcggggggtggggggtctgctaatggcccgctgcctctgcctttgctactgagctggctgaaagcccagcgataggaaaggccaggccggggttctaggcccttccctggcatgcaagtggcagccatccttcagccaggcctgctctccttgcagccatcctggtgatcgagttcatctacgccatcgtgggcatcgtctggctcactcagtactacacctcctgcaacgacctcactgccaagaatgtcaccctcggtacgtctgggtgaggcctgctggagcctcagcagccccgggggcacaggggacgagatcagtttagagaggaagaagcttgggcattgccagagggcagtgccttctgtgggggcaccagcaggttggctgggcgagactgcttccctcacccttgaggcctgccagctacctggtctggggtgggctgcagcaggcacagagctgctcaggtcaagccgaggctcctcagcacc

SEQ ID NO: 8916 - DNA, 1708 bp, Homo sapiens
ccacttccctaccaccagaccagctctgaggcctgaatgtcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatacccaggaagggtcctggcttcccttctctgtgcctggcctgctgtcttccctcttttcctgagaccctgtgcaccccaacctcccgctggccacctcccagcctgaactctgaccaagcccccatggctcaggatgcgccagctcagctaccttctctctgttccccaaaaaagcctctttttttcctgcctcatggccttggccctccttctccctagaccagtggcactgggaacaggcatgctcccagctaggaagaagccggggacataaagctagcagctgtggtgaggataccagggtgagtgctgagggtgagggacctgggcttcctgtttttaatgattaagcctcagcctcaaaaagcttttgacagcctggacaacatggccagaccctatctctaccaaaatggaaaaaattagccaggtatggtggcatgtgcctgtagtcccagctactcaggaggctgaggtgggaggattgcttgaacccaggaggtcgaggctgcactgagctgagattgtgccactgcactccagacagagtgagactctgttaaaaaaaaaaaaaaaaaagctttgattatgaggttatatctattgatcgttactgtattaaaaattaaaactgaggagtttaaaagtattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagacactggcattattctacattttgcaaatctctttattgtatgactttaaataagccacattctgcgtttgatctgttgttgcattgtgttgtttgggttaaagtaactgaagaactggacgggcgaggtggctcacacctgtaatcccagcacattgggaggccgaggtgggcagatcatgaggttaagagattgagactgtcttggccaacatggtgaaaccctgtctctactgaaaatacaaaaaattatctgggcgtggtggcacgtgcctgtagtcccagctactcaggaagctgaggcaggaggattgcttgaaaccgggaggtggaggttacagtgagctgaattcacgccacttcactccagcctgggtgatacagtgagactctgtctcaaaaaaaaaaagtagctaaagaacatctggcctcacatagacgtgtagttgggaaagggaggagtatcttcatagctttttcagataattatgcatattctttgttatcaggaccagcgcaagaagtggtagttcttaaaggtttgttgtggtgtggaatctgaaaccatgttgctgattccacacgggtctaccttgcactttgttttgtttttttttgttttgttttg

SEQ ID NO: 8917 - DNA, 1571 bp, Homo sapiens
agccaaggtgagcaccagggctggaagcaattcctgggctgagtcttccccactgagccttgaccgcccaggagctgccccgttttccctgtctgaccaggcagtgagtgatgtgggtgttggccacctggtctccttgcagcacccgtcagcgttgctggttgcctggctagacctgaccctggggcgtgggctccagaggttgggggtgaggcggggctgccaggaagagctacattcaaactggctggggtaggataggagtgctccaggattacacccagtgctgcttcgggccaggacacagactccttttcctggaggccgtgtcctgccatcactaaaaccagccccctccctccttgctgcagagcagagggtttgttcttgggacggggaaacagggtgacagggcagacctgctggccttgccagccccatggtgaatagagaacagaccacaaaagagatgcagctcacctgggcccaagaggtggaggcggagctgaggacagggctcacatcctgagacagctctgtggtggggtgccagggagatgaagccacattctgaagctgacatccctcgtctgtccatggagccattgccgggagctgccatcctcctatcctacagggggctgtgggttcgtggccctggccagggcaccttgtgttgacctcttgggtccccatccctggaatggtagagggactccctagggggagggcttggactagctgggcagtcccctcagagtccctcttctgttttcagttctgagcagaaggaaccccccgaggaggctgagcctgtggcggcagctgagccagaggtaagacggctgcctggggaagggaggactcacctctggggctcccgctctgcactacggccatcctgggccttgggttccaggtcaagacccctaaagccttggttctttccacaggtccctgagaacaatggaaataactcgtggccccacaatgacacggagattgccaacagcacacccaacccgaagcctgcagccagcagcccggaaacaccctctgcagggcagcaaggtgaggcttcctgacctgccgtgtgcagtgcccggagccacagcgggccttggcggcctcggcctgaccttctctctggggataaggaagccccattttctgggccagtaggctaaagagaaattaaacctgggggtgcagagatcccttttgagtctgtagacttcacctcccaccgttgggctggagctgtcactgagtgcagcatggggggctgtggctggttgggacaggaagcagaggaaggggctgcatcggggtatggatatgaagaggccaggtcaaggccttgaccttgactccaggggccagtgggaagagctgtgggctggggattgaacaccccacctggcctcctgctttgcctcccccgccagctcctttctgacctttgtatgtccatccttgtctaaagagggctggagagcagtgggtttgggagtgtcccagggtcctgctcacatctccctgagaagggtgcctctctctggtggaaagtg

SEQ ID NO: 8918 - DNA, 1027 bp, Homo sapiens
caggaggggtggaatttagaagctgtgcaaggggcttggagctcctgcttctacaaggcgtccacacactgttcttcgtgtcagaggtgggtggggcacgtctggggctgccgcctcgacaggaccgtcccgccctgccttgcctatcatagagccaggcactcgcggggaggtgttcgtgagctgggggtagccaggccctggcatctgtagatttgtatttttagtagaggccgggtttcactatgttggccaggctggtgctgaactcctgacctcaaggatccgcccaccttggcctcccaaagtgcttgtagattcctcaaggctagtcagggttaaggctgatatgtctgcgtttggccaccccggagctgccaggaagggagccttgcccactgccaaggctgctgcccaaggaccccttccccctacacccccattcccaccctgccgccgccatcgtttctgcagccttgctgaaattgctgtcttcacagaggccaagacggaccaagcagatggacccagagagccaccgcagagtgccaggtttgcatccgggaaggggtgtgtaggtaactctgagggccctggaggatgtggccttgtgtccttgctcagggaaggtggatgtgtgctcaggggcttcagagcctctctgctggggtgtggcctggtgttgtgacttaaccaaggaggcagctccatgctgtggatgagcgcaaacctgggaatagggcgacccgattgttgaccccgtcttagtgtggtctcctggccatgtgaccttggactgttcacctcccttcctctgagtgggcagcagagggttgcttaggctctgcagcctctttcagtctagaggcctgtggcctgggcccggtattgttcaccggggtgacttttgatggggtgtggctgggctgtggcgggctgccctgtgatgccgccgcccgcgccttggcaggaggaagcgcagctacaagcaggccgtgagtgagctggacgaggagcagcacctgga

SEQ ID NO: 8919 - DNA, 1122 bp, Homo sapiens
ggtacttgtggacacctccaccactggggtgagggttgggtgacaggagaggcggtgggggtgctgctggcaggagggcaggccccacgcaggcttgctggcacagctgggcatgtggcctgcccggcaggatgctccccggcctggcattaactcttgccttttcccttgtctcctccacagtgcagcttcgtcgtaagtaaagccttttcctgtcggtaacctcgccccacctagcactcacccgctgtagccccttccctgcgtagctgacagcacctgtagatgcactaacattgtaagcgggaggggagccttaggaagagagtgggacggtgaggggtgcactggctggaggcgcccagcagttctgggccccagcgtccttctctgccctccctgcccttgactctgctcttaggaggaagcaagggggtgtggcttttcaccagggctacagcttgatgtgttctccacagccaccttccctccctcctcccctgcaccaggccccgtcagggtctgtgggtctttgaagagaacagacaggttgtctgtggtccccagagctactgagatttattggttcacagacctgagcagtagccttgaggcagtggggtgatgggggagcgcaagtgtgggtctgaactgaggtggaagtgctgggtcttgctgtgctgggtgacagtagaacagtgggtggtagcgtctagaaacaagtcgcagaagctgttctcttctcagacacctcagagctgagccgagccaggcaggccctgagcaaggaccctcagatggggacatgcttagcctgcagccccagctccctgtgccatttgccaaggccacagacacctcattcctttagttcctgcaagccttctgaagggtcctctgcagccacacagggacacctgtgacagccgggagggcttctgcctccagttgagggcctcggcaggtgagaggggcttcccagcagctggccaggtgggccctgagctggcttctccgcatggaggcctgttcccctcttgttggagagggtgactgacagtataccttccagtggccttaccacctgtgccgattagagccctgcaggtctcacagggtgat

SEQ ID NO: 8920 - DNA, 1283 bp, Homo sapiens
cagcactgcaccagggcctgtggggtctgtgagaagcagctggccaaggtggtcaaggatggcatcctatgcttaagctctggaactgggcttgtcttcaaacacaggctctgccattattagctgtatgcctttgggcaaatctgctgaatgggagaatacagaacctgcctcccaggtggtggtcgggacaggttcaaggagtgcctggctcatgcgagctctcaaggactttgtaaggttaagctgccagaggaaggttggaaggatgtgacacaagggcgttctctgggtttgatggtggtacaggcaggggcagggctgaagagggtgacagagctctctgtagggaggttggagagggtgacagggctctgtggtgggcaagggatggggaggttcatggagagccccaaggcagtgtctggtctgtggtctcctgcaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaagggga

SEQ ID NO: 8921 - DNA, 1093 bp, Homo sapiens
gcttaaggacaaaataaagcctaaatccaagaacacttttaaaaatgaggaaatagtgaacacaatagacggaagtctggaagtttctacccatgccaagaaaagcattttatgttttgttcacatatgttgtgcaattcaaatttttttccctatattctctgactagacacttgtactgagtcaattggcgagtgtgtctgtctaaaagcacaatatcaaaatatcacttaaagcatctttacatagtgtgtttaagaaaaagttgttattcagcagaaaggtaattccaattggtctgcatatttatcagcacttggtattgtctgtttcttattttagccattctgataggtgtgtactgatatctaatcatggctttaatttgaatttccctaatggctgatggtgaacatcttttcatgtgcatttctgtcatctgtatgtctttggtgaagagtcttcaaatcttttgttcatcttaaaattggattgttatattaccattgggtttaagaatctacatattatggatacaaatatgttgtcagatatgtgttttgcagcattttctcccagtctgtagcttgtctttaaaaaaaaaatttttttttttttttttttttttttttagagatgggatcttgctacgttggccaggctggtctcgaactcctggcctgaagtgatccttctgccttggcctcccaaaatgctgagattgtaggcatgagccgccatgcctagcccagcttgtctttttgtttacttaccagtgtttttcagagaacaaaaattttaatttgatgaagtccaattaattaaatttttaaaatagagtgtgatttttttgtcatgtctaagaaactattgtctagtcctaggtcctaattctcctttgttttcttctaaatgttttattattttacatgttaacgtttagatttatgatctattttaagttttttttaagtatgaggtttatgttttttgtttgtgtttaggagcatatggatggatgtctagttgttccagcaccatttgttggaaagactatcctttctctgctgaatttcttttatatctttgtcag

SEQ ID NO: 8922 - DNA, 1026 bp, Homo sapiens
ttttttttttttttcccaggttggtccgctgaggaggcggggtcgtttctgcgggattatttttccggagcctcttctgattgggtggtgtggcgcaatgcgcgcgaccctcaagataccaaactgtacgcatctctgaccctttcctctccttgctcctgctggtaaaccgaagcccaggagacttccaggtttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccaga

SEQ ID NO: 8923 - DNA, 1029 bp, Homo sapiens
tatttttagtagagacgaggtttcaccatattgtccaggctggtctagaactcctgaccttgtgatccacccgccttggcttcccaaagtgctgggattacagatgagccactgcgcccggcctacaattttttttttttttttgagacggagttttccccttgttacccagaatggagtgcactggtgcgatcttgactcactgcaacctctgtctcacgggttcaagcgattctcctgcctcagccttgcgagtagctgggattacaggcatgtgccaccacacctggctaattttgtatttgtagtagagatgggggtttttctatgttggtcaggctggtcttgaactcctgacctcaggtgattcgcccgccttggcctccgaaagtgctgggattagaggcgtgagccactgggtccagctacaaattcttacgactggtttggaggcagaatgcaaggacattggaggatctaggaagacatccctgagcaagtgacatttgaactgaaatctgaaggagtgagtagcagttcactagacaaagggattgggggtggaggacagggaggagagagttccaagtggaggaagcagtgttcaaaggtcctaaaataggtgtatttgaggaactgaaaggaggacacaggtgggaatacagaacacaagaaagtaggagataagaggtaagaggtattgcagaagtaggcagtacatgcagagcctccagagccattgttcagatttgttctttatttctttttttttttgagacggagtcttgctctgttgcccaggctggagtgcagtggcgtgatctcggctcactgcaatctccgcctcctgggttcacgccattctcctgcctcagcctcccgagtagctgggactacaggcgcccgccaccaagcccagctaattttttgtatttttagtagagatggggtttcaccgtgttaaccaggatggtctggatctcctgaccttgtgatccgcctgcctcggcctcccaaagtgctgggatt

SEQ ID NO: 8924 - DNA, 1025 bp, Homo sapiens
tgcccaggctggagtgcaatggcatgatctcagctcaccgcaccctctgcctcccaggttcaagtgattctcctgcctcagcctcctgaatagctgggattacaggcgtgtgccagcatgcccggctaattttgttttgttttgttttgtttttgaaacggagtcttgcattgtcacccaggctggagtgcagtggcgcgatctcggctcactgcaagctccgtctcctgggttcatgccattctcctgccttagcctcccgagtagctgggactacaggtgcccgccaacatacccggctaattttttgtattttttagtagagacggggtttcaccgtgttagccaggatggtcttgatctcctgaccttgtgatccacctgcctcagcctcctaaagtgctgggattacaagtgtgagccaccgtgcccagccttatatttttaatagagacgggggtttcagcatgttggtcagactggtctcgaactcccgacctcaggtgatccacccgccttggcctcccaaagtgttgggatgacaggtgtgagccactgtgcccggcctaattctatgaacatttaaatttttatttattattttaattaaaaaaacattttttttaagatggggtcttgctctgtcacctaggccggagtgcagtggtgtgatgttggctcactgcagcctctacctcttgggttcaagcaattctcccacctcagcttcccaagtagctgggattacaggggcataccaccatgcctggctaatttttgcatttttagtagagatgaggtttcaccgtgttggccaggctggtctcaaactcctgacctcaggtgatccacccgcctctgcctcccaaagtggtgggattacaggcgtgagcctatatatatatatatatatatatattttttttttttttttttttagagacagggtctcactgtattgcccaggctggtgaaactcctgccctcaagcaatccttccttggcctcccagcactttgggaggc

SEQ ID NO: 8925 - DNA, 1019 bp, Homo sapiens
atctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcctgtgcggccgctctgctgccactatggagccgtggtggggctgcatgctcttggctggaaggtgagcaccctggcctttctcacacagccgtaagaactcccatttgtgttagaaaaatagtacttgtgcatcgttatctccaaaatagtgtgtgcctgccactgccatgtattgagttctggccttaggccaggctcagtgatacttgactttctgaatgtaaatgtcttatcctttcgaaagtcctatatggcagatactgatgtccccacattttataaattcctgcccgttctatattatcacattaagaaataccttcaattcctgttgtattgagcattttacacatgaatagatactgaattttg

SEQ ID NO: 8926 - DNA, 1291 bp, Homo sapiens
tggcatgaacccagaaggcagagcgtgcagtgagccgagatggcgccactgcactccagcaaaaaaaaaaaaaaaaagcacctcacagatagttatttgttgaaggatatacaaggcctgggtttactctaaggtttctgcacagagaccataacttgtgaggcttctctgaagctcattgcattctatattcattgcctattttctgatccttctggccactgccggtgtgattccccagcaggccctctccatcaatatccctgtcccagaaataggaattgacggtgcacaaataacttcctggaatgcaggaccattcctaagttatcactaacaccctaccaagagactgtatctagagacattaacctgaaatctaggactcagcagcttctctccacagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacaggtgactgcctaaccctgagggccaggggctgaggtaggatgagcctcacctccaccacaaggcttgttctctccctttcagaggtgctatagggctgcgcattgcactggccatctcagctatagccgtcttcctggtcttggtgtctgcctgtatccttcgatttggcaccaggtctctctgcaactccatcatctccttgaacactacaattaggtaatgggagagggagggaagcctggctggggctgactaccttccctctgcagcggggtcctataatttccttttatccccatcagttgctctcaactcacagggcactgggcacaggtgtgcctcggatataaactatcacgctttctcacaactgtctctttgacctcacagctgttctgaagcccagaaaattccatggacaccccctggaactgctctgcagttttactccaacctacacaatgctgaagtgagacccaaggataggaggaaaaactgacataaatatctgtagctgtgtgggtgctcaccagtgtattgtgagcttggcctaccagtgagaggagctgaaggggttgtcagcttaaaattcagcagttcagagtggtgtgtgggtgggaaggactggatttgaaatggtcccactcctgacgatcctgtccctgtctcctacagacctcttcttgggtgaatttgg

SEQ ID NO: 8927 - DNA, 1050 bp, Homo sapiens
tgacatgggttcttcagatagtagctgcgaagtgaactgctttagttggagtctttttctctgctttaatttcagccacgctttgacttccaaatgctcaattcctcacccatctttcctttttctttttcttttttttttttttggagacagagtcttgctctgtcaccgaggctggagtgcagtgtaatctcagcttactgcaacctccgcctcccaggttgaagggattctcctgcctcagccaagtagctgggattacaggcacccgccatcgtgtgcgactaatttttgtatttttagtagagatggggatttgccatgttggccaagctggtctcgaattcctgacttcaaatgatctgcccgcctcattcttccaaaatgctgggattacaggcatgagccaccacactggcctcatttttcaaatggctaaaatcttcaagatttctggctgattggtattttagaggcagctttgatgttttgtttctgggtctttggaatagagtcttgggctttcgaagatttatggaggctgttggacagagacagtctcctgaagagtttctagctgtcctcccatcttctctctgcctttagaaatccttcttagatgtggccgggcacggtggctcacgcctgtaatcccagcactttgggaggccgaggcgagtggatcacgagatcaggagatcaagaccatcctggctaacatggtgaaaccccgtctctactaaaaatacacaaaaaaatcaaaattagctgggcgtggtggtgggcacctggagtccgcaggagaatagtgtgaaccttggaaggcagagcttgtagtgagctgagatcgcaccactgtactccagcctgggcgacagagcgagacttcatctcaaaaaaaaaagtccttcttagatgtttttagttgtttgtttatttttcgagatggagttttgctcttgttgcccaggctgaagtgcaatggcacgatctgggcccattgcaacctctgcctcccaggttcaagcgattctcctgcctcagcctcct

SEQ ID NO: 8928 - DNA, 1679 bp, Homo sapiens
tcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcag

SEQ ID NO: 8929 - DNA, 1037 bp, Homo sapiens
tagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttga

SEQ ID NO: 8930 - DNA, 1035 bp, Homo sapiens
agcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactac

SEQ ID NO: 8931 - DNA, 1035 bp, Homo sapiens
ggctaacatggtgaaaccctgtctctactaaaaatacaaaaaattagccgggcgtggtggcggggcgcctgtagtcccagctactcgggaggctgaggcaggagaatggcgtgaacccaggaggcggagcttgcagtgagcctagattgcaccactgcactccggcctgggggacagagcgagactccgtctcaaaaaaaaaaaaaaaaaaaagaacaaattctatacttgctagagactgctttttattgttgttatgaaagttggctgagtctggtggctcacacctgtaatcccagcactttgggaggctgaggtgggtggcttgcttgagctcacgagtttgagaccagcctggacaatagtggtgaaaccccatctctacaaaaagacaaaaaagcaagaattagctgagcatggtgatgtgcgcctgtggtcccagccacttaggagactgaggtaggaggatggcttgagctgggggcagaggttgcagtgagctgagattgtgccattgcactccagcctgggtgactgagccagaacttgtcttaaaaaaaagaaaagaaaaggaaaaaagaaaatcatgatgccaaaataaaactacattttatatgtttgttcatggaaattagctcaaagcaaaaacagcttgggcaattttttgaaaaaggttttgctttaaatatttctttcctcactcatgaaacttagttgttctgtgtactttttatggcttcattttcacactttgttctaccatattaatcaaatgtgaatatgtaatttgtgttttgagttaacccttaaataaaaaggaatgtggcccccgtccaacactgacatcatctgagtgttacattcgtgtcagattatcagtggcagtgtaatgtgttaaaacacagacttgagctccaggaatgcctagatttcaatcctggccctgtctcttaataattatgtgatcttgtgcaagtcctgagcctcagtttccttaacttgaaaattgggataatagtatctatcttggagttg

SEQ ID NO: 8932 - DNA, 1048 bp, Homo sapiens
tttttctgaaatggaattttgttcttgttgcccaggctggagtgcaatggcgtgatctcggctcactgcaacctccgcctcccgggttcaagcaattctcctgcctcagcctcccaagtagctgggattacaggcatgcgccaccacgtccggctaattttgtatttttagtagagacggggtttctccatgttggtcaggctgctcttgaactcctgacctcaggtgatcttcctgctttggcctcccaaagtgctgggattacaggtgtgagccactgcgcctggccttttaatttacttttaagacaaggcatggctctgtcacccagtctggagtgcagtggcatgatatcggctcactacaacgtccatgtcctgggctcaagccgtcctcccacctcagcctccggagtagctaggactgtaggcgtggctattttttgtatttttctagagacgaggtttcaccatgttgcccaggctgatcttgacctcataagctcaagtgatcctcccacctcagcctcccaacgtgctgggatcacacgagtgagccagcgcgcccaacctttaaccaatttcatatctacatagtccattttgtttctgtcaggctttctaattttcttttgcaacaagagttctgctttgttcttcctcttagattgcatatgcatttactctaataaatggtgcaaagaaagctttccagctctttttagtgatgtaacagaagagtgggcatcttggaaattagcactgttttgacttatatgagagggaactgctgtcttagtaactactacattaataagacaaatgtccagttactagttactactcagtctagttttgaaataacaagctaaatctaaaaatctcttagagtttgggtttcagcaaacatttatgaagctcctgtaatattcaaacctccatattctgtgatttctgctatatgctggtcaatctgaaagatacgaagatatgtaagagggctttaaccctcaggtgcttccaatcagtttgtaattattttccaacaa

SEQ ID NO: 8933 - DNA, 1035 bp, Homo sapiens
ttcccgaaaagccatcactccagtctaaccatgagaaaaacatctgacaaattcaaattgagggacattctgtaaaatatctgaccagagtcttattaaaactgtcaagagaagtctgagaagctgacagtccagaaaaggctaaggagacatgatgacaaaatgtgatatggtatcctggataggatcttgggaagagaaaaggggcgttagggaaaaattaaaggggatcaagaaagaaggacagagtgagaccttacttctctaaaaaataataaatagtaagtaaaaattacctttgtaatattcttttttattagaatacgatgaacatctcttagtgtcaataaattcccatctacaacccagttgttaatgacttatcctattgtttggatatatgaaacttaaacggtctaattattagacctttgttaagtttcctttaaaaaaaaaaaaaaaacctattttaaggaatattgtgatgaggccgggcctggtggctcatgcctgtaatcctagcactttgggaggcttaggcggacagatcttgaggtcaggagcaacatggtgaaaccccgtctctactaaaaatagaaaaattagccagacgtgatggtgcgtacctgtaatcccagctactcaggaggctgaggcaggagaatcacttgaacctgggaggtggaggttgcagtgagccgagatcacaccactgcactccagcctgggcaacaaaacaagactctgtctcaaaaggaaaaaaaaagaatattgtgatgaagccaggtgcggtggctcacgcctgtaatcccagcacttcgggaggctaaggtaggaggatggcttgagcccaggagttcaagaccagcttggataacatagtggggccctgtcactatttttttttttttttttttggagacggagtcttgctctgttgcccacgttggagtacagtggtgccatcttggctcactgcaacctccacctcccgggttcaagcaattctcctgcctcagcctcccgagtagctgg

SEQ ID NO: 8934 - DNA, 1159 bp, Homo sapiens
tctatcttgaaaaaaaaagtttgcagtttgaatctaaccaaatttattacatgttaaaacaaaagtaatgatactctccagaggaatagaacacagtctggaatttgtacagcataatattcacaatgtccaggatataatccaaaactacatgttttaagaaccaagaaattataactcagtctgaagaaaaagagacaatcgatagaaactaactgcatgtgttggaattaggagtcaggattttaagggttttcattttaatcactcaaagaagtaaagggaaatattcttgtattgaataaaaaagaaaatctcaacctagaaatcgaaacaaaaaagagtcaggtggggattctagaactgtaaaatataaccactgaaattaaaattcagcaggtgaccttaacagcaaaatggagatgacaggggaagaagctggtgaacttgatagcatactaaagaacagaaagaacacatattttttaaaagtgtcaccagagcttcagaaccctgtgggacaatatcaaaagacctaactttggccaggcacagtggctcacgtctgtaatcccaccacttcagcacttagggaggccgaggcaggaggatcacttgagcccaggagtgcgagacctgcaaaacctattttttataattggagtcctagcaggagaggaaagtgagagagagactggagaaggacatatttaaagataaaatggctgaaattttcttaaattttatgaaaggcacatttactgatgaaagacgctcatcaaacaccacctactaggataattacaaagaaaaccataccttggtgtatgtgtcggggtccccaagataaccatcagggccagtgatttgctagaaggacccataggactcataaactgtaaactagcagttaatggtttattacagcaaaaggacataggttagaattggccagaggaaaagacacacgggataaaatctaggagagatcagatgcaagcttccaggtattgaatggagtcatacagggatgtacttaattcttttacagtgatgcgtgataacatgtgcaaaggattcccaaccaaggaagctctttcaatctttggtgtctagcacggcatgcagtgcccatatgactgaactcagctactcagac

SEQ ID NO: 8935 - DNA, 1054 bp, Homo sapiens
aactgagcaaaacaccatctcataaaaaaactgctaaaaaaaacccccagtaccctgtttttatgtgttctgggctgttaattacaaatacaaatgtggttttccaaaatgttttttttaaaaaacaaaaacagcaaaattttagcataaacaaaatatagttttagaaactccaggatatgttaatgttaaaactgctaaaaaaaaaaaaaaaagtaccttgtttttatgtgttctgggctcttatttataaatggatttaccttcatgaatatccaatgaggtagtaaaagtgacacagaacataggtcagttctttactgtgcttgactgtcccatgctttgcagacatctggcatatttgcctctgcccactaaatgacagtgtgtctccaccccacctgatgacaacaaaaaaatgctcctacaggttctaacatgcaccctgggaaccaattttacattctcagtaactactgtgctaacaaaatcttcttccatgtcaaatgtatgactgttatttcttcttctggaagagcctacctggacgtagacattactctgtcctcagaagctttccataattacatgaatgctgccatggtgcacatcaacagggccctgaaactcattattcgtctctttctggtagaagatctggttgactccttgaaggttagttgtttctgcagctcttggtggtaaaacagaaaaagcagggactgggttataatttggaggaaaaacagtacataggattttatcagacaaaaatgaacgtatgcttagctcagtcattctataatgggataggtgtcactagagaaaggtatagccttctgctggggaacaaatatcagaagagaggtgatataattggaagcagtgcagtttcagtctttggacctcagaaaactacagacttcactcacataccttcaaatgtataacacaagtagggaaccttcatttggaaattgtccatgtcacacatcactaaatttatgcagacttaattagctggaggagaatgacatcagttaatgtgaatttt

SEQ ID NO: 8936 - DNA, 1410 bp, Homo sapiens
aaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaa

SEQ ID NO: 8937 - DNA, 1314 bp, Homo sapiens
agggtttaagctgattctaggctgttgcctctaacccatcaggaatgccataagtatagaccctgtcttgggagagatctggagagatacttgagaattttggacactgtaatattgaatttggttctaattgtgatctagagaccctcagactctttcaggtgatgcacgaagtcaaaattctgttcatagtaacgttaacacagtgttgctttttcactctcattccctcaccagtatacagtggcattttccagaggctaaatgatgtgtggtaacatcacattcttctggctaatgaaatgtgtaattctgtattcttgtgttttctataatttttaaggtagtactttaaggtaaaaatatggaagttttcattgatggactcagtttgttcttagtacttctgtgctcttactaggtttcttcagttataactgctatcatctttttgtacacttcattactgtctaataaatccttattttgaaatcccagcattttcctggaacctttgagaaaatataagaagtaagtactacttgtaaaacttgcttgtaaaaacttttgggaaaactcctaattttaaaaattttattgacaacttattttagcactttattctaaaatagaaaaaaatttatattatttctcttatatgtaagggtggattgttggcttaaaaaagggagattagaagacttgctttttcaacccatagctgcaacttgtatgttaaaaatactgaagtggacataccaacaagtataaaggaggactttaaagaatctgggcagaactgtaaataagaactaaaaaaaaaaaaaaagaaaagaaatgaaagtgtaatgaaagctaccttctcagtttcataaatgttcataatgtaccttactgcgtcttatgcgacagaacattttcatgtagtattatggtaccagttaagttgtggcattctttcaagatcatttagagtttaaagaaaaaggaattgcatattttatgcgtacgtactatgagctctttaaaagccaaaatttcttccagtttttaaactagaaataaaaaagtcactgaagcctctatctaacaggataagttgccacattgctttggctggaaaagcccacacagaaactgagagacgaatgaagtcttgaacagctgacattcctgaatgcccactggatgaaaagtcagtaaaattcaaggcagtgccgctttaaatgttaccaggattcattaaattaaagatttagccaggcgcggtggctcatgcctgtaatcccagcagtttgggagaccgaggcaggt

SEQ ID NO: 8938 - DNA, 1094 bp, Homo sapiens
atagctaacatttattgagcccttactctgtcgcaagcacttgtttagttgttttacattcattaactcatttactcttttttttttttttttttgagacagagtctcgctcttgttgtccaggctagagtgcaacggcacgaccttggctcactgcaacctccgcctcccgggttcaagcaattctcctgcctcagcctcccaagtagctgggattataagtatctgccaccatgcctggctaatttctttctttctttcttttttttttttttttgagacggtgtttcgctcttgttgctcaggctagagtgcagtggcactgtcttggctcactgcagtctccgcctcctgggttcaagcaattctcctgcctctgcctcccgagtagctgggattgcaggtatccgccaccatgcccggctaatattttgtatttctagtagagatgcggttttaccgtgttggccaggctggtctcaaactccggacatcaggtgatccacccatctcagcttcccaaagtgctgggattacaggcatgagccaccatgcctggcttcatttattctttgtaagttagtagatctcactgttttacaggtgaggaaatagaggcccagaaatgttgaataacttgtttaaggctacaaacccaggtggtccagagtatgtcattgtcagaaccagcttttcttggttgtgaagaatcctttgtccctggcttcagttgtgtccaggcagtagaagatagtttccttaggattagctcccagtcagtgtgaggcagatgtcttgcagcggaatttagagtcacaaatggcctcctctgcctccagttgtttcttttgtccttggtggccattggtaaatgtggccgaaatggtgtggatggagtgggagcagctttctgggctcacctccctactattgagggctctacgcaagagctatgggagacctttttaagaaaccctctttaaccccagcttctgattcacatctttatcttttcccatcttccggaatttcaagaacccctttagaaaaaccaaagccccgagtcctaaaattgataaccagcaattaagtac

SEQ ID NO: 8939 - DNA, 1024 bp, Homo sapiens
cccaggttcaagcgattctcctgcctcagcctcccgagtagctgggattacaggcacccaccaccatgcccagctaatttttttgtagttttagtacagacgggatttcaccatgttggtcaggctagtctcgaactcctgacctcaggtgatccatatgccttggcatcccaaagtgctgggattacaggtgtgagccaccattcctgcctcaatctgtttgatcagctgagagtatcccccctgctcagatgaggcaggcaggactcctggggcggggtggggcgtgttgagccgtagtcttctcgaaggacctagggtcacccagtggttttgaaggcgcaattggtagataagaggaatggggtcccatgggagcctagtgaggagtcagctcagaaattacagcaacaggaaaaatgcctaagggcaggaactaaataacagaagacatgagtgtttataacaaagtacagaagagacagaaaaggtagaaaaagaataaagagagagcagagagggacaagaagtttacaaagtgccgaggcggattaggacagcttggggaggcaggaaacgggccttgtggttggggggtgggccgtgtggccacagttgttaatctcagcctgaaagactttgttcctgcaccttctctagtcatgctggggcagatacagggttggcttttctctgtgcagtaactgagactgggccttcctccctgtgattctgagggaggaacagcagtgccctggcaggagtgctgtaaccaattccgtacacgtcctgtcctcttctcaggttgaatgtctccattgaatgtaagcgagtgtctggactggagccagccaccgtggattgggccttcgacctgaccaaaacgaatatgcaaaccatgtaagcttgtcccaaccaggggagcctagttcctctcgcagctttcccgtctgactgctcccaaattccccaggtatgagcagagcgagtggggctggaaggaccgagagaaacgggaggaaat

SEQ ID NO: 8940 - DNA, 1038 bp, Homo sapiens
caggtgatcctcccacttcagcctcctgagtagctgagactgcaggcatacgccatcacacccagctaatttttgtatttttagtagagagaaggtttcaccatgttagccaggctggtctcaaactcctgagctcaggtgatccacccacctcggcctcccaaagtgctgggattacaggcgtgagctcccaagcctggccctgctgtggagtgttaattctattaaggtgaacatttaatagtccctacggactggcagggctggggctgaggtcacatcatgtggcgctggtgcttagtgcaggccaccccagtgctggagggaggaggccctgagaaatgggaccaggctgggagccccctaaggggtggaggctgtttgactcagagcagggcttggtaggccacagctgggagatcgggagcagggtgagagccagctgtggctgatttggctgttgaaagccaggccctgcacctctctggggtcatgctctgatacaggatggctctgttgcagcaggtgaggctgacgggtggcctggacactagtggctcctgtccggctccctggccctgagcccctcagtggtgacaaaggactaggcagccacgtccactgaggatcgtagtgaggtctcaagccgccaagtgcaggcactgtggatggcgtggggcagcacatgcccttgaagttggtcatgatgtggaactgcccccgtgcctagctcgatgcctggcaggtgggccacacgggtgtcacatgtgggagctgtggggggaccgctcctgtggcggcccctctcctgaatgttggatatatgggatggggaaaggtggggtatgtggctggaggggtccagggatggggcactcaggctagagccctctgagggtcctggcagtgagattggtgtccaggaacatgaaaaggagtggggacctgccctaagctgatcaggggtccagaaacaagagaggcccatgggtattggagctatgagcgcaggctaggggctcagaaggcagaggggcc

SEQ ID NO: 8941 - DNA, 1046 bp, Homo sapiens
ctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgaccccc

SEQ ID NO: 8942 - DNA, 1057 bp, Homo sapiens
attctgcaactttactcagagctggcaccaggcaatttcccagagcgtcccagggatgggtgggcagagaggttaggggaacgctgagaacggctcaggcctggatcccttccacctgctcctctcctctgcagggagaaaggcagctgtagcccagggcgaggctgagatggagcaagaaggcagggcccagagcgggcgtccaggctggagctcccagtgctgggaagtgagtgttccgaatggggtgccgtggctgggctgtggagctgggcaacgtgagttcacatcctggctctgccagccacagatgtgtgacccctcacatatcatttaacctctctgggtctcagttgctccatctggaaaatgggataatagcacccacctcagagctcattgggctgttggaaggattgagttaaactaactttgtaatgtgcttaaggcagtgcttggcaagaatggaggtcatgagtgtatcctgttattaacaacagtgtgacagtgtgggcatgttcgggtatgtgtacatcagtgtgatgggaggtgggtgcacacagggtgttcacagtgtgtgggggtgagcccagggatctgtctgagctggctctcctaggagcctcccgggtcgagcacctggcaccggctgctcgaagtctctgggggctcaccgccctgcaggcgacctcggccagctgtgggggcccgtgcggggaagtggagctcagtgtttcaggaatttaatgtttcctgcggaagtggactggcctgcagccaggcctttggggctgacctgggggcgcaagggaggtggagggagctggaatcaatgctggcagagggctcaggccagatgccccctcctcacccccagcagttccagaacagggcctgggccaggtgatggctctgcaggggccccagggaggggctcccctaaagcagagatgagggacaggtcactgtcagcccactgctaccccaacaagctagagtgcagcctggcccctcttgcctgcgtgtccctccctgtccacacaccagccttctcgct

SEQ ID NO: 8943 - DNA, 1054 bp, Homo sapiens
tgagggcaaaggggagccagaggccaggaaggaagagcccacggcccccagcattccaggaccaccagcaaggcctgcaccctctcctgaaaacatcagcaaggcacggttcaggatgtaggggtcaggctccaggtcacctcaccagttgtggcccctccagtaactcagagtaaaggaaggaccttgctgactgcaaccaggacagccaacacctacatgcacgaagtcccagctgtactgagctaagccctctatgtccattcccactacctccattagcccgttatatcctcagctctcaccccctccaggcagagagatgattggcccaaggtcaggtcaggatcccagccccgacttgggtccaggtctgtttggttcccatctgcagtctggaaaatggttatgcaggtgtcactgattggtgaaatgaggcatgtgggtgatgcagtatattacttctccattgctgctgtaccattaccgcaaattcactggcttcaacgacacatttagtatcttaaagttctgtaggacagaagtctgatgtgggcatcactgggttaaaatcaaggggaacacgaggccatgttcctttctggaagccctagcagacagcctgtatcattgccttttctgattcccagagaccactcacattccttggcttgagacctgttcctccatgttcaaagccagcgcggttgcatctgagcattctcctgtagtggcatttccctctgatactctccttctgcctctctcttccatcttcagggacacttgtgattacatggagcccacctagataatctgtgacaatttctctacttagctgatttgcagccttcattcccctttgccgtgtaatgtaacatatttacaggctctaggatttaggatgtggagtctttggagggccattattctgccctgtgcaaccttcctggcaatgtctagtgaggatgatgaggtagaggcagggtccccagccataagaaagtcttggcgttcaggccgggtgcagtggctcacgcgtgtaatcccagca

SEQ ID NO: 8944 - DNA, 1461 bp, Homo sapiens
acgaggaacttggacggatccagggagcggggacggggatacactgggagtagccgaggatcttagcagcctgggatgcagttggggcaaatgttactcttctacatctgagaaggtcagggtgggagagcgttgagcgggggtctgaggagcgacagaccgactctacctgatgcgggaaagggaagggtgccgcaaaagtccttgggacgaattccatctctgacagtgttttacaaatgtattgcggcccctccccctctttttgtatgcttgtgtgtgtgattgtcgagtgaccgaggaccaacacttccgaaaggtgggtctgaaagatgggtttctgacgacccgggggtggttgtagacaatttacagagatcaaccgctggaagttatgggcctctactgagcatttgaggggccgagtttgaagcggttgctgcttcctttcagtgacttggttatgtcctcagtagcttgcggttatgaaaggcctagaggttttgttcgatttgaagctgtcattgagctgtaatgattcatcggaagaaaaaggacaaaacaacctccaagaaacctctaccaacctccgagaaatcatcctcccgctcgggagtactactgtcttcgctccgggcccataacacttgggggtgacaattctgaaactatacctggtatctggttcttacttcagggccataaaactaagatcgcccacactctccccttaaataagacatctcgatggactagtgactaccatcctttttttggtgtgagctacagagctgagcctttggtctcttgtagcagttgctgctttaggcaaagctcgagcttccttgctgtattaaaaagagtggaaatgaagttagtaaacttttttgtgcccatataatatttcagttgtatctagggttaaatgggctgtagtataggtgaggaaaagatttctggaataagacgttgctcttttacctttaagaaaggatctggggccgggcaccgtggctcagcctgtaatcccagcactttgggaggccgaggcaggcggatcacgaggtcaggagatcgagaccatcctggctagcacagtgaaaccccgtctctactaaaaatacagaagaaaaattagccgggcgtggtggcgggagcctgtagtcccagctactcgggaggctgaggcaggagaatgacgtgaaccctgggggcagcttgcagtgagccgagattgcgccactgcactccagcctgggccatagagcgagactccgtctccctccagcctgggccacagagcgagactccgtctcaaaaaaaaaaaaaaaaaaaaggatctcggctgggcgcagtggctcacgcttataatcctagcactttgggaggccaaggtgggcgaatcacctgaggtcaggagttctacaccagcctggccaacatggtgaaaccccctctcta

SEQ ID NO: 8945 - DNA, 1069 bp, Homo sapiens
ggtgatcccatccgagctaggtaagaggcccctcctgagggtgcagagcgagtttggggtgtgtgactgggaagggtgaaagctgcttcagcttttcattggtcttcaccgtatccattcattacaatacatgcctcctccaagtttggctgtgtctagcagtgagtacagggcaagatcattgaagcactcagctgtagtggccccactctgcccttgccaggcctttggcacccccttcccatctccattacccttctccatttctggccttcttgctgagaggggcggaacactctccctttgcccacactggaagggagcttggccatcactgactgtttctttgtgcatcttcaacagggtatggagagcggggagctcccccaaagattccaggtagtaaaccttttgatacctcccatcacctgcagccagcccacctccctgtggccctggttggcattttgactccccttctcccctacaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcccaaggagtaagcctgtgtgtgtttgtgggccctgagagactcagagacctcagctccagcataccccaccaccttctcctttcccgactgtggagccttgggggtctaggctcaatgacatggtggcccttgcccagagagaaaggagtgttcctgcctgccaacagcaatactgctccccccacccccacagctccccagccactttcaactcctggtctgggagccagcactgggctatcgtcatggctacgtggcccttaggaaggcctgtggtcacctggggagaagctgagctggcagaagtcaaagagcagtgtgcccccctaaaagagaccagccgagcctgttagctgcaccaaaggcgtatcctagctttattaaagggcccgcgccgcagagtcaatataaaaacac

SEQ ID NO: 8946 - DNA, 1050 bp, Homo sapiens
ccaggcatcacccagaggggttctcctcgcagaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggtagggggcctgcagtggccagggaaagcctgctggatagacccgtcgtcagcccggcatcacctgtcagctccctgtgtccacaggctctgcagcggctcagggaggtcgtccttgatgcaaacacaactcagttcaagaggctgaaagagatgaacgagaggtgaaagccgaggattgtctatgggaagggctggggacttctagtaccagaaggagggcagagtctgtgcttctgccgctgacccctcctcttcccctgccggcttctccagggagaagaaggagctgcagaagatcctggacagaaagcgccataacagcatctcggaggccaagatgagggacaagcataagaaggaggcgtaagggcaccgggaccgggggccatctgggtactggggaggcagggcaggtgtctgggccccgagccatcctgcgttgctcccgtgcagggaactgacggagattaaccgtcggcacatcactgagtcagtcaactccatccgtcgggtgagtcaggctcccgggccaccctaccccacctcccttccttcactcatcagacacccatctccatgcctggcctggtgccacgttgccctcaaggttcttctagggcctttctcaagtgcccaacagccccagggtacccacatcatacccaaagccaactgtctgtaccagtgtccctggctttggcgtccttgggcccagtcctctcacaaccctgatacattgccctgggagccttcgcccacctgacttctttttctttgagacagagtctcactctgtcgcccaggctggagtgcagtggcgcgatcttggctcactgcaacctcttgggttcaagcaattctc

SEQ ID NO: 8947 - DNA, 1074 bp, Homo sapiens
atagttcccttgccctcccctcttgctccctaaccattggagagcggataagtaattccaaccctgcctgcaatcttacgccccttagtgctttgatttgattcttttcatcatagtaaagcacacaagctactgcccccccccttttttttttttttttttttttttggtgttattctcaaaagaagatactgaggctcctaggcagagctgtcaccagaggctgcatgccaattggtgacgaggagcctccggcgggcctagtccagacttcccgggtcagccttagaagccacagtgtttgcctcctactcagcactgttagggatccaccccggagatgcagtttctgggttgatctagggaagggcccagggctgaggatcctgaatgaagtagttgttcagtcgtctcaatgaggctgctccaaactggcgccccggcagcattctcattgacgcgccatggttttcaaatctccccagagccctgtgtgctgggaaaacccagccctagaaaactgaaaacaacaaaatgttcctgggttatttataaacaaaacccagaccctgtcgttatgtatggccacttgactttctccaaagatcttaaaggactgaaagaagggatctctgtcaccctggtgaggcccacgtgaccagcaattagtttcccccaatttcatggagttggcacccagcttccaggcagcttccttatcttgtcatgccccacaccgaaaatgtcctaatttttttttcttttgtgttttctgagtagggcagtttgtttggtgggaaagttgtataaaatgtgaatgcaccctttcacttttggtttctccgctgtttcactttctgcctgtctgcctgagcccatggcagattgatggagggttcaagtatttttcttttatctcagaaactgtgccatcccccactcccagtgttttattcttcagttaataaatccattccctgcaaacccagggccttgaggtaccccctagctctcctcagaaacgccctcatccagcagaaaggggcctcacctcccctctaagtggtctgcttg

SEQ ID NO: 8948 - DNA, 1047 bp, Homo sapiens
actgcactccagcctgggcaacagagtgagactccgtctcaaaaaaaaaaaagaaggacacttgcaaagatagtacagaggtcagaggtcccccatataccctttaccttgcttccccatcttacctaaccgtggcctgtccaaactaataaatcaacactggtgaattactattatcttaattacagattttatttgaatttcacgtttttccactaatatactttttgtgttccaatgtttgattcaggctacaaaattgcatttagttgaaaatgaggacacttgtgagagtgaaaggggggattctgcaggcagagtggggactgtcctgggcacaccgcacacatctcctatgtgggtggagcaggtcagatgagatcagggccgtcaaatgctggtcaaggcaggtcaaggcccaagggttagacccgtccacccacatctctcccaatcacagacacatatgtggaaacaactagaatcagaggtggacagtgaggcctgtcgggagtggaacggttaaagggctgtgtgaacccagaagagggagagttcacatcctctgtgcatgtctggtcatcagattggagcagtctagaaccacggagagctcagggatcatcttatgcaacacccctccctgttcatggaagaggaagctggagcatggggacagcggtgtcccctgggtggtggttggctggaaccagaaccctggcccagggctgctccattcatgtgggccagccttgatggctacgtccacaaactcactcctgggcctctcccaccaccacggggcctcaccttgatcttccaggtcgatccttcaccccagatgctctgggccattagaggaggggtcaggctgtcctctgagtccccaccccacccctctatcttttctcccccagcgcctggccggagcaaccctcctcatctttgctaataagcaggacctgcctggagcactgtcctctaacgccatccgcgaggtgagtccaggccccgggacaggctcgctgagggaaaggggcatacatt

SEQ ID NO: 8949 - DNA, 1027 bp, Homo sapiens
cttctctccagccgcgggggccaccagggactggggcctgacctgattttcccctcatccccccaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttattaaaacacccgaggcagccttttgcttccccctccttagccctgttccgactccccaggcctcagtggtgctcctcccggtactcgatggccagaaactccaaggacaggcggttgaagaacatggctccgttgagcactgggcgggggacagagccccccatgagccccagtacccttccctggctactccttgccacatctcagggttccaaagctccccgctccctcttgcaccctcccactcctgccactcactcaggatggtcagggcggagaagcagacgtacttgttttctgtcatctcagcatagagtgaccccatggcagcccagcagatgctgatcacctgggagaactgtaggcccatccagtgggagagtggccccctcgcacaacagtggggtttccatcagcccctcgggtctcccacagccagcccttgcgtccctgccctgagcctaccatcaggacgaccgtgtagtgaaagctcatg

SEQ ID NO: 8950 - DNA, 1041 bp, Homo sapiens
agagaagacagcccatgttccggaaagcatgtgaaaggctttgggaggtctggaaaggagatgagggtcaacaagaatgtattgcctcatccaggcagtgcgctggacacgcagatgcgcttgggagccagcggtccctgccttggctgcttgtggtctgatggagcagttgaggcacagtggtggcagctggctaagcacctgcggcctgcttcggatctggactaattctgagggccggctctcctgggcaccagggttagggggttacggggagtatgtgagtaacgcctgctttgggaacataaaccccctcccccgcccccatgtgcgctgtgacccacgccctcgcagtcctttctctggaatcatccatgcgcccctggagcaagctggggcgtctgtgaaggggtgggtgagaaggagctgaggttgcgcccgccctgcagtcacctgctctccccttttccccgcccctgccctcctagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggtgggcgctgccgggcagggcctgcagtgggcctttcctggggctctggggctaacgtcaccctccgtcccccaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttaggtgtggcccctctgccctgaccccagcgctcccgccagccccgagccccatctgtgcccggctcctgggccctcctggagctgtccccctgccctgtgtgtgctttgcttt

SEQ ID NO: 8951 - DNA, 1051 bp, Homo sapiens
actctcttttctacttcttgggaggggtgagtgagagaaagtgggacaaggccacttttctgcagtgttagttactccagaaaaggtccaccatgtggaaacagatataatgagaaataatccttagtttgtgttaatcaaacccagtcagttatccaaccagtcaattcctcaatccaagcagcatgaaactgcactcctagttaggtttgtggattataaatgctcataaattccttatcccgtccctcatggaaaggtggggtttacttctccacccccttaattctggacttggcctatgacttgctttgaaccagtagaatatggtggaaatgaagctgtgcccaattctgggcttaccctttaaaacagaactggcagcttctgttttcttctcttggaattcagccaccatgctgtgaggaagcccaagcagtcctgtggggaggcccatgtagaggagaatcaaagctccattctcagccttttgggtaagatcaagtgtagtatctgttcttatcagtttaatatctgatatgtcctctattcgaggacacaatctatattaaatagatttttggaactaagagatggaataggagcttgccccacccactccacacatttacctagcattgcagtacctccaggaacagtgtacccctaaagggagataaagtttaaaaatgaaaaaaatagggaataaaaagctctagccctaccatccaattggctgggggaatttaaataaataaataaataaataaataaataaataaataaatagctctagccagcatcaacttgccagccattggagtgcaccatctttgaagggtcctccagctccaaggatggagctggaggcacaagaagagctgtctcaaccaggccttgcccaaattgcataatggtaagaaaataaatgattggtattgtcataagcctctaggtttgagagtggcttgtttcacagccctaatctaatttgactccctgttcttggccccagacccagggcctgccacagaataagaactcagggagt

SEQ ID NO: 8952 - DNA, 1049 bp, Homo sapiens
ggatccatcgcctcaaacatttatcttttctttgtgttggagacattacaattcttctagctattttgaaatatacagtaaactactgttaactataatttcccctgccttactgtcaaatactagaacttattccttctatttaactgccttttctagtttcttaaggtggaaggttaggttattgatttgatagctctctcttttaatatatgtacatttttcatggccatgctatgtaatttctcattaccattatcatctctttccgataaactagttattttagaagaatgttttttaaaacataaaaaaatttctaacttaattttctcatagtaaaaaaatgtgacctacataagatcatagctttgaagtgaacagaagctggtgctatggctcagtgtatgatgaattttcataaaggttccttcgttcttgaaaagactggctaacaaattgtgactgtaggtgaagcactcctaagtattttaaatatgataattagcttaactcacactgagcctatgaggcaggaactattattatccttatcttagggataataaagaaactgaggcacagaaagatttaagcaacttgatgaagtcactgatctatgaagtggcaaaactgggatttgaacccaggcagagggatcctgaagtctgttctctcagccagtacgctattctctgagtactagggggattgttctataattgtccattatatcaaacttattgttttgtctgcttaatctatcaattactgaaagaaagaaagaaagatgataaaaatcttataacatcctaatggctttgccaatttctctctgtatttctatcaattatttttcattatatattttgagctatgatatttggtacatcacatttagaattcttataagcgcctagtgaattaaacattttttaaaatctagtgaccaccttcatctctaataattatttttactttcaagtctatttcagccaatgtttctatagctaattcagggtttttttttgttgaatttttaaaatata

SEQ ID NO: 8953 - DNA, 1949 bp, Homo sapiens
gtgggctagtattttaattctaaagtttttttttcctgccataatttaaacatcatcatgatttgagatagcccatgttatttggattacccacaaataaaagtatttttgttcagcattctcagacctttcatctgagatcattttccatccacccgaaacatatccttttgtatttcctttgttttgttttctttttgagcaggcttgatctcctggtctcaggtgagcctcccacctcagtgtctcaagtagctaggactacaggcacatgccaccatgcccagataattttttttgggagggttggggggcagttgacggagtcgcgctctgtcgcccaggctggagtgcagtggcgcgatctccactcaccgcaacctctgcctcccaagttcaagcgattcttcttcctcagcctcccaagtagctgggattctaggtgtgcaccaccacatccagctaatttttgtatttttagtagagatggggtttcaccatgttgaccaggctagtctcgaacacctggcctcaagtgatccaccctcctcagcctcccaaagtgctgagattacaggcatgaagtaccacacctggccctttttgtatttgtatttttattttttagcaagggtctgttggttataaactttctcagtgtttgtctaaaatgcctttatagtgtgcttattcttgacagttctctggatatagaattctggcttgacattattttcagcctctcaaagacactattagtcctgttctgcttccatcattgctatgtgagccaggagtctgtctaccttgccttctggaaaaaatcttaattttttttttctttcatactatacgattcaccatgatgtgtggaggtatggatttcttttcattctgccttgaatgtattgaacttcctggctatgaattgatacctttcaacaattctagaaaatttgtagtcatgatctttgagaatatcacctccttcccactctctgtatattctaataaaatctaaactggaccttctcactcaatcctctctttctcttaaccttgcttttagatttcccatctcttagtgtctctggattgcattctgggttgttccttcagctcctttctcagttcactaattttcttttttgctctgtcaaatctgttagttatttcttccaagaacttaatttcaattttaaaaattttgtttctagaagatgtaatggatcttttcaaatctgttcatttttgctcaaattttcaaacttttcatctatttctttaaacatagtaagcatagtcttatattctgtgtctgataaggtcaatatctgaagtcttagtggtcagtttttgtccactgtggctgctgctcagttatcacgccttgtttgcttgtgagatctctgccccgtgagagagttctttgagtcctcagataaagttaaattgctccggggtgtttctgctagtcacctggaatgccaccaatccagaacacctttttcgttcttttttatttatttacttattttttgagacacagtcttgctccggctggagtgcaatggcataacctcagctcacttcagcctcgacctcccaggctcaaggaatccttccacctcagccttcccagtagctgggactacaggcacacaccaccatgcccagctaatttttgtagagatggggttttaccacctcgcccaggctagttttgagctccaggactcatgcgatctgtctgcttcagcctcccaaagtgctaggattacaggcgtgagtctgagtcaccatacccagctttgttctttttttttggagatggactctcactctgtcgcccaggctggagtgcaatggtgtgatctcggctcactgcaacctctgctccccaggtttaagcaattctctgcctcagcctcctgagtagctgggattac

SEQ ID NO: 8954 - DNA, 1043 bp, Homo sapiens
atccagctgcctcagcctcccaaagtgctgggattacaggtgtgagccactgcacctggccatatattacgatttaaatatactattaaatatacaatttaaatatactatttaaagtatattcacagagttgtgcaaccatcaccacatcaattttagaacatttcattatcccaaaaacaaatgaggtactccttagccatgactccccagccctcccagcagccctggcaaccacaaatctacttcttatctctatggatttgcctactgggatatttcatgtgaacaggatcatataatacatggtcctttgtggctggcctttttcatttagcataatgtttgcaaggttcctccatgttgtagcatggatcagaatgttgttcctctttgttgccaaataatatcccattgtttggctccatattttgtatattcactcttcagttgatggataattgggtagtttcatccactcagctgttataaataatgcagccattaacattctctctttttttttttaaatggaatcttgctctcttgcccaggctggagtgcagtggcacgatctcggctcactgctacctctgcctctgggttcaagcgattctcctacctcagcctcctgagtagctgggattacaggcatgtgccaccacgcccagctagttttgtgggttgtttgtttttgaaactgaatcttactctgtcgcccaggctggagtgctgtggcacgatctcagctcactgcaacctccgcctcccaggtttaagcgattctcctgcctcagcctcccaagtagctgggactacaggcatgggccaccatgcccagctaatttttgtatttttagtagaggtggagtttcaccatattgtccaggctggtctcaaaactcctgacctcaagtgatccgtctgcctgggcctcccaaagcgctgggattacaggtgtgagccaccgcgccctgccacactcttatgaacaaggctttgcatggacacgttttcatttctcttgggtatagagcttggag

SEQ ID NO: 8955 - DNA, 1043 bp, Homo sapiens
actttaggcacctgttttgctcccacttgttgctgggtattttatgacaattgagtagtgacctcccattacctgggtttctttgccctctgagcagtatagaaaaatggcaggtcccatcagatccagggagcaagacagaggcacatccttcccctgccctctcgctcctccccactgtcctcccatcacacacctgcaccacccccaacctggtgccctcccctttccttaccaaggtgatgcctggcgcaagaccttacttgagcttttcccctgtttttagggtgtgccacttccattttatcagcccactgaagaggatgcaggtgagtttcggttcaaatattgttttgccaacaatgaggatggtagacatgagtccaggagtgcagtttcccaagcccaagaaagctgcagaagctgctgaagagcaatgtgaccaagcagtgagggcgccaccatcatgagttcgtaggttttttgtcacaagacccctggtctgagcccagtgagcgttggtcgtgctgtcgcctgagttctgcctacatgaagcatgttgtttaaagactaatgtttaacaggtatttttgaaggttgccttggaaaggaaaagatgtacgatttcaaaaagaatttatttacatgcagcatgggcagatgcggtggctcacacctgtattcccaacactttgggaggccaaggtgggaggatcacctgaggccaggagttggaaactagcctgggcaacatagggagaccctgtctctactaaaaattaaaaaaaatattagctgggcttgtggtgcatgcctgtagtcctagctaatcagaggctgagacaggaggattgcctaagcccaggagttcaaggttgcagtgagctatggtaacaccattttactccagcctgtgtgacagagcgagactctgactcttaaaaaaaattaaaattaattaattttttgaaagtataatgtggcatcctggattggatccttgaagagaacgggaacatcagtggaacaactagcaacatctg

SEQ ID NO: 8956 - DNA, 1046 bp, Homo sapiens
aaatacaaaaattagccagatgtggtggtgggtgcttgtagtctcagctactcgggaggctgaggcagaattgcttgaacccaggaggtagaggttgcaatgagccgagatcgcaccactgcactccagcctgggcgacacagcaagactccatctcagaaaaagaaaaagagccagtgagaaagcacctcagagaaagcgagcagagcccgcggttctcgtcctgtttgcgggagcagctggaggaccctcccgctgtgacgtacgaggttgtgcaatgctgagcatagttgggatgtttttctgatccctccttctataggcgctttctaaccatgagcaggaaggctatttcctccttaactattgcccttccaaagcctacactgaaacagggcaattttgtcccttgagagcagccagctgcacctcagtcctttgtgtttatcacagatgtcaagcccttgagatgtggagcacagattgtcccattcaagttaccctgtggcctgtttaccagaccctggcacccaaatggtggactggatcaccctagtgagcttctcagtgtcaaagggacaataatgaatatgcaaacacctttggtctcaggattctgattttctgttatagacatctcagttcacactctgagaggacaccacaaacagtgataagggtgacagctgtcaccagcacctttatcacatgtgaaagtgtatgtatgcctgagaagtccacatgttttaagcaagagacagagatggaagtgagagctattggtggattttaaacatgcccgcaaagtaataccttatgcctatttgatttataaacggcccctctgccaaggtcatcttaagggaaccaaggaaacggggctttcttcctcttttgtgtggctgggaaaaataaatagttggcccccagagttacaactttcttcttcacttgtatgttgtaaccctagagattctcctgctccatcaaaggaaacatctgctgtcatctgtgcttttactgttgctgttaaatatttctttcat

SEQ ID NO: 8957 - DNA, 1088 bp, Homo sapiens
ggctcaagtgatcctcttgcatccgcctcctgagtagctgggaccacaggtgtgcgccaccacacccagctaatttttgagtttttgatagagacagtttcgccacgttgcccaggccagttcaagcaatcctcctgcctgagcctcccaaattgttgggactacaggcatgaaccaccacacccagctgtgtttgaaattttttaccatgtgtctggattactttaaaagaaggtgggggccaggcgcggtggctgacgcctgtaatcccagcactttgggaggccgaggcgggtggatcatgaggtcaggagatcaagaccatcctggctaacacggtgaaaccccgtctctactaaaaacacaaaaaattggccgggcatggtggcaggcacctgtagtcccagctactcaggaggctgagtcaggagaatggcgtgaacccgggaggtggagcttgcagtaagcggagatcgcaccactgcactccagcctgggcaacggagtgagactctgtctccaaaaaaaaaaaaaaaaaaaccgaagaaggtggggatgggcacagtggctcatgcttataatcccagcaatttgggaggctgaggcaggaagatcacttgagcccaggcagtggagattgcagtgagctgacattgtgccactgcgctccagcctgggcgatagagcaagactcagtctcaaaaaaaaagagggggtagagtggtgggaatagacatatacaaatgtttatatgtcgatccagctttctgtaagcactccacaccccacagctgttgtagcatccacctccttgggaggcaggctctcagaatccctgctccctgagggcagggagtgtcatgttcactgttgtctcactggtccctagacagtgcttggcacatagtaggcccacaaagaaactcctgcagaagcagtgccctcctatgacatgcctctccaccttccagaagcaggcagcttggaaagaaaagaggtgggaggcccacctgcagggacagcacaacacctgctaagggccctgcaggttgggggtctctcctcggcagcgggatgcagaaatgaat

SEQ ID NO: 8958 - DNA, 1047 bp, Homo sapiens
aggtgggttgaaaacagtccccagagtgcagatagcatttctagtcctggttggaaggctcagggaggaaagcaggagcttggaccaggtttgcgggctctgctgctctctatccctacccgagggacccctaatcacccaccccccacagaacttcttcaaagagctccggggttggtccccagctgtgtgtggccttgggtgagaggctttgtttctccatcttccatccctgtaactctgttttgtccccagctctgaatggagtgcctgacccttccctgaccgctaccccccaatggaggactctcagcagatgggcaggggatgagggcttggcctgagcctcattcccgcaggcttaggtggcttcatcattacagccattccgatcaagcagcacagccagctggccaggccccaaagctcttgtctaatgtgtccgtgaaacaatgccacctgaggggctgcgtattcccatgaacaaaatacatgcatgtccatcccttatctggtttgggacttgcctgacctgatgctactaccccatattataggcaaggagactctggaagggaaggtcctttgcctgtggccacagagcaaagcagcagcagagacagctcagaatctgactgatggctcagaggccggggctcaaggcactcagctgcccctcctctctgagagctgtgtcctggggatgggcaggaatgatgcctgtggggttagaagcctgagagaaggaggggccagagcccacatgccttgccacttctaggctcagcaaatcactgtcggtgccctgagctttagttcccatctgtaaaatggggatcgtgattcaggctctggccacgtcactaggcacccccaggaggatgtaaagaattcaggaacatgaagcaatgggtaaagggcacagggcggcctggcaaagtcccatggcaagaatggggagaggcacaccctttactcacccctaccacagcttggcccagggccatcattgccacttactcaatggtccaggcctgttttcctcca

SEQ ID NO: 8959 - DNA, 1024 bp, Homo sapiens
attcagatgtttggcaagaggtggctgagcactggggtgggcttggcactgtgccaagcctggggccaatccctgcccagtcagctggggtctggtgggggacacccaagaataaaagaataaccacaaagtgtgcaagggaccaacagcttctccagcttaagagcaccgagggagcatgcaggagggatgcttggagctgggagggtctaacagtgctgcttcaagattcattccatccacggctgtttactgagcatctccagtatacaaggcacggctccgggtgctggggatacaaggcagacgccatccctgctctctaagagtttaaattctagttggaagggggatattaaattggtaaacaaataagagatgatttccagcagtggtaaaggctacgaagaaaacaacgtgatcaggaatgcctagcagggaggtcagggagtgtcagggctcattaatgtgatcagatgtgattctgagccaaatcggagctaccagccagataactcatatgtaagcacaggcactgaggaaccagagtgaagacagagcagacaccacacagcaaaagagcgtggacctccgagttgcacctggcctgagactcagtttccccatctctaaaatggagcaggccaggcatggtggctcacacctgtaaccccagcactttgggaggccaaggtgggtggatcatgaggtcaggagatcgagaccatcctggccaacatggtgaaaccccgtctctactaaaaatacaaaaattagctgggcatggtggcacgtgcctgtaatcctagctactagggaggctgaggcaggagaatcacttgaacccggaagctggaggttgcggtgagccgagattgcgctactccactccagccttggtgacagagtgagactctatctcaaaaaaaaaaaaaaaaaaaaaagagccactgatagctacctcacagggttattgagaaaactagggataacatttatactagccacagggaagggttttttg

SEQ ID NO: 8960 - DNA, 1031 bp, Homo sapiens
tttcttttttttttttttttttgagacagtgtcttgttctgttgcccatgttggagtggagtggcatgatctcagctcactgcaacctctgcttccccgggctcaggtaatctggtaatcctcccacctcagcctcctgagtacctgggactacaggcatgccaccacacccggctaatttttgtatttttagtagagacggggttttgccatggtgcccaggctggtctcgaactcctgggctcaagtgatccacccacctcagcttcccaaagtgctgggattacaggtgtgaaccactgcatctagcctgaagaaaatccccttaaaaatataaaaactggctgtgcactgtggctcgcatctgtaatcccagcactttgggatctcttgagcccaggggttcaagaccagcctgggcagcatggcaaaaccccatctttactaaaaatagagaaattagctgggcgtggtgctgtgcgcttgtaatctcagctactatagaggctgaggcaagagaattgcttgaatctgggaggcagaggttagagtaagctgagatcacactgctgtactccagcctgagcaacagagcggaaactcttgtctcagaaaaaaaaaaaataaagggagttaaaaaaaaaatgcatgagactgtatgtggctcacacaccctaaaatatttaacactctggctctttacagaaaactttgccaaccgtattgacctttgggttagaaaggacttacatttttgagtcacctgtttctgaagagctgataaaagccctagaataatgtccaaatgcgcataggtataattttgcttatcatttcaaggcattaaggactaattttattcaaaaaaaattagaagaattcagccatagtcaatattaataaacaaggaatgacccaattgtttttcatataagggacaattattttgtgttttttagtgaaactacacaagtcttaaaactgaggtgcttgacaaacttctgtcttcccaggccctcttcctactccca

SEQ ID NO: 8961 - DNA, 23557 bp, Homo sapiens
cctccgccgccgcctggaattttccagatgtcctgccggcccttctttcgggcctcggctgggcgtggtgacctcaagcgaccccggcggctcccgtcgcccactcaagagggcgcccccgcccgccacgcccccagcccctctcggggaagcgcgtcccccgcccgacctcaacaacatccgggaagaaaaggggtcttcttcctcatggcattcgcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaaggcgctggtggtggcacgtccagcacggctgggccggggttcgagtccccgcagtgttgctgcttccttccagctccctcctccaggcctctcctcccaccccaccagggatatcttgtctcctagaggggtagcattgggtggggcaccccaggcctctcccagaagccctcctgccctgctatcccctccctcatcctctggggccctgggaatacagcaggggacgtggggccacaggcagctgataacttagccccctcagccactcctgtgggagcgggagggggacagcttggcggctctgcacccaaagctgtggggcctacctggagtgtccccacccctcagggc

SEQ ID NO: 8962 - DNA, 7846 bp, Homo sapiens
agaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtc

SEQ ID NO: 8963 - DNA, 1052 bp, Homo sapiens
gtagcagcatctggctgttggaaggactggctgggatctcaggtgaaataccctccctggccctccttacccttaagatctccctgaaaagtcagaccttgcttattggagtttgagatgcattctagtaaacccagacctaccagagagagggacccacgtctgaagaatcttccagcctggggaacctgtgactggccacacccttagcctaatggaggggcctcagaagcagaactacctttttttttttttttaatggtattacattttgcaaatggagaggtagactctgattgggccccttttgacaacgcagcagagctgaggtttgaatcctagtcagtcaacacttcaacccctatgttgctgtttcttcaatgtctagaatgttctgatagatgaagcaatggcccggcaggtcagcagcacaccaacccccaacctacccagcctgtataggccttggccacaggagctttctcttcccttgaagtgatctaatgggggatggggtatctgtctcgctggttatgaaagaagctgagctaggtgctctcctaagttgcttaagtgtcttctgaattgatgcccagtcagtttcgtatggagaaaggtctctgtttttccaaagcagaaggttctgtggaagcacaaatactttactggagagcaaaggagtacgagtaggaattgggggccacgcacagtggctcacgcctataatcccaggactttgggaggccgaggtgggcagatcacctgaggtcaggagttcgagaccagcctgaccaacatggagaaaccccatctctactaaaaatacaaaattagccgggcgtggtggcgtatgtctgtaaccccagctattcgagaggctgaggtaggagaatcgcttggacccgggaggcggaggttgcagtgagctgagattgcgccactgcactccagcctgggcaacaagagcgaaactgtctcaaaaaaaaaaaaaaaagaagaagaaaggctgggcacggtggctcaagcctgtaatcccagcactttgggaggcc

SEQ ID NO: 8964 - DNA, 1031 bp, Homo sapiens
gtctttctacctctccccctttttgcctcggtttccccatccctctgtcccttcttaagctctcatccttacagtacgctagaaggcaggctctattatcctttaggatttaggcctctttagataaaagggctcacaggcttggagggttttaagtgacttacccggcggcggagtactgatcttagtaccgcccgccgccccggactgccccgcccctccctagcccccccatccccgcccctccctagcccccccatccccgcccctccctagcccccccatccccgcccctctcccgcccctcccttgtccccgccccttcccgccccaactcaggttctgccccaccccgccccaattcacgtcctgctccgccccgacgtaggccccgccctggcccccgggccccgcccccgtctgacgcaggccccgccccctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggtgagtgcggccgagctccgtaggccgcggtcgacctgggccttgcctattccgcgccgccgaccccgtcgcgttgcgcccggcctgacgtggcggcggaaccaaggggtagcaggccggggagggggcgggcagtgcctacgtggcgggcggagggaccgagggaccgacaggcggacagggccggggtcacgtgggcccggcgaagtgtccctaaggctgacctggggagagacctggctgcgggcccttgtcttccggccacacaacagctctgggaccatctcaggccccgctgccctcccctaggccacaggcagccccgtgtccatcttcgtctatgatgtgaagcctggcgcggaagagcagacccaggtggccaaagctgccttcaagcgcttcaa

SEQ ID NO: 8965 - DNA, 1059 bp, Homo sapiens
ctcacgcctgtaatcccagcactttgggaggctgaggcgggtggatcacctgaggtcgggagttcgataccagctgacgacatggagaaaccccatctctactaaaagtacaaaaattagccgggagtggtggcacatgcctgtaatcccggctactcaggaaggctggggcaggaaaatcgcttgaacctgggaggtggaggttgcagtgagccaagattgtgccattgcattctagcctgggcaacaagagcaaatctccgtctcaaaacaaacaaaagaacaccataaataagaaaaccagccagtgcggtggctcccgcctgtaaacccagcactttgggaggccggggctggcggattatttgaggtcaggagtttgagaccagcctgaccaacatggagaaaccccgtctctactaaaaatacaaaaaactagccaggcatggtggcgcatacctgtaatcccagctactccagaggctgaggcgggagaatagcttgaacctgggaggcaggaggttgcagtgagccgagatcgcaccattgcactccagcctgggcaacaagagcaaaactcagtcttaaaaaaaaagaaaagaaaaatccagtgcaggaaggaaagtactggagtgggtattcagggatgggctctctgaagtgtgacattggagctggggcctgaaggacatgactgtgggagccagagggatggtacctggagtaagagttccaggcagaggcgacagcacgtggagagatactgaggagggagccctctgctttgcctctgaaccttggtttccacatgtgtatagtgaggagcatctgggtgcactggcctgcagggttgctgtagggaggagggaggaaggctctgctctatgcaatgcccggccccagccgtgtgtggggaagacagcgggggctgagaatcagaatcaggagcaggggaggagagtggcagacactccacagaccctgacccagcagaggtcatggaatcttgactcagatgctgtggggcggggagggcctttggagggtggaaacctggaa

SEQ ID NO: 8966 - DNA, 1050 bp, Homo sapiens
ctgaacgaggccaacctcaatgtggagctgatgaagcactttgcacggctacaggccaaggatgaacagggccccatccgctgcaacaccacagtctgcctgggcaaaatcggctcctacctcagtgctagcgtgagtgtcctgcacaactgctggagcccggtccctgtcgcaggaccacagcctcctccagggccaggagtcttgtgtgtgggggccttcattctcccagagacttagaccctgcacgctgttggccccatatctgggttcccagaggaggagtgagttggccgaagtcacacagtcaggagggatctgggatctgaatccaggcgtgcttggccccatggcctgtgtgcatcccttcagccagggtttgtaagttcagttgcttgccgtgcccagacagttaacaggaatgaacggtcagctgggcagggaggaagggagcctgtgtccgagccctggggacagctgctgttgtggtcccatgccctgaggcagtgtggaacccagtgatttgggaagagaagcccaggtccagagttttaggtcaactctccccatttaagtgattcattcatatttttcagattctggggacctatgggtggtcccattctgggaagtaagggctggtggttctgggtcccaacattgaccctacactcaggagccctctttcctgccccatcgtagaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggtgaggcacagctgggcctgggccctgggctggggctgtaggggatgtcagcccctagctggcctggtaggttcttgggaaccccagagaccccagctctgcctcgttaccccacaggccttcaaggccattcggagcttcctgtccaaattggagtct

SEQ ID NO: 8967 - DNA, 1063 bp, Homo sapiens
ctggtgactgtccctgtccaatgcaggtgccaacaagctgcaggaggaggtgctgatccaggagtggttcaccctggtcaacaagaagaacgctctcatccggaggcaggaccagctgcagctgctgtgagtgctggccccgggccaggagagcagagggactcttagctactttggttagagttcttcactactttcttattcctacagagatctttttgacaaacgattcctcttccatcttactgtttttgtcctaaacaaattgctgtttaaagtgtaaaactggccaggcacggtgtctcatgcctgtaatcccagcacctggggaggccgaggcaggcggatcatctgaggtcaggagttcaagaccagccaacatggtgaaaccccatctctactaaaaatacaaaaattagccaagtatggtggcacgcgcctgtaatcccagcaacttggaaggctgaggcaggagaatcgcttgaacctgggaggcagaggttgcagtgagccaagatcagaccattacactctagtctgggcaaaagagtgagactctgtctcaaaaaataaaaattaaaacaaaaattaagggtaaaactcttaaattagaactatttttactaataagaaaaccggccgggcgcggtggctcacgcctgtaatcccagcactttgggaggccgaggcgggcagatcacaaggtcaggagattgagaccatctggctaacacagtgaaaccccgtctctactaaaaatacaaaacattagccaggcctggtggcgggcgcctgtagttccagcttctgggaaggctgaggcaggagaatcgcttgaaccctcctggggttgagagattgcagtgagccgagatcgtgccactgcactccagcctttacagtaaggaaaacagaagcccagagagatctgatctggttcccatgtggggtccgaagccactctgcggccattgcctttgtcatcctgcagggtggagacagctttgcctcccttttgcgtttgggatttttcagaataactgtagccagtgcttcctgttta

SEQ ID NO: 8968 - DNA, 1011 bp, Homo sapiens
tgtcttggcgggagcctgctcaatctgagtgccgtgggcagcccctccccggcctgtgccaggtggccctctgtggtcccttggcctgctcccatcagctgagtctctggcctctccctcctgcagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgagtgcccacccctgatggccaggcctgggcagtggctcgggctgcagcctggctggtgggagctgtggtcctctcggctcaggagtgccagcagggggcactcgctgcccacactaccctttctgctccctccctgccctctgtgtccgtgttgcccggctgcgctctccaccgactcttctcctcgtgccctgctgtgcccttcccttgcctgtgttgccctggtcctgccctccttcctgtctgtgagaagacggaagaattagaaccccagggccctgaagggatctcttgtccagaattaaacactgatcaccagtggaccagagctgcctggagcacatcttcactgggctgcataatggtttttaaaaaatcctggagcctctattttagcatctcgatttgagatatgaagatccatgtttcttgagtttttcttaaacgacagaagattttgcttcccagactagcatccctctgtggctacaaccagcctgaaccgaggggtctgccctttagaagggcccagctcacgggctcactgtgcactcaggccctagccagcctgctgtacgtaggtgtttgcgatttcatcattggccttgttttaacagacagcagagcagagcacctgccataaagcaagcctcgatgtgctaagtgccatgtggagcccttgccctgctggggctcgctgctcccatttgagctgccacagatcagcccct

SEQ ID NO: 8969 - DNA, 1030 bp, Homo sapiens
gcgtttcccagtctgagcaatgaggtggcagggtctcttggccaagccctgtgcctgccccaactttaggtcccagtgactctacaggtcactgcagtgagggcctgggcctggaggtctgagttctcacacccagcctgctctgtggtctcaggcttggcccatgggttgggcgccatgagtgagccagctccttcctctcaggaagacgtgtgtgttggatgcccgagagtgcagaggggccagaccgtgtccctgctccctcccgccctgcccttggatgctgggagttgggaggagaaaggcaggcgctctttcgtgaatcttggcatccaataaggttgactcccctggcgtccaagggggtgaatggcagcaggcctctgatgccatgttggtcactctcccaggacagggcaggtagggattgttctagcagcccctgactgcacacccctcctccacaggcacttactgccagcagcgcgaggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaaggtacggtgggcaggtgtggccgggcagcagggcccttgcgggtgagcgctcgctgaccagaggccccagtaccccctttctgggttgttgggagcctgttttgtccaagggaagctgaggcctcagagagtttaagtgtcccctgaggtgccactgccagacctcaggttgcaggggcctctgtgcccatatggctctgataggtgcccaggcaaggaaggcttgctttgggcagtgagtatggggcaggtgggcagttgcagaggccagcctttgaaaccaccagcccctgcccccagctcacccagc

SEQ ID NO: 8970 - DNA, 1099 bp, Homo sapiens
aagaaaatggccaagccaggccttgaacccaggctggccctgagccacagagctttcctgccttagcctgggggctctgagccaggcctgaggatcttgagacctcttgggggtgggagggggttggtgaggcaatgtggggtacataaggagccctggaatgggggttctgatcagcctggaatgtttcttccctgtgtccctcagcttaccccttgagaagtgggggttattgcagttctctgagatggcagaaatgttgaggcttggccaagcgtggtggctcatgcctgtaatcccagcactttgggaggccaaggcaggtggatcacttgaggtcaagagtttgagactagcctggccaatgtggcgaaaccccatctctactaaaaatacaaaataattagccgggtgtgatggcgggcacctgtagtcccagctacttgggacgctgagacaggagaatcacttgaacctgggaggcagaggttgcagccagccgagatcgtgctactgcactccagcctgggcaacagagcaagactgtctcaaaaaaaaaaaaggaattttgaggcttgtggtgctcagaataagcgtactgggagtggggtggcctgctgatcacagtgcaggctcccacgtgccttcttaggatctaccctggtgctccctatgttgggctcggtgggtggcctactggggcccaggtgagcctgccacctaggttctctctggagtagtttcacgaggccctggctgtccttctccaaaggaaatcctgtccacaccacatatcagaggagctgtcatttgtcattccttctgccctcccagccactcctaggcaaggatttgtgagaccacccccctttcatcaagaaggaggctgtgtctagagagggacattcccagtcccaggtcaccgagaggtcatggcctggtccaccttccggtcccatcttgagagaggtgcccttgcccaggttgccctgctgtgcctgctaggctagggccagcaggttgagatgcacctggccaggtctcttgtcccatggggaagctgactggccacatctaaggctgcctcaaaggctgggca

SEQ ID NO: 8971 - DNA, 1031 bp, Homo sapiens
gtaaatgttgagtgtgatgatcttgttctcgttgggggctgccatttgtttgagcctcaatttctcatacaaacggggcatattctagggcagaggcaggcagatgctgcttgtgagtgctagccccagcacaggacttcctgctctgtaagtgggtgcttcctggcggctttgtcactcctccctggtctaggggaaggagccaacttgcttggttgctcttgagagctgagatggctctaggagcggggcatcccagaaagcggacttcagctcagtcttggggaggagcctctgaacctccatgctttctcctccagtggccagggccgggaccccggcctgacgcctgcccctcctctcccagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccaggtcaggctccactacctgaggctgccacctggggctgtgggacctgggcttccctgctccccttctccccatttggtttcctctcactctgagcctcccttagcctgagccccagcccccactccaaggtccctgtcccaggtctgagctgggctctgggatgggggtccttatgccacagcccgtggaccaggattggaactccccgctggtcacgctgtgttttggcctgtgtgtgctgggccgccgggccctggggacagcctctcacagcatgtctgcaaggtgagtgctcgggtgtcccgcggggcctactgccgtccccaccccacctcttccacgaagagcactgtggtctctggccacagtggccacagaaactgcagtggcccttcctgttggggtacctcttctcccacgggcagggcacttc

SEQ ID NO: 8972 - DNA, 1078 bp, Homo sapiens
accccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggtgaggcctcgggaaggggtgacgtgtggcgcgggaggaagctgaggtgcagtacgtccctcctgggtctcagagggaggacgtgctggagccagggcttgaatcccgagagatgaccccctcccagagctgacctgcccctcctagatgtcaccttacccccagagctgacagtggcctttagtcatcaagcactgttgacaacgcaccctcaaaagactctgcaaagtaggtggcagcttcttagaggggaggatcctggggctcagaggtgttagatgacttgtcctggggctgaggactcatgcttgtgaggcctctggcctcagccgtgtccctcctgatcccttttctacctctccacccccaggcttcacaagggctgtggcgccggctgcaatagtggcgggaacgtggatgattcagactgtagtgggggcggtggcctgacctccctcagcaataacccccccgtggcacaccccacacctgagaacacggcaggtgagcaggcgaggctgggctgaacccgtgggtgaggagtgcagcccagctgaggcctctgctgtcttatctgtctcctacaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtac

SEQ ID NO: 8973 - DNA, 1065 bp, Homo sapiens
ccctgcacagctaccgcgtcatcgtgcggaccacgcaggtgggccgggatcgcgggatcaggacgtgggttgcctccccgacaccttgtatgcatcctgagtgcccttacaccccttcctcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtggtgagtggcgggccgcggagcccccagccatacagctggccccagtctgaacccagcctgcccagctcccaaacccctagccttgaccctgatcctgggctgggtggtgaccccagaagagctggcttttcagagacagggcatcagagttcatctggagccttgcgtctcaaagtgagctctgtagaccagcagtatccacatcatgtagaaatgcagattctggggccccaccccagaccatctgaatcagagtttgcactttatttatttatttatttatttatttattttgagatggagtctcgctctgtcacccaggctggagtgcaatggtggaatctcagctcactgcaacctctgccttccgggttcaagagattctcctgcctcagcctcctgagtagctgggattacaggtgcatgccaccacgcccagctaatttttgtatttgtagtagagatgggggttttaccatgttggccacgctggttttgaactcctgaccttgtgatctgcccacctcggcctcccaaagtgctgggattacaggcatgagccactgcccttggcccagagtctgcattttaaaaagatatttgcagccctagatgccctggtctgactcaccccactggtcctgcagttcccgcatcattcctggccaatttcccccacagcccctgctgggtttcctctaacatgtggtgctcacagcttcctggagcggctccttccatcccccactccatgctgaaagctgc

SEQ ID NO: 8974 - DNA, 1035 bp, Homo sapiens
cccctcccacctaacagatccactagcaaggagtggactttctgaccccagggccctgcacacgccattcccttggtttgtgggtgaagaaactgagatcaatatggaaaaccagtaccaggactcaaactcccgtgtccgagtgcttcgttagaattgcatttaaccgttagaattgcatttagagtacccccgtcttcctgcagaaaccccgcctccgggggcggggctttgggggaggggtggggcatagcagcctggccgagttcccccttaaggcgtcctggagttcagttttagattgtgcatgtcagttgagggttgcagaaaccttaccctaatgtaaaagtccccctgcgagtttccagcacggatctgaaaggcattgtaggcaccggggtagacggaggtcgcctggatctggaacacgtcagcgggcacgctccgctccgaggtgatggtcatgtagcggtgcacaatggatgaaggctgctctcgacatagagggttggaggccgggcagagacagcggctagagaccccgaggtgggggacacaaatgagctccttgcccgtccccccaatttctcctaccctacaaagggagggaatcccaaaaggacccttctacccctgtgactggttttcatgaaggactatgattcccatcatccctcaggggcactcgctggtctgaatagatgccagtcagccccaaagccccctgggagacgtagtttctgtgggggcctggcatcgaattgactcacttctcagagacctggatgtagggctccacgcagcggttggtgtccacgcagcggtagcccccatggaagttgacacaggtttgggcctcggagcactggtgcgcaccagactcacactcatcaatgtctgtgccaggggagaggggctggaatcgggggcgtcaggctgccagctcctgacaccgtcctgcccatcccacccgggcaacctgtaccttggcagaggcgtgtggccagcagctggtaaccctgtgggcagtggcag

SEQ ID NO: 8975 - DNA, 1077 bp, Homo sapiens
tacaggctagctctgggaacagaaagagcacagcttggcagtcagagactgacctggtggcaaatccctgctcataagctgtgtggctttggggcaggtcacataacctctctgtgcccccatttccccattagaactaacatttataaagcacaaactgccaggaactgttctaaccactttacaaatactgactcatatcattggcacagtaatatcttcattttcttttctttcttttttttcttttttttttttcagatggagtctcactctgttgcccaggctggagtgtagtggcacgatctcagctcactgcaacctgcgcctcccaggttcgagtgatcctcctgccccagcctcctgagtagctgggattataggcgtgcaccaccatgcccggctaatttttgtatttgtggtagagacagggtttcaccatgtttgccaggctggtctccagctcccaacctcaggtgatccacccgcctcggcctcccaaagtgctgggattacaggcgtgaaccacagcgcccagcctagtatcttcattttcagacgggagaacagttgtccgcagacacagagccaatgagcccagcagctgggctcttacccactcctgcacccgtttgcacgaagaggataattacagctcccagctcaaggggaggctgtgagaatcaggtgagagaatgtgtgcgacagtctggtaagtggcaggtgcccagtgcagaggggctgaggcaggaaagagtcactgctctgggttcaggccattccattgcttttttttttttttttcttgagacagggtctcactctttcacccaggttggagtgcagtgacctgcgggctcaagcaatcctcccacctcagcctcccaagtagctgggactaccgacgtgcaccaccacatttggctaattttttttttcttttctgtttttttttttttgagacacagtcttgctttgtcacccaggttggagtgcagtagcccgatctcgcctcactgcaacctccacctcctggattcaagcaattctcctgcctcagcctcccgagtagctggg

SEQ ID NO: 8976 - DNA, 1068 bp, Homo sapiens
ccctttttgcactccgcttggtagagccctgagtgttttctggtgatgctgagtggcctgaagtcctaggtcacccctccctgtcccgtaggccaagttactggaggagatggaccaagagtttggtgtcagcactctggtggaggaggagttcgggcagaggcggcaggtgaggctgcagcaggggtggtacaggggacactggtggccttgctaccggaatcccgaggttgggtgcgtggagggaggttcctgactcgccgattcttcccttaggacctgtacagtgcccgggacctgcagggcctcaccgtggagcatgccattgattccttccgagaaggggagacaatgattcttaccctcaaggacaaaggtaatgcgagctgggtgccctgggtgggggcacagcctctgctgagttgcggacaagtgtgaatggccactgctctgtgctgcccccaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcaggcacggcctgggcaggctgggtggcgggggctgaggtggagaatgtcgggaatgggggctctgaggaggtggtggctcagtggcttttcaggagccagcctgggtcccaacctgtacctcttgccttgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgagccctcccgtgccttatactcggggtcaagattctccctccctctggggctcctgccctgcccgcaggcactgagaagacagggcgagtatttgtgttcacaaagcgcttggcctcgc

SEQ ID NO: 8977 - DNA, 1048 bp, Homo sapiens
tccggaactcaagcagtccacccgcctcagaagatttttttaaaaaaatgaatgtaatataaaatgaaagaggggtgcagaagtggacatagtgactcgaaccttcactgaggagtgaggactttgctgtctgggctgcagggttgagggagaagttttttaaagaggggagatggtaatcattgtgtgtggctgggcatctgcgacaggagggaaagcagagggtgctggtgcccgtgtgggggtcgctggattcagtgctggcagcatgagtgagttctcttcccatgtcacggaacctgctttcttggtgaagcaggaagcgagaagctgggctgtgggaagtcaaaagcgtgggccacctcaccaccctgcgggttctagaagtgctgtctagagtcctgaaaccggagtttgtcgggggaggggcaggtggcaggagggagcctggaggaaggagtttgaggctgaggtagtgtgtgaggggctttggagggggattggcacaggcctggtcaggaaggccctgtaggatgttgggtattcattcaaagggcatccaaacccattgatgggtttggagcagaagagtgaccccagtgaaagaggtgcagagtggagttaggcggcagatagcagctgggcctgcatgggctgtgggcgtggcctgtctggctgctgccagggaggacccttaggttcctgggtctcaatggcatcaccccagaaactgctgggtttgcccacagccgctccctcccccaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggtgcgtctggggcggccccgccctctgcttccctcggctgggtgggctggctggggcctgggccgaccctggtcttttgtgccccaggactttgaacgggatgaggagc

SEQ ID NO: 8978 - DNA, 1055 bp, Homo sapiens
tggaaacagatgctcgctcgtccctgggccagtcagcgtcagagactgaggaggacacagtgtccgtatctaaaaaggaggtagggattggagctgagtgtggaaggaaagccaggagatgggacttgggtacggaaataacacaatttgtaagtgttcagtaagtaatagcttctattttgtgccaatttccgccctcagcatcttatagatatttttcatttaattgctttgagttccaagtactatacgtgcctacattttacagctgaaaaagcagaggttctgagacgcacagtaatttacccaaaggcatacagcttgtgagtggcagaactttggagtctgactccaaggccccttcgcagctacttcatgagatggcctccttgggaaaagcctgactgttgaactgtgggggagaatgggggaggagtttaggggttggggtgctggcacagtgcttggattccctgacccagctggttttcctcctcttgacagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaaggtacaaggagagcacactaggaaggggcagtgccaaacagggaaggggctcagaggtgggtgagaggcagcggtgaacaggcatcttttagtgctggccttaggaactgggaaggggctcagagggcaggggtttcaccttgtctgcctccttagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggtcaggcccagccctcctggtgggaagcagggactctgggca

SEQ ID NO: 8979 - DNA, 1126 bp, Homo sapiens
acctacttgttacttgtctaattatccttttgttttcctcctctgctcttcctcccctctgccttcactttgccagctcacctggtgactcctttctcagatgtactttgtggctagagattcgtggtggttgtgtaacttcttaattttaaagcttttagttaaatgctttgaattcaggaggtagaaaagaacatggggaagtctctgctttccagagaactgttgagattcatctcttgatgagatggtttaaaaactagttattgatatacacggctgaggctgatattgtatagtctgttttgttcagtatggattatgtaattttgaaaggttttagcaggaaggattttgatgactttcagggtgagataattgaggcttcccatgatctcatttggagttgggagctggattctctacatgaatttggtgagtacttgttaaggcttgtttgctgccattctccacaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggttcgggagggggctgggagaggtcaggctgggccttggggttgagactgtctagggcttttttttgtttgtttgtttgtttaaaaaagatggagtctcaccctgttatccaggctggagtgcagtggtgggatctcggctcactgtaacctctgccttgggggctcaagcagtcctcccatctcagcctcctgagtagctgggaccacaggcacaccacacctggctaattttttgtatctttggtagagacagggtttcgctatgttgcccaggctagtgtggaactcctgagctcaagtgatccacccgcctcagcctcccaaagtgctgggtttataggcatgaaccaccgcacctggccaaggagggcttttgaagcaactacgatagttcctcagccttagaattgcccatcgactaccctcggatgagatggaatttaaaaatgaggctctatttggaggagagatgcagatctggtggcttctttccctgat

SEQ ID NO: 8980 - DNA, 1428 bp, Homo sapiens
acttcagtctctcagaaataattttatctcaagaatgtcttcaaatttcttattttaaaataagcattaaaaaaattgatgagtcattaaagtaaaacagtagtattgttaaattttagatagaaatttctgccccttaagataaatagattctgaacaagctagctttccaaagttaggaaaactcaataagaaattgaagtcatgttttcaatgtacgtattttggtttcagacagtaaagactctgccatgacagaagttattagcatactttctgcctcctgtctccttatcctgttgcctccagattttagttgtttattaattttggtttctaatgcttcataacatttgatttaattctgcagtcataatttccggagttcccaagtatcagctctgtacttttgagtgtgccttttctctagggcttcagaatttcttttgcagctaaggagtgaactgattgtgctcactgtcttgcagagctgttcctttgggtaccatgctggtggctggggcaaacctccagtggatgagactgggaaaccgctctatggggacgtgtttggaaccaatgctgctgaatttcaggtatgggccatgtactagcgatcttggttttacttaatgtcatgaaggttagattgttggtttatagcttcattatcagggagttgtgtgttctgacacagcagagcctggaaaagggcatacattttcctgagatgttaatgtaagctcctcactagaatttgagctctaggtaggtagggattattgtgttttgactcttacaccccttcagcttaaaacagcctggcacataataggtacttagaaaacatttgttgaatgataaagtgatctctttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacaggtgggggaagcagagaatgcctcttggaagtgggctatctttggggtccttctctttactccagagcttgttcctctctttacagtggccttatcactcctggaggcttttcatcagtgcctgctggaatggagacccctgaactcattgagctgaggaagaagaagattgaggaggcgatggacgggtaagggtaccagacagggctgagaggggaggaccttcacttccctttggctggctggctgactgttgttcctttctccctcatccttttttaaacaattattgaaccaactctctgccaggcactactgtaggcagtgaggagtcagcagttgaggtaaactggtaatcagagaacaagatactttcagatgtagataaggatgttgaagcagaggaa

SEQ ID NO: 8981 - DNA, 1044 bp, Homo sapiens
ctgtgtttccacatcacttaacagatttacacattgttttttttttctctgtcctttctctagggaaatcaggagccacattaatttagtttgctgtggccagatccatagcacaacaccaagctcaagcgagagttgagtatgtgatggtgttcctctcttgatcctaagcaggcctctctctttctatacaggcccatctatcgctgaagtatcctaacccacctctttcacacatagaaacactgtgttccttcctacgtgggtccagtctttcccatttctccttcactttcatgcctgtgtttggtgacgtttgggcagctgccttctccatctcgttaggttgaaaaggcgcgagcctactggcaaggagctgcagcagaggggcgtgaatgaaatcattgactgctgttgatgtttggtctgcccctaggtcttttggtcactgcaaagtccacgtaataaattattagcctaagaaacagccaggcatcctgatcaaatgtataattattatgctaacttgctgtgagaggcttaggcggacttatttttacattccgggagtgtgcagttacgtcacgtttactgaccagtccttgagcttgtccactgtcctgctccgacattgtttttcatccatcacccttgtacctcctcactccttgtggaacacatgtgctctttgagcattttgcaggccagaataacactctgtggggagaaaatggcctgccattggtctttccaattattagagtcatctggttaatttgaggtctcctgggtgtccttgttcatgttgtttagaatatataggcaacatgcagcactctgtggagggattaacattcttgtctcatgtaactcaaacgggacacaaatatatgagatacatgccccttagaaatgtaaacatgattgtggatctaaggttaggtgtgcataagaatgtcatgggatttggtctcttagggcagagaagaggggctcgaacagtacagtgttaggaaggtcctgctgcttttcttgatgcctgtc

SEQ ID NO: 8982 - DNA, 1061 bp, Homo sapiens
gataattttgtatttttagtagagacggggtttcaccatgttggccaggctggtctcgaactcctgacctcaggtgattcacctacctcagcctcccaaggtgctgggattacagttgtaagcaaccatgcctggccaactgtaaggtttttaaggtacaacaaaggttggaatatttgagtttagtgctagcttcaacaatttttctgaatctcaaatatcgttcttcctcttttctccttgtgagtaatgatctgtgtccactctcagatcaacctgggctcccttcatcctttcaacactttcagtacttttagttttgtaaatacagtggtatccacaggtcattttggcaaaaacactttttagaactgtatgcgtcttagaaattgtgatgtgggtaatttgctgtgtatgttttttagtgacctcgtataaatataggtagatgtgaaaggagtgacgccttaaatttgctccctactgtaacacctgttcccttctttgtagtctgtgtaactcctccaaatgacagatcttttggacacattagtggttatgtgatttctttctaaactagttttccaaactacctctcaaaactttattatgagtaggatttcccccagctaacattttgggtatgactggcatgttaattgtctctgaaggattttagactggttattttgtttttgattttgagataggctctcactctgttgcccaaactggaatgcagtggcatgaacacagctcactctgttcagcctcaacctcctgggttcaagtgatcctccctccttagactcccaagtagctggaaccacaggcacatgccaacatgccctgctaactttttaattttttgcagagacaaggtcccactatgctgcccaggctgatctcaaactcctgggctcaagcaatcctcccgcctcagcctaccatagtgttgggattataggcgtaagccaccgcacccaggctaggctggttattgtgctgagatataggaaggcgttttttcttttcagctgttttcttttctttttcttttt

SEQ ID NO: 8983 - DNA, 1091 bp, Homo sapiens
acccttcatgctaaaaactctcaataaattaggtattgatgggacgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcaattaggcaggagaaggaaataaagggtattcagttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttacacaccaataacagacaaacagagagccaaatcatgagtgaactcccattcacaattgcttcaaagagaattgttgttgttttgagacggagacttactctgttgcccagtctggagtgcagtgatgtgatctccactcactacgaactcaatctcctggattcaagtgattctcctgcctcagcctcctgaacagcaggggttacaggcacatgctaccatgcctggctaatttttgtatttttagtagagacggagtttcaccatgttggccaggatggtctcgaactcctgacctcaagtgatccacccgccttggcctcccaaagtgctgggattacaggcgtgagccaccacgcccggcctcattattgcttttatttttaatcaaagttatacatatattttagagagtcacgtagttttacagacttatttagaaaacaatctttaggtattatctggtgaattccagctgtcgaaaactgtttggctttttcatcagcacccacattttcccaataagtttgtaatttcttcttttttttttttaaatttttgagatagagtctcactctgttgcccaggctgaaatgcaatggcgtgatctgagttcactgcaacctccacctcccaggttgaaggaattcttctgcctcagccttctaagcaactgggattacaggcatgcact

SEQ ID NO: 8984 - DNA, 1151 bp, Homo sapiens
gaggtttttgtcttttcctcactactctattggcagggcctggatcagtgccagacatttagtaggcattcagtaagtaattgttgaataagtaagcaaatattttagtctttttgcttctcttctgtattacacacatttggagtttcttgggggaacaaggatgatatatttgtaggtggcaattatgttactatgtaaatctgttataatttttcccaaaagttcagaaaattgtttcattagtacaatggagtattaagcagcagttaaaactagtaattatgggctgggcacggtggctcactcctgtaatcccaacactttgggaggccgaggcgggcagatcacctgaggtagggagtttgagatcagccttaccaacatggagaaaccccatctctactaaaaatacaaaattagccaggcgaggtggtgcatgcccataatcccagctactccagaggctgaggagggaaaatcgcttgaaccggggaggcagaggttgcagtgagctgagactgcgccattgcactccatcctgggcaacaagagtgaaactctgtttcaaaacaaacaaacaaactggtaattatgataactatagaaatgaggagaaatgtttatggtaggtcaaaatcgtaggcacactgcctccctaaaatatgaatgaatatggacaaagactggaagataatgtgaaaatgaaatcattttaagacagtggaatttttggtggtttttctctccaaaattttctttaatactattgcttactcatcttttcagaaatgattttaaatatgtataaactttccatgcccttccctgcactatgtacagaaatagaatctttaatgtggatcacaaataacacaataatcagaaattagagatggtgttgaatctcagcattggtaatgagaataggctttatggatagatattccactttatcctgagatacacagctacagtatactttctgggaggagtatgcctataagcatccttggctggaacctgaattgggtttacaagcttacatttagataaaagcctttttatttgagatgaaacccatacaggcagggtagaaaggagtggcctgggtgagaatgtctaatgtttgggttttctcaaagcgtcat

SEQ ID NO: 8985 - DNA, 1126 bp, Homo sapiens
gcctttatcttccacattttctgctgtgttgtttcaacagccagtgacttttctgttcatactctattgatgatgaagtaaaaattgattttgatttgtttctgatttcttttccttagtaagtttgagttgaacctttagttctctctcctcatctcctcgctttctacaaaggcaattcctggtgttaagtgaaagctgttcctgttagagcctactgtttgccattaataagtgataagggaggttgtcagccagcattaatactctgtttatgaaattacagttactgatgcagtattttgtgaagttcttaagatataaacggcacaagtgatttgataagttatagctccagagacttccttacatagtatgccagtatttctttttcccctctcaacgggacacacataacattaaattaagtttgtcttggttgccatttactttaaacggatctggtgcctgtgctcagatatgtttatgagagtataattgacttctctgaaagcattgagattgagggagtagttatatcttaccttagtctcattgatgattcatggaattgaaataattaaaaagtacttattacatgcctgattgcttcatgaccctttgataaactaccaacactcatatcaaatgtctcctgatttaaaaaaaaaaattttttttatacatatatagacaagttctcactgtgtcaccgaggctggagtatggtggctttcacaggcatgatcatagctcactgcagcctcgccctcctgggctcaagggatcctcctgcctcagcttctcgagtagctgggaccacaggcacctgcgtctagctaaatgcctcttgattttaatggcatgtcttgtcttcatagcatattccacaaaaaactctaaagtctgatagaaatgatccttctctttcctgtagtttttttttgtttgttttgttttgagaaagggtctcactctggttgcccaggccggagtgcagtgatgcgatctcggctcactactacagcctctgcctcctgggttcaagtgatcctcccacctcctgagtacctgagactccaggtgtgcaccaccatgcccagctaatttttgtattttagtagag

SEQ ID NO: 8986 - DNA, 1026 bp, Homo sapiens
ctcactgcaacctccacctcccgggttcaagtgattctcctgcctcagcctccctaggtgctgggatcacaggcatgcgccaccacgcccagctaatttttgtattatagagatggggtttcaccatgttggccaggctggtcttgaactcctggcctcaagtgatccgcctgccttggcctctcaaagtgctggaattacaggtgtgagccactgcacccagctcagattcttctttataatgcctgcctcatgtagtccctcagcaggagctattgattctgaacccttcccatcccccgtggttcccttgctctcctgtcgttcacaccaccctgtctcacctgcatcacgcagtagccaccagactgatctgtttcactgcctgtgcagttcttctctacactgccggcagagtggtctctttgaaatgcagatctgattgttgcactcacctgcctaatcccctccagtaaaacccagacttcttctcctggcctacaagatcctgtttggcttggcctctgcctgctctccagcctgtttcttaccctcttcgcctagtttgctgcatgcctgccacatggcctgccttctgctgctgcttggataggagaggctcagtctctccttagggcctttgtgcttgcagttcttggaaatgcttggatgtcagaaggttacatggctgtcccgttggtgtcattcaggtctcactcagcgcagacaggccttccctcgctgcgcagttagtcacatgcctctcgttgctttcttaatattttactttaaactttttttctattacataccttatccgacatgattttgtttgtgtgttttacaggagaggggttatatctgtctcgttcatgactgagttctcagtgcctgaacagttcctgacatccagtagaccctttatatctatttgttgaataagtgactgcttttcccgttgtgcatgggccagtgccaggggtcgagttgtagtgaactgagagtacatggacagtgctgaatggg

SEQ ID NO: 8987 - DNA, 1109 bp, Homo sapiens
tttctaatagcatgtgcttactttgtatctctgtgtcacattttggtaattcttgcagtatttaaaatttttttattattgtgttggttacggtgatcagtggtctttgatgctgctgtcgtgattgttttggggtgccatgaaccgcatccgtgcgagacgttagacgtaattgataatgttggcatgtgctctgactgccccactgactggccattcccccatctctcttcctctcctcaggcctccctatttcatgagatacagtattgaaattaggtcaattaataaccctacaatggcttttaaatgttcaagtgaaaggaagagttacgtgtctctcactttaaatcaaaagctaggaatgattaagcttagtaaggaaggaatattgaaagccaagacaggctaaaaaccaggcatattgaaagccaagacaggctaaaaaccaggcgtcttgcagcagttaactaagttgtgaatgtaaaagaaaagttcctgaaggaaattaaaagtgctactccagtgaactccggaatgctaagaaagcaaaacaaccttattgctgatgtggagaaagtttcagtgatctggacagaagatcaaaccagccacaacattcccttaagcctaagcttgattcagtgcaagatcctgactctcttcaattttatgaaggctcagagaggtgaggaagctgcaggagaaaagtttgaagctagcagaggttggttcatgagttttaagtaaaaaagcaacataaaaatgcagggtgaagcagcaagtgctgatgcagaagctgtagcaagtaatccagaagatatagctaaggtggctagatgatgaaatgaaggtggctacactaaacaacagattttcagtggagatgaaagagtgttctgttggaagaagatgccatctaggactttcatagctagagaggagaagttagtgtctggcttcaacatttcagaggacaggctgactctcttgttaggggtgaatgcagctggtgactttaagttgaagccaatgctcattgactattctgaaaattctagagcccttaaaaattatgctcaatctactctgcctgtgctctataaatg

SEQ ID NO: 8988 - DNA, 1054 bp, Homo sapiens
gttcattttgccctcctgctttgtcatcctcagtacaggcttgcccgctggctccccatggtctcaggtggcctgtcgcagttccaggtgccacagggagacaccagaacatcccattgaggaggaggaactgtttctttccatgtctgtctctttattgatgaacatttgggtggcttccaccttttgtccattgtgaataatgctgctatgaacattggtgaacaataaattctttttaaaaatacagcatctaggggctaagctatgaggatgcagaggcataagaatgatacaatggactttggggactcgggtgaaagggcaggaggcaggtgagggataaaatactgcaaattgggtacagtgtatactgcttgggtgttgggtgcaccaaaatctcaaaaacctacggaaataaaaaattaaagtaccacatcaattaatgcgtagaccaaatcttattgcaattaaatttctacttttagcatcatttgctacaatgaagttctagtatttgaaatattttgagccactgacttgctgtttaatgggatttgatcccatagtaaagaagatataaaccaagtaagtcaaaaggatcttagaagcaattttattccatcctctattttgaagatgttctggattcagagtgattttccagggtcagagagctaagtcatgttaaataattcaaagtgtatgaaaatacacattactcacagattcaagtagagtaaccaggggtgtcttttgcctctagtcttactctaaccagtgtctaactatgcctgtgtagataaaataaaatagaaaactgggataattcaggtattcaagtaattgaagaaaatcagtcctgtttaaaatatctgggcaggccgggcatggtggctcatgcctgtaatcccagcactttgggaggccgaggcaggcagattacttgaggtcgggagttcaagaccagcctggccaacatggtgaaacctcgtctctactaaaaatacaaaaattagtcatgcatggcggcgcatgcctgtaatcccagcta

SEQ ID NO: 8989 - DNA, 1046 bp, Homo sapiens
cttctctcaaagactcagtgttgagactcacatgtctccccgaagggaaggaggaggcattcaagtagaaacacatttacgtcaacaggttttctgaacccccggtgaattttgagttcttagtgcaaccttcccctgcttcaccgttcctgtttcttctctgtgcctctgttttccggttggggaagtggaaaggatcctgactctggaggaaagtggagaagaaccagtgggcccgactgcatcaagagcctccccttagcagagaaccgcctggtcctcctcactcatacgtgctgtctgtgtgcagggtgctcatgggagatgttgaagaggtgtaagaaggcttcttctctgtgtaactggggagcaagacatgcacacaaagacaagtgcatcagggtacgttcagtgtgtaacttaaaataagcgacagacatagtgtggtgggcagaactgtgtgtatttcagacagcggctcaaggactgcttgtctctttgtaggaacactgtaggccagaatcagtctgttaaatgggagttgatgtcctgtgacacttttctagattaaatcgtcctaatactctacaataaatgcttttgtttttagttacttgagggaaaagatggtatttttcaaaaagtgagacagaaaaaggcatatgggacattgtatgtatgtcctggtatgtgtgcacaccaccacctgtgaagcagccttgctgctaaagtagaccccgagtttgataaaacgcctagatcttactgtgtatttataggaaatacgagggatggagaaacattgtaaatggctttttggggatagaatcagcaaattccaaactgcattataggataaacagaacagttttttcaacaaataaatcataaggggaaaaggtgagaaaaaagcctctatagataaaaagagattgaagagatgaatgaaccaatagtcatatatgattgattcagacaaaatgaagaaaatgtgaggcaatctgggaaatgtggacactgactgattatttgatggtattaatggt

SEQ ID NO: 8990 - DNA, 1050 bp, Homo sapiens
gtttgcctcttactgataatggactatatttagccttttcttgggttgggtccttatcaaagaatgagaagactaactaatagtaacaataatatgtgtttgctgtatgacaagagctagccaggtgatttgcagttttagtagggtaaggtacagcactatgaaccatttctataacaaaaaggaaatgtatcatgtcaaaagagtaaacaaagttttttagagaagaggaaaacaaatcttgaatttgttatttgtacaaatatacatagaaggctatcagggctgtctgagttttctttcatgtgtgagaatgaaggtaaaacttgctccaggtgcttagataagacttgaaggaaacacaggcatttatttggtttattgttagatcaatatagagttgtacggcaatcttttacattttccactctcaagacctagaaatgcatggtataatagcttagaaagacaactggtgtgaagtatgttcattattcttttttttctttgagatggatctcgctctgtggccgagggtggagtgcagtggcacaatctcggctcgctgcaacctctgcctcccgggttcaagcaattctcttgccttggcctcccaagtagctgagattacaggcatgcaccacgacgcccagctaattttttgtatttttagtagagatagggtttcaccatgttggccaggctggtctcgaactcctgacctcaggtgatccacccactttggcctcccaaagtgctgggatcacagatgtgagccatcacgccaggcctgttcattattcttgatgatctcacatttgacttacagtgcacttttatgtcatgtgatgaggtgatacgtttgaagatgaaagagggcatttaaaagtagctgaggacagaatcagaactttagtagttacagtgaggaagtcaaaatctctccccacaaaacaacaataataccagacaaaattgttaaaagcaactgtttcagggctctagaaatggaataaatgcaagaaagaaatggagaagcatttatccaag

SEQ ID NO: 8991 - DNA, 1006 bp, Homo sapiens
acatgcaacatttggaatatttgatctaataaatttctaaagacaattaggactttgccactgaagtgttattgttcattacttgaaaacgtgttacttttaaatgttttgtttatagcactatgcctttaaaagtaaggtgttatatttaaaaatccaaaaagtaaattactttctgttggattagaggaaatttccattaagggagattgaagtggttgcataaaccctcctacagataacaattgaaagatctgggtaaaatataagaaacaactaaaagcatccaaaagctgtccctagaacctgaggagaattgactcctgaaacactataatagaaggagcaagaattgcaagtttgtgacttttttgccagaggttatgcatcagtacccatggtggtttcagtagaaagaaatgatagtggaaagctgcagccttacagatgagaggtgccaaagaagagaagtcagggatggaagacaagctggaaagttcaggggggaatcctggaaacaagagaggactacagaaagggggaggccccacatctgagtgaaaactgcccaaattcctggttgactattaaactctaaatgtatagtgaaatcccagggagcccagcaagacaaaaacaaaaataaaaaccagccaaccaatgaaacaaagcaagcaggcagaggctagagaggaatctacccttaaaagacagacctatactagatgagatctgtgaggttcatgctttttaaaacagtatatccctaaactgtgagcagcgaagcagtggaaagctgaagccttactggcttggggttcagaggaaagaccctaatattgcccaagcagctgaaaacttaggaggaaatcacaagaacacaaaagtcacagagtgtgagcccctaaatctgagtatgatcagcctaaatccctggctgtctgccagattacacagaagcatgggagaccccagggagctaggctagacgttgtaagagctgagc

SEQ ID NO: 8992 - DNA, 1107 bp, Homo sapiens
caaaatttctgcgtatttttgttgtagaaattgaaaagctggttctagaatgtgtatggaatgcaaagtacttaaaactggcaaagccagcaaaaattgaggactgacttctacagcaccgcaaggctgtgatactggcaaaataatagacatgtacataaatgagaagatggaatccagaaagagatccacacgtaaatagacaattgatttgcagcaaaggtcctgaggcaattcaatggggaaaggaacatcttttcaacacatggtacagcagcaactaaatatctgtgtggaagaaaacaaacattaacccataccttatacactgcccagaaagctcaaaacggaccaaagtcctaaacgagttaaaactataaagcttctggaaaaattataggggaaaacgttcatgtgacttctgggtgtgaaaagattttctaagtaggatacaaaaagcacataccataaaataaatgaatgctaaattggactttatcaaaattgaaatgtgctttttcagaaaggaatgaagaaaatgtacaatatgggataaaatgtttacaatagataaatctgacaaaggattgtaaagaactcttacagttcagtaatagtaaccccattttttaaatgcacaaaagatttcaaagtatacttcacaaggtaagataaaacagtggccaggagctacataaaatacttcatattattaattatcagagaaaagcaatttccagccataatgaactaccgctctttaccctctacgtatggctaaaatttaagagactgatagctccaggtgttggcaaggatgtggcacaagcagaactttcatatcctctgttgagaatgtaaagtagtactagtttagagaacagtagtttgttttaaagttaaacaacagttactcaaggatacagtaattccatgcctagatatttatctgagaggaatgaaaacgcagaggcttctccatgagtgtttgtagcagcgtattcatgacggccaaaggctggaaacaatccgggggctcatcaggtgaatggatgaacaaactgtgctgtcccagtccaatgagagctctgagcaggaaaaaggagc

SEQ ID NO: 8993 - DNA, 1047 bp, Homo sapiens
actgcactccagcctggttgacagaaaaaaaccctgtctcaaaaaaaaaaaaaaaaggaaatttgttggtaacttactttatacctaaatacaagatcagtttttgaaaacattctatgtatgtttgaaaagattgtgtattctcttgttgtggggttccggatttcatgtgttcgtttgaatattggtaatgttagcatttttttctgtttaattatcaattactaagagaggtatgttaaaatatgcccctctgataagtaagcttgtcactgtcttatacttttgtcagtttttgtggtatttatttttaagacattttattaagtttatataggtctagaattttcttcctgatgattctctctctagtaattctattttgtctaatattatctattccagctttcttttgattattatatatctggtataactttctagtcttattctaggtgaatcttatgaagaacatataagtaggttttgttttataaatctaatctatatcttttaccttaggagtttaatatatttatacttactgtggctattgatatccataggtgtttttttctgccatcttaacttatgctttctatttgttctttttttgggggggcggtgtctctatttctggatgactctttagccttctttgtctccttttgaattcgttggtggtttttctctcattccatttttcttttcttttcttttctttttttgaaacggagtctcgctctgtcgcccaggctggagtgcagtggcgcaatctcggctcactgcaagctccgcctcccaggttcacgctattctcctgcctcagcctcccgagtagctgggactataggcgcccaccaccacgccccgctaattttttgtatttttagtagagacggggtttcaccatgttagccaggatggtctcgatctcctgaccttgtgatccgcccgcctcggcctcccaaagtgctgggattacaggcttgagccaccgcgcccggcctcattccatttttctaaactatgcattcgaaagataga

SEQ ID NO: 8994 - DNA, 1042 bp, Homo sapiens
catgggggtctgcattgtctccctgatacaataatttcctttcctttgaaccgattcccagtagtgggattgctggatcatgtggtagttttatttgtagttttttgaaggaacctccatgctgttctccatagtggctgcactagttcacattcactagttacaacagtgtagaagagttcgcttttctctgcatcctctccagcatttgttattttttgtctttttgatagtagccagcccaactggggaatatgatacctcattgtggtttcgatttgcgtttccctgatgattagggatgttgaattttttttttatatgttcgttggctatttgtatgttttcttttgagaaatgtctgttcagatcgtttggcgatttttttaatcggattttttttttttttttttggccgttgagatatttcagttctttgtatattctgggtattaatccccccatcagatgagtagtttacaaatattttgtcttattcttttcactctgtagattgtttcctttgctgtgcagaagctttgaacgttcttgtacctgtcttgttgtggtgtgccttcctttctcttgggttcccttgggagctggttataggagtagacacacacaaacacacacacatatatgtaaaatctaatcaactaccaaatggttttctcgagtaactgtaccattttccactgtccccagccatgagtgtaagttctggttaccctacatcttcaccagcacttggaattatcagcctttataattttgctgtaaaattattttctgctgtagaaaaaccaattaaagcaggagtgtcatcagggaaagactcttctcttcaggccttgtatcctacattttcactgcatgagaagcgcccaccagtgaaacacagggtagcaggaaacctggggtgggcagctaactaacccagcttcctaatcactgagactacttcgttacaatgtcttgccagacacagtcagcatgagtcatcctcacaactatatctaggagtctttccatcaaatgt

SEQ ID NO: 8995 - DNA, 1033 bp, Homo sapiens
cttcatgataaaaatcctcaaaaaatgggtataaaagaaacatacctcaacacaataaaagccatatatgacagacctatcacttgtatcagactgaacggagaaaaactgaaagcctttcctttaagatctggaacaagacaaggatcatcactttcaccactgttattcagtatagtactggaagtcctaactagagcagtcaggcaagagaaagaaataaaggcatccagattggaaaggaagaaatcaaattatccttgtttgcaaatgatatgctcttctatgtggaaaaacctacacttcacaaaataactattagaactgataaaatcagtgaagttgcaggatacaaaatcaacatacagaaaataggtagcatttctatatgtcaacagtgaacaatctgaaaaagaaatcaagaaagtaatcccatttacaagagctacaaataagatacctaggaataaacttaaccaaagaagtgaaatatctctatattaaaaactgtaaaacattgatgcaagaaatctaaatagacacacaaaaaatggaaagatattccatattcatggattggaagaatcaatattgttaaaatgtccataccacccaaagcaatctacagattcaatgcaatccctatcaaaataccaatgacattcttcacagaaatagaaaaaaaaaatcctaaaatgtatatggaaccacagaagacccagaatagccaaagccatcctgagcacaaagaacaaaattagagaaatcacattatctgacttcaaattatactacagaactatagtaaccaaaacagcatggtgctggcataaaaacaaacacctacaccaatggaagagaatagataatctagcaataaatccatacatctacagtgaactaattttcaacaaaggtgccaagaacatacactggggaaaggacaatctcttcaataaatgatgctgggaaaactggatatctatatgcagaggaattaaactagactgttgtctctcactatatacaaaaa

SEQ ID NO: 8996 - DNA, 1033 bp, Homo sapiens
ggaacccatgaaagctaaacccctggggaagggtagtaaagatgaggacagtagtgcaccatgcttgaaagggctgggctgggctgggcctggctgcgatcccgtgacacactgcactccgcatcctgctacctgcacacgcagattacttctagcgaatttgaaattcagatagtgaatttgggatacaaagttttacaggtatttagagcacatacttgggtggtgagagttcatataatcatataatgaggctactgctgttggaaggtgatgtcctatagtgacaataactaagataaaggggaccgagagggctggggtggaggaagttaacggattccctacggtggtcacggtagacctggttgagaagatgacatttacccaaagactttgagggaggtgagggccatgcaggtatctggaggaagagccttccaggcagagggaagacccaggaccaggccctcaggccttcatattctgtgaatatatgctctgagctgagaaatcttaaaagaaccctaagcactgattacttttttcaacttttattttggaaaaatctcaaacgtgcaaaagtagacgaagtagtttacaattccctcgaaccccttactaagctgcagttgttatcaacttatggccagtctcgtttcgtctgtgtccccactgtttcccttcaccagtgttattttgaggcaatccgtacatcataacatttcacccacaaatatgtcgatatgtatttcaaaaatgtaggcagtatatttaaacaaaacctcgataccattatcacaccttggccagacgcggtggctcatgcctgtaataccagcactttgggaggccaaggggagcggataacttgagatcaggagttcaaggccagcctggccaacatgataaaacctcatctctactaaaaatacaaaaattagctgggcgtgatggcactcacctgtaatcccagctactcaagaggctaaggcaagagagtcgcttgaacctgggaggcggagattgcagt

SEQ ID NO: 8997 - DNA, 1048 bp, Homo sapiens
gcaggatccggctgcaccgcattgcgtctcccaggcctagacaagctaggcgcgccctctgtaggccaagcgcgggcacggtgcgggctgccggctgggggacctgggcacacgggagactcaggcgtccggggaccgcctgtttacctaatccggggcggacggcggtgtggccccaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtaggtcagtctggggcactgaggtgggaggtcactggagggatcgagccttcaagaggaatccggtaatgtaggagaagaatctgagcagggaaccgtctgtttcctggagccccatgttaggaccccagtaaataccttttgaagaaataaatgcactttggcgaccccagccctgccctaagagaccatgatcacccttgcccccacgcagagccccatttccggctcccctctacctaagggagactggatggcatatgagaacagaaagaaaatccttaaggaaacatagcctcccaccaattaattcttctattcactcgttaacagatgagttattgagggccagccagggtgttaggtggatacagggcccaacaaaatagacaagattcctgccctattagagacaaaaacacacatacagaaataattggttgttacaaattgtgatgagttctgcagagaaaagaacaagattttatgatagctcgcagcagcgagtcttgtctactggtcaggcaggacttctgtgaggaaatgacaaactgaaacctgagggaagaaatgaaccagcctccaggaaaggg

SEQ ID NO: 8998 - DNA, 1117 bp, Homo sapiens
aggggggcaccccccaggagccccctaaccccaggtgagccccccaccaaggtgagcctcaagaaccacccagcaaccccggatgagctcctgacccagagtgtgccccactgaccccaggcaacctccccatccctctcaggctccaccacccaccagtctgttccctccccagccccacccttctccctgcccccatctcccgtgagttcctccttgggcaaatcccaggctgtccttttccctcaggatgaagcgggccagttccctcaacttcctcaacaagagcgtggaagagccgacccaggtaggggcaggcgggtgtctgggcactgggcagctgcggccggggctgcatgcgtgctgccaagcttccctccagcatgcctcttcatccagcaacagttcctggctctgtctcaggcctactttgggctggacaacggggagacacgaggggaacccagcctctcctgggggtggacgtgtaaacggccagtgctaacaccgtcactgtggagatggacgggagtgtcagggcaccagggtgtggccttgggtcagaactgccattgcctctgcccagctcagggattccggctgcctctgccaggtcagaccccttcaggccagggaggcacagactggcagcagcacagggctgagccacctgccccctctgcccacagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccct

SEQ ID NO: 8999 - DNA, 1044 bp, Homo sapiens
ccagggcccacctgactgccatatatccagtgatcttatttcagcacattgacctctcgtggctttggacactgctctcttctctctccttgaaaagtggaccatcccccgctcctcagtctcctgcagcactcgattctctattgtcagtgtctatttgctggtctgtccagtgctgcctcccatcaccctgtgtttggtgcttccccactgccctggactctcctccttactcttgtgcatggctgcggccactctgtggtttgcttctgccttgtgttctgtgattcctgcatctaacagccgtggctgtggcttccctcctctgtccatgtctacactggcactttgtgtctgtattaatcctgatcttcatgatcttctctagtaaactaaatggtgaggtttgtgttttctagatgaggaaacttgcttggagaggtgttaagtaacttgccaccggtctcacgggaagggcaaagccagttttggagggctcttggcttttgagcacaccctttcccaccctcaagcagcctctgcagaactcagatgtccagcgctggcctcactgtctctccccaaaccagcgcctctatccccatttttaatatttttatttattttaagacatggggtctcactctgtcacccagactgcagtgcagtggtgtgatcatagctcattgtaacctcaacctcctgggcttaagggatcctcctgcttcagtctcctaagtcactgggactatagacacacaccaccatgccccagctgcatccccatctttgtgacacaatccttgtcagcctgaccagaaaactcttccctcccccatccagtcagtctcgagtcccctctattctctccccatcatctttctgaaatctgtcccctcataataatagcagtgatgaggataatagcagctcttgccaattaagcacttgttatgagacaagcctgtgttcattctcttcatgctcacaatcagcccttctaggaggtactgtttatagaaatgaggaaactgaggctcagag

SEQ ID NO: 9000 - DNA, 1092 bp, Homo sapiens
gctattgtgtgttaatcttgaattctgcaactttgctgactttattagctctaaaagtttgtgtatgtgtgtacgtgtctgtgtgtgtgtgtgtgtgtgtctctgtgtgtatgcatgtattccttaggattttctatatatgtatatattatgtcatctgtgactatgaatagttttacctctttttcagtttggttaacttttgtttctttttcttgccattttttttcccaccccagtgcagaagttcatttcttgccaaattgctctagctagaacttctagtacaatgttgaggagatgaaacggtgaaaccacgtatccttctcttgttcctgatctttgggggaaggctttaggtctttcgccattaagtatgatgttatttgtggatttttcataaatgccctttatcaggtgaaggaagtttccacctattccttgtttattcagcatttttatcttgaacgagtgttggactttgtcacatgctttttatcttgaacgagtgttggactttgtcacatgctttttatcttgaaagcgtgttggattttgtcacttgctttttgttcataaattgaggtgatcacttggtgtttcctcttcattctattaatgtggtgtattacattgattgattttctttttctttttttgagacgttcttgctctgtttcccaggctggagtgcagtggagcgatcttggctcacggcaacctctgcgtcctgggttcaagttattctcatgcctcagcctccggagtagctgggattacaggcatgcgccatcatgcctggctaatttttgtattttttagtagagatgccgtttcaccatgttcgccaggctggtcttgaaatcctgacctcaagtgatctgcccgcctcggtctcccaaagtgctgatattacaggcatgagccaccacacccagcctttcttttttttttttttttttgagatggagtctcgctctgtcacccaggttggagtgagtggcgcgatcttggctcatggcaacctctacctcccaggttcaagtgattctcctgcctcagcttcctgactagctgggattacaggtgtgc

SEQ ID NO: 9001 - DNA, 1088 bp, Homo sapiens
taggcatttatagctataaatttccctctaagcactgctcttactgcatcctgcaagttttgctatgttgtattttcgtttgcatttatctcaaagtatttcctaatttcccttttgatgtctttgactcattaatttttaagaatatgttgtttaatttttacgtatctgtgaattttccagcttttcttctgttgttgatttccagtttcattccactgtgatcagaaaagaccctttatatgatttcagtcttttaaaatttattgagactgtttcgtgacctaacataggatctgtcctggagaatatttcacaagcacttgaggttatatattcttttgtttataggtagagtattctatatatgtctgttgtggttttggatctaaagtgagtctcttatagacagtttatagttgaatcactttttgtttaattaattaattttgagacagggtcttgctctgtcacctaggctggagtgcaatggcacaattacggcttactgtagcctctactgcctaggctcaatcaatccttccacttcagcctcctgagtagctgggactaaaggcgcacgccaccatgtgtgcctaatttttaaattttttgtgtagacatgaggtcttgccatgttacctgggttggtctcaagctcctgggctaaagtaatctgccctccttgacctcccaaagtgctgggattacaggcgtgagccactgtaatcccagttgaatcattttttttttttttgagacggagtttcgctcttgttgcccaggctggagtgcgatggtgccatcttggctcactgaaacctccaccccccgagtttaagcgattctcttacctcagcctcccaagtagctgggattacaggcatgcgccaccatgcctggctaattttgtatttttagtggagatggggtttccccatgttggttaggctggtctcgaactcccaacctcaggtgatccgcccgcctcagccttctaaagtgctgggattggcggggcgcagtggctcatgcctgtaatcccagcactttgggaggctgaggcgggtggatcatgaggtcaggag

SEQ ID NO: 9002 - DNA, 1062 bp, Homo sapiens
gaccagcctggacaacatggtgaaaccctgtctgtactaaaaatacaaaaatcagccgggcgtggtggcaggcgcctgtaatcccagctactcgggaggctgaggcaggagaatggcttgaaaccagaaggcggaggttgcagtgagccgaaatcacgccatcgcacttcagcctgggtgacagagcgagactccatctcaaaaaaaaaaagaaatgttaaatatcttcacataatagaatgtttaatggctagtttattcaccattgagtcccagcatctagtccagtacctgacataaagtaggtacttgataaatatttgtggggaagtgagtagatgctaaaattgaacatgtagaaagtattacgggagcgccaacgagaacaatggattctgtctggaggcaccaggaggtagtaatgtgtgaactgggcattgaaggatgaatgaagtctatcaagaagtcaaggatgagaggatggggaaggcatttcaggtagaagaaacagcacaagcagaaggacagagacttagaagttcatagcatatttggaaagaataaatgtgaagttagaaagttgagacccatataaaataactaccacataaaatagtagttaagactatggctttggattcagacagaactagctctaccacttaatagctgtatgacttttacttaacttctctaagacacagcttcctcatttgagaaatgaggctaataatggtgcctacttcataaggttgttgaaagccaggtgtagtggcacacacctgtagtcctagctgcttgggaggctaaggtgggaagactgcttaagcccaggagtttgaggctgcagcgagccatgatcgcaccactgcactccagcctaggtgacagagcaagacccagtcgcttaaaaataataagactgttgagagggttaaatgaaacgatgcatgcagtttctgatgtggtccctggcatatactgcatgctcagtatccaggagttcttgggtaccccctttctggccggagcacagcaatgggaagggtgataggaaacaag

SEQ ID NO: 9003 - DNA, 1051 bp, Homo sapiens
gagttaagggtggctttagaggctcagtccccgcgacgccgcgctggttggtgctcctgcgccggaggagttctgcgtctcggggtggtgactgggtccagaatggcttcggattcggggaaccaggggaccctctgcacggtgagggtcgaggcttcgtgtggagcctcgccgggcagagagcctcggcccctgggatgatcgttaccttgggaagaggagaaggagtgggcacttgggttggggcctggggccatgggatgaaactagggtgcgagggtagcaggggccctgcgtgagtgttggggggtgactcccatggtcctggaatggtcatgagagatcatgaagaaggtgcttgaagaggggttaagtggggcttgttcccagacccttgcggtggtcatagggtaggtggtgaaacaaagtcataccaaggcacttccccagcgatcatcggttggtccctgccgcccttgcagttggagttcgcggtgcagatgacctgtcagagctgtgtggacgcggtgcgcaaatccctgcaaggggtggcaggtaagaacagggtaaacttttctgcagacagtccagaagcctctgggagggaccaggcgaatctattaggcgaaccctactcccattttacagatgcagaaagtgaaccccagagagtgaaaggcatgttctcagagttacacacagacctggaggcagagcctagagtacagctgtccagcttgccctgacagattctaactgcctgtcttgttgtcctgaacctcaggtgccccagagactgaggagctaggctgagggagttcctgggaaaacaggcagtttttgcttgggaaacaacataatcttgacaaagcaaacagcagctcaggccctataccatcctgggtagctttctataccactgggtgtggtggctcatgcctgtaatcccagcactttgggaggccgaggtgggtggatcaccaggtcaggagatcgagaccatcctggctaacacagttaaatcctgtctctactaaaaaatacaaaaaat

SEQ ID NO: 9004 - DNA, 1048 bp, Homo sapiens
cacctcccgggttcaagcaattcttgtgcctcagcctctcaggtagctaggattatagacacgcgccagcactcccggctaattttttgtatttttagtagagatggggtttcaccatgttgatcaggctggtcttgaactcctgacctcaagtgatacacccacctcggcctcccaaaatgctgggattacaggtgtgagccactgcgctgggactaatttttatattttttgagacatggggtctccctgggttgcccaggtttgtctcaaactcctgggctcaagtgatcctcctgccttggcctcccaaagtgctgggattataggcattgagtcactgcgtctggccaaacttcttactatgtgtcttacattgtgttcaacacttgttattgctcaaaatggccttatccttcatacatacctgccaagagaaatttttattagagacaaggcctccctgtgttgctcaggctggagtgcagtggtgcgatcacagctcactgcagccttagcctcctgggctcaagtgatcctcccatctcagcctccagagtagctgggactacaggcacacaccaccacacctggttaatttttaaaattcttttcatgtagatgggggtctatgtttctcaggctggtcttgaactcctgagctcaagtgatcctcctgcctcagcctcccaaagtgctaggattacagggatgagccaccacacccatccccaaatttacaattaaaaaactcttaaacctaaaaacaaaaatgtggtaaagccagttattttataggtaagatgatactcatatgtgtaaagaatctagctgggtgtggtgggtcatgcctgtaatcctagcacattgggaggctgattctggaggatcacttgaggctaggagtttgagagcagccagggcaacaaattgacccccgtctctacaaagtaaaaattaaaaaattatctgggggtggttgggcatggtggttcatgcctgtaatcctagcattttgggaggctgagctgggcagaccacgaggtca

SEQ ID NO: 9005 - DNA, 1048 bp, Homo sapiens; identical to SEQ ID NO: 9004

SEQ ID NO: 9006 - DNA, 1048 bp, Homo sapiens; identical to SEQ ID NO: 9004

SEQ ID NO: 9007 - DNA, 1048 bp, Homo sapiens; identical to SEQ ID NO: 9004

SEQ ID NO: 9008 - DNA, 1034 bp, Homo sapiens
gtacactcacgcggcaacccccaggcgcgggtttggacagggcttccagaatgggaggagccctgacttccaattgtacaaagttttcctgggagcccgccggtcccagccccacccgggccagagaccgccttacagactaggcctctctgccgccggcgccgctcgcgcgcgttctcctctcttcagccctccctcttcttcccaaccccctctcccgccacgggctgtggcggttggtcgtccctttcccaccccctcagctaacgagcgggctctaggccctctgggattggctgtgcctgagcacatcttccctcagcgtttctgattggtcgctggacgcgcgggatgcgagtccccattggctaggccagggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtaacgcggaggcgcgctcgggggcgggggcgcgctcggggcactctgcctgttagccacgccccttacccgggggtcggtcactgcgcggttgggaggggtggggaagtgcgcgggagcaggtcggaggtgttgggggcgcgttgggtagagccaccctcctcccctgcggtccaggaaccgtccaccaagtag

SEQ ID NO: 9009 - DNA, 1663 bp, Homo sapiens
ttttcttcgagaaaaatgtgtcaccataatttaagcctgactagggacccagttgactttttcatagcttgagtttttatcccttaagctctttatcttttacattggcaagatttggtgggacagccgttgtgtatgtggccagtctctgctccacttgggaacagatcagagttaactttgccctgtcattttggaagatgcagcctgggagtatctgatgccctactcctggtgggttcatacctgctcataccctgtgtgagaagtttcagggataggaaataaatgtgggtgcaagtgcttatttatcccaccaagatatttcatttgctgtcctggaaaggcacatgtttggggccattcctagtcctttaagtgggggaaatataaagggtcatagtgtccactactaggaacaagtccttgttctgcattaatactgcattctattttcctcaactcaggttatacaagtccacgactatccggaatcgggctttcctgctgggtgctctgaggcaggctgtatggtgcatggatttttgcttttgtttagagtaaaagagtggtgggggagggtctcagattgggtacttgtccagcaaaagggtggggtatatgagtctcatttgtgagagttttgtgtttaattgacttaccaagtttcttttgtggttgttaggtagagtggctactaggttgagagtctagagtcaaacatctgaagggacagtctccctggaactcaggcttcttgctggctttcaggtggtagagaaagtcaaaaatttgcctgaaatttgcttgggacccaacaccaagtgacgatgcgggtgaagtgcataactgcacatgaatttttagaactcctggctgactccttgtgagagttagacggagttttgtgcatcttgttcctttgtaaacatttgattagcaaaaatgcattgacttactccgggagtggtggtcaactatttgcagttacattgttgtgtaacagagctcctgacatacttcgatgtaagagactgggaaagatttgaacatcatatcctccactgatgtctttttatctgtttgtgatgacggaaagtgagggttgaaagttgggagtgtagtagaagcgactggctctctaaagagcgtactcatttcttatgctgggaatggtcatttgattgagtctccttgtgttggctgacagggctttgaaaagcacagaagcttggtgttgcaccagacaaccagctctgttttatttcacaggaaaaaaaaacaacatagttgcttggttactccaggagcttagataggatttgtagaacagaaatctcaatagcaacagtggattgtaaccactccacagcttcctcctattgggtgttcaaagatgaacagcttccggaaacatgtacagacttgtggggagatctgaaagacaaaagaggaaaatatcttctcttcatttttgtgagtgactgtttcttcttcctatacagagctctgtagtttcaagtttaagattttttctttttctttttttttttttttagacggagtctggctctgtcgcccaggctggagtgcactggcgccatctcggctcactgcaagctccgcctcctgggttcacgccattctcctgcctcagcctccc

SEQ ID NO: 9010 - DNA, 1663 bp, Homo sapiens; identical to SEQ ID NO: 9009

SEQ ID NO: 9011 - DNA, 1663 bp, Homo sapiens; identical to SEQ ID NO: 9009

SEQ ID NO: 9012 - DNA, 1663 bp, Homo sapiens; identical to SEQ ID NO: 9009

SEQ ID NO: 9013 - DNA, 1663 bp, Homo sapiens; identical to SEQ ID NO: 9009

SEQ ID NO: 9014 - DNA, 1663 bp, Homo sapiens; identical to SEQ ID NO: 9009

SEQ ID NO: 9015 - DNA, 1663 bp, Homo sapiens; identical to SEQ ID NO: 9009

SEQ ID NO: 9016 - DNA, 1663 bp, Homo sapiens; identical to SEQ ID NO: 9009

SEQ ID NO: 9017 - DNA, 1049 bp, Homo sapiens
ctgcctgtgctttgtgagtgtggacatgagaatttctttccattccttcattccctgaagttttctccttctgtgtagtagataagtatagctttgagaccggcatcctgtcttctcctaccacagcttattcaggtcataatgagagctgcaggggtaacctggttagcagagcctgttagctgcagtaattgcagcttcataccttataggtgagaaaccagatctttctggtaagcagtctgctctgtgaacagaagcccaaggtgtaaggtatacctctgtcccttaaagaggaaacagtggaggatgcagtgtggtctgggacagggggattgggcatgaactcagccagtgggcttagtttctattcccatacctcattggcttacacagggtccatcttctctgcttctaagcctaaatttttagtcatattacacagtcctgccttataccttgacttctcagggatagattatgtagcaaaggggcattggaagagctgtgattctggtcctgactctaacacactttgagtggggcaagccatataaaaactcttgagcatgtatgtccacctgttaaatggaggtaatgattctttgccctgcctacctcacaggattgtgaggcccaaatgaggtcctcctgtacctaagagtgctttgaaaacttgggaagtactgtgaaaaagcggagagatcatattggaatgttgtgaactgcttgcttgttgcagtctatctctcttgccttaattggacatgggctgagagatgggtcataccaaaacgtgagtggtcatttccagtgtttgagagttaggcctcaaaagtgagctaggcctcaaaggtgtttggtgagtttgggttgagaacactgaagaactgagtgatctaggaacgctttctgcattttgttctgctggtttgtacttacaggagatgtgaagatttttatcctgtgttgcagttcatctttgctccttcttctctcaccaggaagttgggtgagatggcagggtttgtaaaggggagaatgggaag

SEQ ID NO: 9018 - DNA, 1076 bp, Homo sapiens
gagaccactgtgatcacaccctccctgtccccattggcatctccccaatgcccacctggagtcctcccctcaattgtctcattcaccaactgtcttcttctctcgactaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctggttgtcattgtcttgattgcattcagtgtcaaaggagccaatttgacatccaggaagacatgatagctaaagggaaggc

SEQ ID NO: 9019 - DNA, 2511 bp, Homo sapiens
accattttcactgacttttctccagttcaggaataacctgtgttccaatgggatggttctggggtttggcctcttaggaagtggggaatgggctgctgtggtatttacaggctagtagatcctttaggcagtaggctggaatgagtgctggggctgggacccagaaaggaaccagtagtggagtgggggtaatggcgttgcctgatactgccctatggttggaataaggaagggcagagaaaacttgaagcaggtatggggcattctggccatagagctcgtattttgcctgttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaagaaaagaaaaaaaaaagccagctgtggtggcatgcacctgtagttctagccacttgggaggctgaagcaagaggattgcttgaactcaggagttggaggttatagtgaactatgatcatgcgactgcacttcagcctgtatgacacagcaagaccctgtctcaaataaacaaacaaacaaatgccttgctcagctagctgaggcaggctttgggctgaccttgagggattt

SEQ ID NO: 9020 - DNA, 2802 bp, Homo sapiens
gcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaattatggagtatttccgtgactccttgctatatttcaaacctgtgttctgacagtgtagtttgccgattctttttctgggtactacctttgttaagagtcattgctgcctttggcgtccatttcccttaaattgggcttttttagagctgagagtctgatcattatttcccctagtaatgggtgccctgtgtcatgggcattgctgtgcgttagtaaagaaaagtgacacaggtctctcaggtctagtttgctttcttttttttaattggcaagttgagaattattttgtcaacaacttaattgagagcaaaggttgctcttgtggagggtttatggtgtgatacctaatttttggactgtttcccacacttcagcccagtcagaagaggtggtgtctgcttgtagcagttaggtttaaggagaggacagtgtggtcttgattcaggacaaattatccttatataaaactctgggtgtctgaaccctaggtcccctgacactaacctatgcttagttatttttaccttattttatgtaatattggcgtttctcatttcttaatactgttctggtagaattatagatgtatattgatgagcagtagttattagggtggtcttttttcctttccgtttctcagtgttgggtatcttctctattgcttgcccacttaaaatctcttttagatattttttaaaatttaacttctttttctggcgttagaaccaacagatccttagattaaggcgtttattaatgatctttatgtctggaatgtgcatagttgcttgcttagttgcacttgttttctctggttttgttaggtgccaaagtggccccctgggcaaatgccagagacaagctagcactttaaggcacttaagtgcataattgcatatctactctcttttaataacctgcaacctaaacttccagctgtgtagacctccttgatattttgttccttccacccccgtttccctattgtgttttctggtctcccagaatctaacattaattttgcaaggaaaattgtgtgtttaccactttctctaatgttagaggatccatttgttgactctcccttgcttttgaccatttactcctttgacaggtgtatgtttaggtgcatcataaccaattgcattgggaagtttttgcaggatttggatctcttctgaattttgcttaccagtaagctggtagatcatgttaggtagaaattgcttctgtagagacttactaaaacttagttttaacttttctagaaaagtttctgcttttattacattttcagaagtaatacttttcatttccagaatgcaaattttaattttcaggaaaaatattaggtgtatgttcttagttacgctctcagatatgtagttgcaggagaagtactttaattctgcttaaactgagcagtttggtccactgactagtataactagttattctccactttcctcaggcacgttttcttccatgttttttacagtattctaaaatttcaggcatttgagaacaatctgtcctgtttttgccctgtttgcctttgaccctagtagagggtcactaaaattaactgtcagattgtaaagaatcctcgttaaagcaatgatcagaaccagcagtttaaagggcccagttaagggagaagtctgtccttcaacttgttgtgcccctctgtctccccagttcatgagggtttttccagagatgtaccttgagatttgcttgccacattcagctgtggattgagtctagatcattctttaatagtggtaatcattggagtcttttattcggttcttttaaattttttgaggagggtggagaactggcctttacttatattcctttgcttaatgaaaatccatcttgctagtaaggattggaggtgtcagaaaagacttgggcactgtttcttactttgacttcttttgactttgagccgctgtttggagatgatttttacctgtttggagatgattggagcaagagtagtttatttcttaagcatttaaactgttgttatagctgaaatatttcttcatctaagtggtcttttcctgaaatcaggtcattatactgaat

SEQ ID NO: 9021 - DNA, 2802 bp, Homo sapiens; identical to SEQ ID NO: 9020

SEQ ID NO: 9022 - DNA, 2802 bp, Homo sapiens; identical to SEQ ID NO: 9020

SEQ ID NO: 9023 - DNA, 2802 bp, Homo sapiens; identical to SEQ ID NO: 9020

SEQ ID NO: 9024 - DNA, 1047 bp, Homo sapiens
aattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttagggtatgtgtgctttgcgagacttcttgcttgggcttgtttgggggttcatttgtaccttgaaggggagggtataaagttttaagacactcagctttgggtgaacgtcactgtagttattttgtttattgtaagtaggacttgtaggtgccagaggaaggaggttatacagaagcccaggcaggcagccttattccaatgaagacttttcccactggtccacctttgttataaaaccaactacttttagtttacagatgtaggtcttctcttctagagaaacagtcaccaccttcccttaagactaccattccaatcacccagtcagtgtatctagcttaacttaatttccagggaaaaggaggggtttaggggaagaggaagtcagttttcgctcttcgtgccatgtgaaaaaatgaagctgtggctccaagagtactttgctaactaggccagtgacatgtgttgatgcctttcaccatctatttgtttagctctgccaaaatccaaagaatgcctgaatggtcccactagcacctcattacttgggtttacagcctttaaatcataggcatggagaaatgacccaacatatgaggctttagataccttgttgaatgatgggg

SEQ ID NO: 9025 - DNA, 1047 bp, Homo sapiens; identical to SEQ ID NO: 9024

SEQ ID NO: 9026 - DNA, 2171 bp, Homo sapiens
tgggaggatcacttgaacccagaaagtcaaggctgcagtgagctaagatcaggccactgcactacagcctgggtgtctcaaaaaagaatttgtctcaaaaactttttgccaggcgcggtggctcacacctgtaatcccagcactttgggaggctgaggcaggtggagcatctgagatcaggagttcgagaccagcctggccaacttggtgaaaccccatctctactgaaaaatataagttagccgggcatggtggcaggcgccttaattgtggctatttgggaggcagaggcaggagaatccttggaacccgggaggtggaggttgcagtaagctgagatggagccattgcactcaagcctgggggacaagggcaagacttctctcaaaaaaaaaattttttttttaatttcttgattctattagagcaagtcatttttgctttctgctttgagatcctgatctccctgtaacagacaatgtaagagtagttttttcatgactcagaatctggcctggtttaatgctatattcatactagatgcttttgcattttctcttttttaaaccatttattgcttttgtttttgtttttgttttttgagacagagtctctctgttgcccagactggagtgcagtggcatgatctggctcaccgcagcctctgcctcccgtgttcaagtgattctcctgcctcagcctcctgcgtagctgggattacaggcgcctgccaccacacctggctaatttttgtatttttagtagagatggagtttcaccatggccaagctggtctcaaactcctggactcaagtgatccgcctgcctcctaaattgctggaattacaggcatgagccatcacacccagccttaagctatttattgacttgttgagaggaaaaactctatcaagaacaatggcagcctaggcaacatagtaggatcccatttctaagacaattttaaagttagctctttgtggtgatacgcagctgaagttccagctactaagaggctgaagcgggaggatagtttgagcccaagagtttcaagctgtggtgagctgattgtgtcactgtactccagcctaggtgacagagcaagacgaattatttttaagaggtgatttgaaaagattgactataactcactgattttcaacatcaatgtattatgaagttgtttttatgcttccaatcaagtgtatctttgagtggaagccacatagttggctctgtgtaattgacaaggttatgctgccactccttaggaataataaagtactttttcttgctttttgttttttagacatccagctctgtcacccaagctgcagtgtggtggcatgattgtagctcactgtaactttgaactcctgagctcaagggatcctcccgccttggcctcccagagtttttgcagggactatatgtgagccactgcgtctggtcaaaatgtagtttttcaagagtaatgctttaataaactgatttttttcccccatagcatttcactgttcattctgtctagtaaatgtctagctggctttgtatttcgctaggtactccctgattacctgcaattaggttaccatgtggcgaatacaaagatgaatagggcattgtgcctgtcctcactgtgcctccacaagctgctgcttgtctgggccttgggtgtacaaataactggtatgtccttggaagtcagttcggggtgggaatggtcatactattttgtattgatgacatgtgcctcggcctgattctgcatgggtcaaaggacctgtgagggcagttttcagggtgatcttggaatttaacttgatgttaaccctgttaactttgcctttaaagttttccagccaggcgtggtggctcaacgcctgtaatcccagcactttgggaggccaaggcaggcagatcacctgaggtcgggagttcaagaccagcctgtcaaacatggggaaaccccatctctactaaaaacacaaaaaattagccgggcatggtggtgggcacctgtaatcccatctgcttgggaggctgaggcagaagaattgcttgaagctgggaggaggaggttgcagtgagctgagattgcgccattgaactccagcctgggcaacgagagtgaaagtctgtcttaataataataggccaggcgcggtggc

SEQ ID NO: 9027 - DNA, 2171 bp, Homo sapiens; identical to SEQ ID NO: 9026

SEQ ID NO: 9028 - DNA, 2171 bp, Homo sapiens; identical to SEQ ID NO: 9026

SEQ ID NO: 9029 - DNA, 2171 bp, Homo sapiens; identical to SEQ ID NO: 9026

SEQ ID NO: 9030 - DNA, 1050 bp, Homo sapiens
ttacacatgatctcattctgaggtaaaggaaattcccaggatgatggtgatgggaagtcccaggactccctttctgcagtggatttggagaacagtagtccaggttgtagcaagagaaagtacttttttttttttttttgaggcggagtcttgctctgtcacccaggttggagtgcagtggcactatctcggctcactgcatgctccacctcccgggttcacgccattctcctgcctcaccatccagagtaactgggactacaggcgcccgccaccacacctggctaatttttttgtatttttagtagagacagggtttcaccgtgttagccaggatggtctcgatctcctgacctcttgatccgcctgcctcggcctcccaaagtgctgggattacaggcgtgagccaccatgccccgccaacaggaggatttttttagtccgtttgaggtgctgtaacaaaagaccgtaagactggatggcttatacacaacagaattttatttctcacagtttcggaggctgggaaagctgagatcaaggccgtggcagacgtggtgtctggattctgtcttgagtttgcaaggcaggaagggtgagggatttctctggagtttcttttatataagggcacaaatcccattgatgagggctctgttctatggcataatcacctctcaaaagtgtacctaatactttcactatggggattcagattttaacatgaattttggggggacataaacactcaaaactatagcaagattcaactgtgtgtgatatttacctagttatgatcgtagcagctctgaatattaaaataataatctgatgaagtggcgatgggtgggtaatacgtataagagcaaaactcatagaaatgaaaaaattttttttttttggtcacccaggctggagcgcagtggtgcagtctcggctcactgcaacctctgcctcccgggttcacaccattctcctgcctcagcctcccaagtagctgggactacaggcaccctccaccacgcccggctaatttttttgtatttttag

SEQ ID NO: 9031 - DNA, 1050 bp, Homo sapiens; identical to SEQ ID NO: 9030

SEQ ID NO: 9032 - DNA, 1050 bp, Homo sapiens; identical to SEQ ID NO: 9030

SEQ ID NO: 9033 - DNA, 1050 bp, Homo sapiens; identical to SEQ ID NO: 9030

SEQ ID NO: 9034 - DNA, 1098 bp, Homo sapiens
cgggcgtggtggctcacacctgtaatcccagcactttgggaggctgaggcgggcggatcatgaggtcaggaaatcgagaccatcctggctaacatggtgaaaccctgtctctactaaaaatacaaaaaaaaaaattagctgggcgtggtggcgggcgcctgtagtcccagctattcgggaggctgagacaggagaatggcgtgaacccgggaggcagagcttgcagcgagtcgagatagtgccactgcagtccggcctgggtgacagagtgagactccatctcaaaaaaaaaattttttttatttttgagacaaggtctcactttgtcctctaggctggagtgctgtggtgcaaacatgtctgactgcaatcttgatctcccaggctgaagctatcctctcgcctcagcctcctgggtagctgggactacaggcacgcaccaccacgcccagctcagttttgattaattttgttttttttttttttttagaggcaaggttttcccattttgcccagcctagtcttgaactcctgcgcttaagtgatcatcctgcctcagcctaccaaagtggtgggattacaggtgtgagccactgtgcccagcctacagataatttctttttattttttgagatggagtctccctacgtcgcccaggctggagtccagtggcgccatttcggctcactacaacgtccgcctcccaggttcaagtgattcttctccctcagcctcctgagtagctaggattacaggcgcataccaccacgcccagctaaattttttttttgagatggagttttgctcttgttgcccaggctggagtgcagtggcatgatctcggctcactgcaacctctgcctcctaggttcaagcgattctcctgcctcagcatcctcagtagctgggattacaggcatgcaccaccacgcctggctaatttttgtatttttagtagggatggtgtttcaccatgttggccctgctggtttcgaactcctgacttcaggtgatccacccgctttggcctcccaaagtgttgagattacaggcatgagccactgcactcggcacttcttttctttttttttttttgag

SEQ ID NO: 9035 - DNA, 1098 bp, Homo sapiens; identical to SEQ ID NO: 9034

SEQ ID NO: 9036 - DNA, 1098 bp, Homo sapiens; identical to SEQ ID NO: 9034

SEQ ID NO: 9037 - DNA, 1098 bp, Homo sapiens; identical to SEQ ID NO: 9034

SEQ ID NO: 9038 - DNA, 2011 bp, Homo sapiens
ttgtgccaatgacatagaaatcaagatacttttatttatttatttatttttttgagacagagtctcactctgttgcccaggctggagtgcattggcgtgatcttggctcactgtaacctctgcctcctgggttcaagcgattcttgtgcctcagcctccctagtagctgggattacaggtgcacaccaccatgcccggctaattttttgtatttttagtagagatggggtttcaccatgttgcccaggctggtctcaaactcttgagctcgggcaatccacctgcctcagcctcccaaaatgctaggattacaggcgtgagtcacgcacctggtatatgttaaacttcctatgttaaattggttgaaacctagcacagaaccaccagagattttgctgaggccagcaaaacctgcaaattttttttcttggctctgcatagtgccttgcagatcataagaaaatcccagcatctttgccttattttcccttttgtaaaacagagacagtcttgcttccttggggaatactgacgctaacatgagccttatgtacatcaccactggttggaatgtgtgcatggatggacaggttaacttctgtagattgtcagaccattcccctaagaaataagggaaaatttttgcttcacctgtcaagattaagtataaaatatgtgaggtaaatgctttattattgtaggtaaaatttcacatgtagtcagaatttacacatcaacatttccatataaagtacaataaagcttaagtagagttgagtccatcattaaatgtgttctatggggatctaaacaaagataaataagatgtccataatctagaagacatactttactgcaaaatgtcactgctaatcattaatatgtgatttgcttttctgctcaaagtactatgtatgaatattttagccaaagcctaatcctagcagaatattagcaccttgggaagacagacctcttttaatagctcataagtgaatttaattttttatttttttgagatggagtctcgctctgtcacccaggctggagtgcagtggcgtgatctcggctcagtgcaacctctgcctccttggttcacgccattctcctgcctcagcctcccgagtagctgggactacaggcgcccgccaccacatccagctaattttttgtattttagtcttgatctcctgacctcgtgattcgtgtgccttggcctcccaaagtgctgggattacaggcatgagccactgtgcctggcctaattgttttttaaaaattaaaaaaggagaaacactggagaggggtggtaactaggcaaaaatgtgtgtgtatatgtgtgtgtgtgtgtgtgtgtgtgtgtatatatgttttctttttgttttgtaaatatgagccagaaaactatgaagtcaaatttagttaatgtgataggtccttggagagaatctggctcagcctttttctgatgcagggcttactcctagcactactaatctgagtctgttagcctttaaactggtttaagagcagctctggttagagaaaagtagcctcaccaccagctgtagcaaatttagcagtgtctcaagaatctggctaacttcctaccacctattactgaagccacagcactaacctaaatccttttttgttgttttggagacagggcctcctgttgcccagaatggagtgcagtggcatgatcacagctcactgcagcctcaacctcctgggctcaagagtctcccacttcagcctcttgagtagctgagattacaggcatgcaccaccatgcccagctgtttttttttttttttttttttgagatgggagtacagtggtgccatctcggctccctgcaacctctgcctcctgggatcaagcaattctcctgcctcagcctcccaagtgctgggactacaggcactcgccaccacgcctggctaatttttgtatttttagtagggacagggtttcgccatgttggccaggctagtctcaaactcct

SEQ ID NO: 9039 - DNA, 1024 bp, Homo sapiens
aagcaagataagaggggttccactgcacaggaaaaaggggatgccagcataatccttacctagggctgctcagaggctgagaatataaggaacagagtgaaaggctacagagactagtttcaggaggaaagaaaagtcaacttagaagaattaagaaagaaaacatagttggtcacaaactccttttgtttactgaaacatgaagcaatggaaacatcccggcaaaggggaccgcgcggagcaagttctcatatatgaccgcagcccgagggttcagtccgcaattatcctacctgaaagagagcacaacacaagaggcttacacaatgcctggagagcagcctggctccgcgtacaagcgccctgggtcctgtcctgtattccggggggaaaaaaaagaacaaaacaaaaccaagtcagactggatctaactcatatcccatgtaattacctaggagtctatcaatagctatatataggaatccacttatggctatatatataggacaagatgcaatctagctgaagaatgtgttggtgataaatacatctttcttatccatcttttaggcaagataacccctgtgacagaaggctactgttgctgtaacaaagggcatacatacattttcaagaactgcaatttaattttggagtccaggaaaagcagaagatgctgagatgtcatatatggcgaattgcactattctaaatgtgttttgttttaatctttcacagtaaacaagctttcagaaatgatggtcacaaggggtaggatatcaaggagcagccagtcattcacccaattccaacacacctacatgtcacactgtcacagagtgagagccacagttccagtagttcccctaattgaccaaatctcccttgccaaatcaaaagaaatcattcctagaattctctaatccttctattgatgatgggaactccagacaccaatggctgggggaaaaaaaaagttaactcacaccaagttcctctacttattacagacaaagggccaaat

SEQ ID NO: 9040 - DNA, 1072 bp, Homo sapiens
cattatgttgaatttcactgactcttttcttatgtcactctcctagctatttattttgtttagacacaatactctgaacaaacctaaatctgacattttagaagcaagaatacaatttttggggggaaattagagttactaatttaactgggtcatagagatgtattattactgtgatttctaaagaagattatgttttctttgaattgtgctcttttcagattttgagatttttaataattcactggaagtgtgacatagatgtatcaaagggagcattgctagaagggcagctagtgatttccatagaaggattaaattctaagcaccaggcaaatgctcttcattgtgtaacaactagtaagtagagaaagaaaaaatattttctatctcttttgtcatggtttatgtcgtagcttatttaaaaatttcaattagaatcttttatcatgttattccaggattgttccataattataaaatgaaatgattatgtaataagtgtctggtggtagatttacaaatgtatcatacaggaaaggtgagtagttgaatgactcttaccatagattatttattttactggtttaagttaaaattgctcagaaacaatcttatttttctcttgattttaatctactttgtcacagctaaattatattacattgagctttacctactttttttttcccaagtctaaattttggcagtagcaaaaaaaaaaaaaaaaaaggaaaaatgatgaatggtgcatactgtgattagtttgaaaatatctcttccatttggctttcatgcttttatcatttttgcctgttgtctttgagggaaacctgatgcagtgagtggctctgaagcatgaattttcttaaacttgaagtgttagctttttgtgtgtgtgtgtgtggtgtgtgtgtgtgtaggtttattgaagggtactttggattgaagttgccccttcaggcttagagaagtcacttgggcaccaagttgagattggatagtgaactaggctttacaagacatttgcttacctgaacaggaatgacctgtcttgtctttgtgtattaat

SEQ ID NO: 9041 - DNA, 1003 bp, Homo sapiens
gctacgtgtctagggtgatggttggtctgtgtgtggttgtaatagtctaatccaataaactctggccagggtagcaaggttgatttaattcaaagcaaaggactttagccacagtagtttttggcaagaaactcgattctgcattttgagcctgatgaacttctttagcccacctagaatagggggcatttctcttctctttattgtctctgagctttaagtaattatggttataattatttatttatttatttagagatggagtctcactctgtcgcccaggctggagtggcgcaatctgggctcactgcaacctctgcctcctgggttcaagcaattctgcctcagcctcctgagtagctgagattacaggcagctgccaccatgcctggctaattttgtgtgtgtgtgtatttttaatagagatggaggtttcaccatattggccaggctggtctcaaactcctgacctcaagtgatagtgatccacctgcctctgcctcccaaagggctgggattacaaacgtgagctaccgcacccagcctatgtttatatattttttttgggtaggaaacgtggtgatacatgcttgataaaaaacattacagaaacatatattgtggagagtgagactttctacacatctcacgcctttgagatgattattaacattgagtatatattctagattttcctttttccccctacttgccaaggataatctgtcttctagatttttctatgcctacgttcttagttatcaatatccattttttagaactagaactatactatacatatgactgtgctatgtaccagtactttgtgggcagcatttcatgttagcataagggatctatttcattttttttgtaaaaaaatgtacacttatttagttttagtttttgtcagttacacacacatatggttttggctgggtgtagtggctcatgcctgtaacaccagcactttgggagtctgaggtgggcagatcacatgagg

SEQ ID NO: 9042 - DNA, 1048 bp, Homo sapiens
aaagagtgtttggaaggtaaatttcttgagaccttacatctctgaaaacatctccacgtatacctaattgatagtttggccatataggattctaagccagaattcatttttccttcagaattttgatgacattgcagcattattttctaacttaaggtgttgctattgaaaaatctaaaaatctttctgattactctgtatgtgacctgttttttcttttttcttcccctctgtgtaagctttcatttttatttttttgagatggagtttcactctgtcacccagggtggagtgtagtggcatgatctcgacttactgcaacctccgcctcccgggttcaagtgattctcctgcctcagcctcctgagtagctgggattacaggcgttacaccaccatgcctggctaatttttgtatttttcatagagatagggtttcatcatgttggctcggctggtctcgaactcctgacctcaagcgatccacccacctcagcctcccaaagtgctgcgattacaagcatgagccaccgttcccggcctctctgtaagcttttagaatcttctctttatccttgtattaattacagtaaataagggtaggtgctataacaaaccctaaaatctcagtggcttggccaggcgcggtggctcacgcctataatgctagcactttgggagggtgaggccagcggattgcctgagctcaggagtttgagaccagcctgggcgacacggtgaaaccccatctctactaaaatacaaaaaattagccaggtgtggcagtatgcggctgtagtcctagctactccagaggctgaggcaggagaattgcttgaacctgggaggcggaggttgcagtgagccaagatcacaccactgcattccagcctgggtgacagagtgagactccgtctccaaaaaaaaatatatatatatcagtggcttaacacataaaatgtttagttttcttgtatttcacagtcagatgaatgtgtgtgtatgcaggcaagcaggcaagtattttgttttatgctatctctgtcttg

SEQ ID NO: 9043 - DNA, 1051 bp, Homo sapiens
ggtatatacccaaaggattataaatcatgctgctataaagacacacgcacatgtatgtttactgcggcactattcacaatagcaaagacttggaaccaacccaaatgtccaacaatgatagactggattaagaaaatgtggcacatataccatggaatactatgcagccataaaaaatgatgagttcatgtcgtttgtagggacatggatgaagctggaaaccatcattctcagcatacttttacaaggacaaaaaaccaaacaccgcatgttctcactcataggtgggaattgaacaatgagaacacatggacacaggaaggggaacatcacacaccagggcctgttgtggggtggggggagggggagggatagcattaggagatatacctaatgttaaatggcgagttactgggtgcaacacaccaacatggcacatgtatacatatgtaacaaacctgcacgttgtgcacatgtaccctaaaactttcataaaaaaaaaagaaactgtggtattggcaaaagaataggtaaatagtgtttttttgctcaattttgagtatttttaaatactcaaatacttataattccctgccttatgagattatttttgctctgaaaagctagctgtcaagaaaaattcaaggaaaaaaatagtcttttatattcacttatttatgatttctggtgctcttcatttcttcctttatagctgggtttccatcttcagcctgaagaaaatcctttagcaaatcttctagcagcagattatttcatcttctatcttaaaatgcctttaccttaacctcatttttaaaggatattgcactggaatatctggcttgatagttttctccttttcaacattttgaaagatgttgtcaattgtcttctgcgctttattgtttttatttatttattttattttatttttttggagacagagtctcactctctcacccaggccggagtgcagtggcgtgatcttggctcactgcaacctctgcctcctgggttcaagtgattcttgtgcttcagcctcctgagtagc

SEQ ID NO: 9044 - DNA, 1024 bp, Homo sapiens
gtatgtcaggctggggtactgggtctctaacacccaacacccaactgtaaaaggctttgtcatctctctcttcctctttctaataatttttttttttttttttgggagggagtcttgctctgtggcccaggctggagtgtagtggcgcgatctcagctcactgcaagctccgcctcccaggttcatgccattctcctgcctcagcctcctgagtagctgggactacaggcactcgccaccatgcctggctaattttttatatttttagtagagatgggctgtgttagccagatggtctcgatcttctgacctcatgatccgcctgcctcggcttcctaaagtgctgggattacaggcgtgagccgccgcacccagcttcctctctctaataattctatgagtagatcttaaaagggtcctctaaccccttttaaggggttagttgtgttgtattaattatcctctctgacctgacattagtcactttatcctaactctgggataggtgtcggtccttctgctgtattcctttagcacctcatttatctaaatttcacattgtcatataaattagtctgtctcatctactgaactgtgaactcttctaattctgagattgtcttatttatttttataagcccaggtacataataagccacattaatattttatgagtgagtaaatgcatatattgagtagccatacataagcattgcttgtcaggctccataaaaaataatgatggattatatattaccccattcagatagctacctgtatacacagaaaatgaacatttttggagaggcagcattggatagtagaatgtggactttggagttagtcagctctaggtttgaatcccagtgctgccacttaactagctgtgtatgaccttggacaaattaattagcttattgagtctcattatcctcttctataaaatggagttatttcttacttgcatagaaactgcttgacatgtagcaagtagtcagtaaatatcatcattattcattgtagt

SEQ ID NO: 9045 - DNA, 1037 bp, Homo sapiens
cttgtcatttgtaagtgccaggtgtcagcttctctataagaaaagcagaagtaaaacttttttttatgttgaaaactgctattttaagttatttatgtatttgaatctattctaaatgacctgaagacatgtgccttcttctcttcaggccttattttacacagaccctgctagttccaatcccatttaggcatgagaagagaagactatgaatttaaaactttacttgaattcttggctagagagatagtatgaatacaaaggaattcagtgtacattattttctgtgcatcagcattttgcataggtttggaaatcatctctctgcccatctccatcttcttcagactccaagaaagtaaatctggccaggcgcagtggctcatgcctataatcccagcactttgggaggctgaagttgatggatcacttgaggttaagagtttgagaccagcctggccaacatggcaaaaccctgtctctgctaaaaatacaaaaattagctgggcatggtagcacatgcctgtaatcccagctacttgggaggccaaagcatgagaatcacttgaacccaggaggtggaggttgcagtgagccgagatcacgccactgcactccagcgacagagcaagactctgtctcaaaaaaaataaataaataaaaaatgtaaaaaatccatggaggaggtggtaaacaatatggaacacacagagcccttctgtcttgccttcctgtgccatttaactaccacagaatccaaagtgaaaatgaattatgtcaagaaaagacctaacatatgcttaagtccaattaatttattttttctttttttgagacagggtctcagtctgttcaacccagatgccatcatagctcactgcagccttggtctcctgggctcaagtcattttcccacctcagcctctcgagtagctagtagctaggaccacagaaatatgctaccatacgctgctaattttttttttttttgagacggagtctcgctctttcgcccaggctggagtgcagatctcacc

SEQ ID NO: 9046 - DNA, 1048 bp, Homo sapiens
tgacagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatccttttgatgaaaagttccatccaattatctttgaaatgggtttttatatcccagttttaggaaagcctttagtatgtgaattctgcatctacaaatatatatgatttgtataaaaacatataatctaatgtgaaagccaagcttgaaaattttgccagggaactgaaaactgtaaaatgtgacacatgccatgcgtttttcatacaatccaatatgactgaagcatgaaatgaatggtgcacgaggaagagatgggactagaaaagtagtctggagttgaatatggtagatcttgagtgccatactaaggattgtgaattttattctctgtatagtaagaaaccattgaatgttttgggagaagtctttagcagcattatagagtacggatgggagacagaagttagtaatactaagtaaataagtaagtgaactggattaaaaataatgagtgcttgacggctgggtgcagtggcttacacctgtaatcccagcactttggcaggccgaggtgggcggatcacttgaggtcaggggtttgagaccagcctggccaatatggtgaaaccctgtctactaaaaatacaaaaattaggccgggcgtggtggctcacacctgtaatcccagcactttgggaggctgaggcggatggatcacaaggtcaggacttggagaccagcctggccaacatggtgaaaccccatcttagtaaatacaaaaattagctgggcatggtggcaggcgcctgtaatcccagctactcaggaggctgaggcaggataatcacttgaacctgggaggcaaaggttgcagtgagccgagatcgcagccactgcactc

SEQ ID NO: 9047 - DNA, 1035 bp, Homo sapiens
tagctcactgcaacctcgaacttctggggttaagcagtcctcctacctcagcctctcctgagtagctgggactacaagcatgcaccatcatgcctggctaatttttttatttttattttttgtagagacagggtctcacccccgagtttccaaatttaatgaaaactataaacctgcagattcatgatcaatgaaccctaagtgtaagaaatatgaagaaaattataccaagtcacatcataatcaaagtatttgaagccagtaataaaaaaatcttaaaagcagctggagataagacacattatgtatagaggaacaaaataattatggcagatttctcactggaaacagtgttagctagaagaaagtggggtaacatctttataaagtactgagagaaaaaaggcaaaatgaagaatttttcagacatagaaaaggtgaaagaatttatcaccagaagacctgtattataagaaatgttaacagaaatcttttaggtagaagaaaaatgttgccagacggaattctgaatctacccaaaaaaggaagagcactggaagtggtggctatgcgggtagatacaaaatacttttgtccttttaaaaacacaaaatatccttcttgagtatataaaccaaaaagcatccaagacaggtttcaatcagtttagaagtttattttgccaaggttaaggatgttcctgggagacaggtctgtgcctttctctaaagatggttttgaggtcttcagtatttaaaggggaaacgcaggctggagaggaaagatggaggggatgatcacattattgaatccatatgttacaagagaaaaggagcaagtaggggaacagtcaattatgtatttgtcttgtgctcagtaaagtggccctttatataatagaaggtgaacattacagtagctacctgtagaggtatttaaccctttatctgtagctatctgcttaggaacaaaaggagagacagcttcttgcatgactcagctttcagctaaattatttccttttggcatagtgat

SEQ ID NO: 9048 - DNA, 1016 bp, Homo sapiens
agtcccagctactcgggaggctgaggcaggagaatggcgtgaacccgggaagcgaagcttgcagtgagccaagattgcgccactgcagtccgcagtccggcctgggcgacagagcgagactccgtctcaaaaaaaaaaaaaaaaaaaaaagaaatctgtgtgttgtctgttactttatgtactctaagagaatatggtctgtttagaataacaaatcagtcttgagattccaattaaaacatgtaactgaggccaggcgtggtgactcacatctgtaaccacatgattttgggaggctgaggcaggtggatcgcatgatagcagtttgagaccagccctggcaacacagtgaaatcccacctctacaaagaaaattttttaaaaggccaggtgcagtggctcatgcctgtaatcccagcactttgggagaccaaggcgggcagatcacaaggtcgggagttcgagatcagcctggccaatatggtgaaaccccgtctctactaaaaatacaaaaattagctgggccacgcctgtaatcccagctactcgggaggctgaggcagaagaattgcttgaacccagcaggcggaggttgcaagtaggccaagatcatgaaaccgcattccagcctgggcaacagagtgagactccatctcaaaaaaaaaattttttttaaatcagccaggcatgacgtgcatgccatggtcccagctactcaagaggctgagatgggaggatcgcttgagcatgggaggtcgaggctgcagtgagccacgatcgcatcagtgcaagccagcctggggcacagagcaagaccctgtctcaaaacaaaaaacatgtaactgagtagttagtttagacgtgtgattttacatagaaattttactaagtttaaaatcagtactggcagatgacaaacacatgacaagatgctcaacatcattatcattaggaaaattcaaattgaaaccatgagataccaccatatacctttttaaatggctaaaatttaaaag

SEQ ID NO: 9049 - DNA, 1029 bp, Homo sapiens
gttctgaggtaacaatgatttatttctgtatttctttttctttttggagacagggtctcactccgttgcccaggctagagtgcagtggtgtgatcattcctctttgtagcctcaaccgcctggctcaagtggtcctcccatctcagcatgtagctgggactacaggcatgcatgtgccaccatgcctggctaatttttaattttttctgtaaaggcaggctatccctgttcgggctgctcaggctggtctggttttttttgctcagtctggtcttgaactcccagactcaagcgatccaccttggcttcccaaagtgctgggagtacaggtgtgagccactatgcctggtgtgcttgtcaatcttgatgaaattgagagtttttagcactttcacctagcaaaaaaaaataaaaaataagaaattgagagcttttctaaaagatgttattatcgcatgttcaatcctgttaacctgtcttacatataattatgaaatagctaaatcatttatctgttacaaggaactgcggccactgaaactctggcaatagtcccacctttccttggtttacctttgaaagtgcctccccaaattcagcagcgattaccagattatcttttttaaattaattaatttatttatttatttattttgagatggagttttgctcttgttgccgaggctggagtgctatgacgcaatctgggctcaccgcaacctccctctcctgggttcaagcgattctcctgcttcagcctctgagtagctgggattacaggcatgcaccaccatgcccggctaattttgtatttttggtagagacggggtttcaccatgttagccaggctggtttcaaactcccgacctcaggcaggcgatctgcctgcctcggcttcccaaagtgctgggattacagttgtgagccagcacacccggccttttttttttttttttttttttttaggcggggtcttgctctgttgcccaggccggagtgcaatggcactaccactgcagcatcagcctc

SEQ ID NO: 9050 - DNA, 1040 bp, Homo sapiens
ataataataacactcttactccacggtgtgtaggctgagtactttctctcttttgaggctactttagtgttttcttttcttttttttttttttttgagatggaatttcgctcttgtcgcccaggttggagtgtagtggtgcgatattggctcactgaaacctctgcctcccaggttcaggcaattctcctgcctcagcctccttagtagctgggattacaggcgtgtgccaccacgcctggctaatttttgtatttttagtagagatggggttttaccatattggccaggctggtctggaactcctgacctcgggtgatccacttgccttggcctcccagaatgctgagattacaggcatgagccacgactttccgcctactttaacattttcttgctaacgtctgtctgcttaacatcctgaattagatagctataaatatttgatagccagtgtttgattatgtttcaaacaaagatggcacattctttcttttcatgaactttgaacttattgcacttgatctgttaaaacggcagtattgtgcagtttgtgtgtatgtcaaggcttttatttatgtatgtcactcatatccttgttttctgttttaaattttaggttcttggggtttttctctgtctgtgagtacttggtaaaaagttaaaccctaaagataaaaggcagcaaatagtgaccaaacgaatgtttttggcaaatacattggtgaaggcctccttcaggtaggtagagaggaggagggaagagggtggcctttcaggtggtaaagacagcataagctttatactactactataaggcctattctgtggatctctgatagatgagcagactgaagtaggtggtgtcttttgaggggcactgctgataacgttgggtagaaattttaaacaactttgaaagccaagtatggacatagccattagaagttttgttttttttgttttttggatatggagtctcactgcgatgtccaggctagagtgcaatggcacgatctcggctcactgtaacctacgctt

SEQ ID NO: 9051 - DNA, 1054 bp, Homo sapiens
cgcatacctataatctcaactactcaggaggctgaggcaggagaatcacttgaacctggaaggcagaggttgcagtgagccaagatagtgccattgcacgccagcctgggcaaaaagagtgaaactccatctcaaaaaaaacaacaaaaaaaaaatgagatagaccttctcattaataacaagagctagcggggcactgaggcatgtgcctgtagacccagctacttgggaagctgaggcaggagaattgcttgagcccaggagttcaagtccaatgtgagaaacagccagagcctgtctctaaaaataaataaataattaatgaacaaaaaatagcaaattagatggaaggaaagaacgcctttatttgtggctgacggagcttggacttctctttcctttcctttttgcctgagttaactgtggacaaggtggactagtggccaggcacagtaattcacacctgtattccccacactttgggaggccaagttgggaggattgcttgaggctaggagtttgagactaacttgagaacgcagtgtgatcctgtctctattaaaaatttttttaaattgaaaccaaaaacaaaagaaaaacaagactttagtgatggctgtgatgacagcatgatcatggtaaactgtgactttttcaatctatagaaattgtatccacgtgaaacctttgaattgtcttcactttggagagtatctagtgtatcacaaatgtttagttttcagtctacagatcataggttatgtgcaagcttttgcttagacagtagattaggaaaattagtatgttgtagtacagtgttttgcacagtttttaactgacctgtagcaggaaatacattttatattactacgtattactattatatgcatggatatatgtaactaacatgtttcaggaagtggtatttactcatagtgtgttttctgatttactcaaatttcatttaaaaaatacacactgttgtgacctaaattgatttttgtgactcatgctttaagatgatctggaaaagtggttctcaacatgtggtctg

SEQ ID NO: 9052 - DNA, 1040 bp, Homo sapiens
cagtactatctcctggccacttgtgggtccttgttagactaccgactcttctgttcatctaaaacgtgaaagtcacagatatcccaggtagaggaaagttcccaaatctctgttttattcatccccttactgtttctgttttaaaccctggccatctgcctgttgccatgtattccttagtacctagcacagtccctggaatatagtaggtgctcagtaaatccgttgaataatgaaaatgctcccctactcgtcacaagacagaacactcaggggacctcagaaaacctacctgaatatgtaatagtctgtaatttgacctcttttattaaagagcctccaggacagtaattccctgtttaaagcttccctcttgatgagacattcttacagattgtggtccacagatgacctgcatcagaattgcttgtgatattgttaaaaatatagactctcagagaggattgtaggaagatggcagagtagcaagcaccaggaacttttctccttacctagacaataattgcacgggcagaatctgtctgatacaactattttggagttcaggagtctattgaaggcttgcaaatttcagggacagcttggacaataaagtacagttaatttcagtcagtttcaggccttagcacagtaacagctgctccattcttccctgccaaccaagcccatgacaagcagctgtgcatatgtttccccgaaaaacttgcacacagcttataggagccagggtgagcaaagaggaacctttcctccaaataatgggatccatgctgtggtcactgagtgctgcttctgatcacagaagtacagacaaagaggcaggtggggccaggcacagtgggtcatgcctgtaatcttagcactctgggaggctgaggcaggtggattgcttgagtccaggagtttgagatcagcctgggcaacatagcaagaccctgtctctacaaaaaatacaaaaattagctgggtgtggtggcatgcaccaatagtcccagctacgtggggggcaattccttgag

SEQ ID NO: 9053 - DNA, 1023 bp, Homo sapiens
ttgctgtcgccaggctggaatgcagtggcgcgatctcggctcactgcaatctccacctcctgggttcaagcgattccctgcctcagcctcccaagtagctgggattatgcccggctaattttttgtattttagtagagatggggtttcaccatgttggccaggatggtctcgatctcctgacctcgtgatctgctcgcctcggcctcccaaagtgctgagataacaggcgtgagccactgcgcccgaccaagggaacacttcttaagtctttctgtgaggccagcattaccctgataccaaagcgagacaaagacagtacaagaaaactacaaatcaatatcctttttgaacaatgatgtaaaactcctcaacaaaatacttgcatactaaattcagcagcatattaaaaggattatacaccatgaccaagtgggatttattcctggaatagatgatttgacatgtgaaaatcaatcaatataaatttcattaacagtgaaggaggaaaaaagttacatgatcatctcaattgacacagagaaggtatttgacaaaattcaacaccttttcatgataaaaacacttaacaaactagaaataaaaggaaactaccttaacataataaaagctttatatgaaaaaccctcagtaaatatcatactcagtggtgaaacaccaaaagcatttaagatcaggaacagcgtaaaggcgcctgcttttactgcctctattcaatgtagcactggaagtcctaacagagcaattaggcaaaaaaaggaaagaaaaggcatacaaattgtaaaggaagaagtaaagtcacctctgttggcagatgatatgacttttttatttgttattagtatttttctttggttccttctatcatgtgcatctttacacttagttttgctgtttgtcaaatatttcaaatatacataaaattacggagaatatcattaacaaaatgaacacccatctataaacccaaaatgaagatccacttgtgtacaacttagtaagaa

SEQ ID NO: 9054 - DNA, 1288 bp, Homo sapiens
gtggcaggcgcctctactcccaactacttgggaggctgaggcagaagaactgcttgaacccaggagcgggaggttgcggtaagctgagaccatgtcgttgtattccagcctgggcaacagagtgagaccccatctcaatacatacatacatacatacgtatttattgagacaggggtctcgctgtgttgaagaagctggtctctagccccaggcctcaagctgtcctcctgtcttggcctcccaaattgctgagattataggcgtaatctcactgcacctgtccaccattttagatactaatcttgccaaagttatttttaaaatttaatctcatttctttgagtgtttctacttatattttctaatcttttatgataaattatttcagcaattttagcattcatgactttaatccttttgtttcttttctagtattagtttaaaatgttccatttctgttctctttgtgtatctcagttcttgcttcaatgacagcaaataaaaatcctggtcttgtggaacagctgagtagtacatcctttcccaaactgggggagggtggttgctttacccccagctgtcccagcagctgctcagccagattcccagatctagcatctttcaaaacatctcaaccttggtaactcagataaaagtctttctgaggcgtaggtcctcctgtgtcaatggcacatctgaattactaacaacgtgttcttttcttaagttatgttatctagtcagttgatcaggagttatatatactgtggaccctgaaaacattatccctgcattattgagtaaatcatgtaaatactgcgagaaggtaaaaaacaccacaaaagcaatgtggcataacactttgtgcattacataggcacccaatacatattggtgattgcctagtaaaaaatagagggctctcagtgctgcttacctgcctctaataaaaatgtaggtggtattaaaccacaagctagaccatcaggaaggaggtacaaggatagatccacaacctgctcttggcctttatctcagcaagctacctggcttctgtactcctactttgattcacctgctgttgcagcagggttttaggaggatcctatttgtgtatctaagattcaacattcatgaaggagcagaaatacttggatttgcctcttagctcttggagctggagagtggatgacttcctgcaaggcacgatttttggattggcttctcaattattacaggaatcctcaacttttagaattgccagcctattcatctgatcttgaaagt

SEQ ID NO: 9055 - DNA, 1033 bp, Homo sapiens
gtatttggttgagaatatggactctgtagcaaaactgtcctgagctacactaattactagctgtgtaatcttggacaagttacttaaatgtgaagtgcttagaacagtgtctggcatatacagttgacccttgaacaatgcaacggctagaggcaccaacccccagcaagtcagaaatctacatataaattggaattcctcagaaacttaactaccaataacctactgtttactggatgccttatggataatgtaaacagttgattaacatattttatgttatacatattatatactgtattcttacaataaagtaagataaaaattccttaaatcataaaagaacatttgtttactattaagattgaaaatatatttactatcttttcatcttcatgatgagtaggctaaggaggaagaggtgggattgcttttgctgtctcaggagtggcagggatggaagaaaattcatgtataagtgaacccatgtagttcaaaccagtgttgttcaaggatcaactgtgctgagttctcagtaaatgttagctattactttgaccatcacaattttatctaagtgctctggtccatacccagagtatgagcgcacctcattttattgcactttgcagatagtgtatttttttttttttttaacaaattgaaggtttctggcaaaccttcattgagcaagtctgtagccgccatttttccaatagcatatgctcacttcatgtctgtcacattttaaaaccttttcattatgccgggcgcaatggctcatgcctgtaatcccagcactttgggaggccgaggcgggcggatctcgaggtcaggagatcgagaccacggtgaaatcccatctctactaaaaacacaaaaaattagctgggcgcagtggcgggcgcctgtagtcccagctatttgggaggctgagtcaggagaatggcgtgaacccggaaggcggaggttgcagtgagctgagatcccgccactgcactccagcctgggtgacagagtgagactctgtctc

SEQ ID NO: 9056 - DNA, 1046 bp, Homo sapiens
aaaataacaaggtatttaggatattacataaagtgagtttataaagcagcagtagggtttgagaggattgactccaattttgaaagacgttctaccatgggtaaaatgatatcaaacagcattgcatgctacagagaagtctctttgtgaaaggaagtatcaatccatgttgcaaactttattgttgtcttattttaagaaatgtcagctgggcatggtggctcacgtctgtaatcctagcactttgggaggctgaggcgggtggatcacaaggtcaggagattgagaccatcctggctaacatggtgaaaccccgtctctactaaaaatacaaaaaaaaaactagccaggcatggtggcaggcacctgtagtcccagctactcaggaggctgaggcaggagaatggcgtgaacccaggaggcggagcttgcagtgagccgagatcgcgccactacgctccagcctgggcgacagagcgagacttcgtctcaaaaaaaaaaaagaaaagaaattgtcgacccgagaaacagcgagatcttgtatcggcaaaaattaaaggattagccagccattgtggcacgtgcctgtagtcccagctactccggaggctaaggtggaaggattaccagagtccaggagtttgtggctgtggtgagctgtgattgcaccagtgcactccagcctgggcaacagagcaagaccctgtccgtccgccgccaaaaaaaaaaaaaaagaaaaacggtttacacttcagcgaaagaaaaagaagttgctatatccaccccaaccttcagcaaccaccaccactctgatcagtcagcagccctcaacaatgaggcaagttcctccacaggccaagattatgactcactgaaggctcagatgattgttagcatttttagcaataaagtatttttaaataaaagtatgtaccttgttttttagatacagtgctgttgtacacttaatagcctacagtataatgtaaatatatgcactgtgaaaccaaaaagttttgtatgacttgcttactggaatagttgct

SEQ ID NO: 9057 - DNA, 1076 bp, Homo sapiens
tgtgtcgcccaggtccggagtgcagtggtgcgatcttggctcactgcaacctctgcctcttgaattcaagcaaatctcttgcctcagcctcctaagtagctgggactatggccgcgtaccaccacgcccagctaatttttgtatttttagtagagatggggtttcaccatgttggccaggctggtctcaaactcctgacctcaagtgatctgcccgcctcggcctcccaaagtgctgagattacaggcgtgagtcaccacacctggcctcccctacattcttgaaggaaagcatttacttgttatttcttaaattatggttaaatacaggtaatataaagtttaccatcataaccattacgtttttttctttttgcatagaacatttcattgtcatgtacccattttaaagcataccagtgtcatcaagttttttcacagtgtgcaaccatcaccactatctagttctagaatttcatcaccccaaacaaactccatacctttgagcagtcattctccgttttctcctccacttaactcctggcaacaacaaatctattctgtcttggtgaatttgtctaatctgtatatttcatataaatggaactatataatatgtagccttttgtgtaggcttctttgatacagtgtgttttcttttttcttttttttttttttgagacagagtctcactgtgttgcccaggctggagtgcagtggtgtgatctctgcttactgcaagctccgcctcctgggttcatgccattctcctgcctcagtctcccgagtacctgggactacaggtgcctgccaccacacctggctaattttttgtatttttagtagagatggggtttcaccgtgatagccaggatggtcttgatctcctgacctcgtgatccacccacctcgacctcccaaagtgctgggattacaggcgtgagccaccaaacccagctgatacagtgtgttttcttggtatatccatgttgtagcatgtattagtacttcattcctttttatggtcgactatttccttgtatggatcaaccacattttgtttattcatatcatggt

SEQ ID NO: 9058 - DNA, 1034 bp, Homo sapiens
gtggcacgatcttggctcactgcagcctccgcctcccaggttcaagcaattctcccacctcagcctctcaaatagctgggattacagggacacaccaccacacccggctaatttttgtatttttagtagagatggggtttcaccatgttggccaggcttgtctcgaacccctgacctcaggtgatccacctgtctcagcctcccaaagtgctggaattacaggtgtgagccactgtacccggccaatttccagaattttaatttaaaaataacaggattggccacacacgttggctcatgcctgtaattccagcactttgggaggctgaggtgggagtatcccttgagcctaggagttcaagaccagcctggttaacatagcaagacctcatctctacaaaatttggaaacttagccaggcatggtggcatgcacctgtagtcctggttactcaagagaccgaggtgggaggattgcttgagcctgggaggttgaggctgcagtgagctgtgatcactgtagcctagccaacattgcaagaatctgtctcaaaaaaataataaaatgataaaaaatgtaaatagaagccgagcatggtggctcatgcctgtaatcctagcacttggggaggccgaaggcagacagattgcttgagctcaggagtttgataccagcctgggcaacatggtgaaaccctgtctctatagaaaaattagccaggcatgatggcgtcccccatgtagtcccagctactcagggggttgaggcaggaggattgcttgagcctagtaatttgagaccagtctgggcaacataataagaccttgtttctacttttgaaaaaaaaaacaaaaaacaaaaactaagcagcaacaagaaaaataacatgattgtagctataaatgtaaaacttgacctggtcaatactttaccattattaaggttgtgaaatgtctcactattccacatgaagccttttttgtggcatcctgaatttattcactctgtccctagttttaatgataaaaatgtga

SEQ ID NO: 9059 - DNA, 1035 bp, Homo sapiens
tgctgtcagggaaacagggagacatctttctgggtgaccgggtatcagattgtcagcgcattgagctcaagcagggctataccttcgtcattccctcaggtaagcaaaatgggaagagtgggttatttagccatttttttccttaatgaaaaagaaattgatggattaccaccaagaatagttatgatgctgggcgtctgcagaaaacaacagtgtttcttcctgtcattatggaatagatgctgaggttttgtttgttttgttttcagtttgaaaaggcagtggttttccaataaagtatatgagaattgccagcagaggcttttcaggtatacacgtttgggctctgcattagccctagtaatttagaatctctatagataggacctgttctgcaggtgatacacaatctatgttgaagaactgcctactattctagggaatggctgtgaaggctggagtgctcagtcagggatgtttttgatcaagtcattaaatcaaagtaagtgcttataaagatcacagattttggagtcacagacctctattaggattctgactatgcatttacctgctagatactacgcttagagcaaatatttaaatctgtgtctcattttgttataaggaatataaatgagaacacatgtaaaccaagcttatccaacctgcaggccacaggcctcatgcagcccaggatggctttgaatgtggcctaacacaaattcataagccttcttaaaacattatgagatttttttttttgcaattatttaagcttgtcagctgtcattagtattagtatattttattttatttatttatttatttattttgagatggagtcttgctctgtagcctcaggctggagtgcagtagcgtgatcttggctcactgcaacctccacctcccaggtcccagttcaagcaattctcctgtctcagcctcccgagtagctgggattacaggtgtgcaccaccatgcccagctaatttttgtatttttactagagacggggtttcaccatgttggcca

SEQ ID NO: 9060 - DNA, 1161 bp, Homo sapiens
tggctcactgcagcctcaacctccctgggctcagttgatcctcccacctcagcctcccaggtagctgggactacaggcacacgccaccacatgcagctaatttttttgtattttttggagatgggtttttgctgtgttgcccaggcttgtcttgaactcctgggctcaagtgatctgcccgctttggcctcctaaagtgctgggattacaagtgtgagctactgcatcccacagtatcttggatttttataaggccagacatttacctctggtaatctcttgagccatgtgtttcatttttatgctcacagaataatttggtgtaatggggcttatcaacccaaatttcagaactttaaattcatgtatctttttctacactgatgactatactcaaagcatcttactttaattatataaatgtatatactgtctttctcaactggggtttcaagagagaattaagcccaaaataaaataatttgtgtatcttattttctcatttttctctaggatgatacacagctaatacccttctagatgcatagaaaaaagttaatttattatatacaatggataccttaaggcaagagttgacaaacttttcctgcaaaggaccagatagtaaatattttaggcttcgtgggtcataaagtgtctattgtaactgtttaaccctaccttgtagcatgaaatacttaaacaaatgagtgtggctcaaataatataaaattttattcatagacactgaaagttgaatttcagataactttaacatgtcacagaatactcttaaatttttttcaaccattaaaaaatgtaaaaaacgatccttttatatagttcatgatcatgattaggtgttcatgcacgtatgtgaaagatgccacccttgaaccttgttactattaatacgtcagcacattacctgtctgacccgaaaaaaaaaaaaaaaggtaaaaaacactcctagttcacaggaatcataaaaagaggcagcaggccaaatccactaagtgttgtttgctggctagcctccaccttagagaatgagagcttattttttagcagaattctaattggtaagggctgaatcatatatgaaagtatagatgatactgggattaaacagcaattagaatatttgggggttgtgatgtt

SEQ ID NO: 9061 - DNA, 1051 bp, Homo sapiens
aaataaataaatagctgggcacggtggctcatgcctgtaatcccagcactttgggaggctgaggcaggtggatcacctgaggtcaggagttcgagaccagcctggccaagatggtgaaaccccgtctctactaaaaacataaaaattagctggtcatggtggtgcacacctgtaatcccagctacttgggaggctgaggcaggagaatcgcttgaacccaggaggtggaggttgcagtgagccaagattgcaccattgcagtccagcctgggcaacaagaacaaaactgtgtcaaaaaagagtaaaaataaataaataaataaatttaaaataacaattagccaggtgtaggggcacacacctataatcccagctgctcaggaggctgaggcaggagaattgcttgaacccaggaggtggaggttgcagtgagccgagatcccaccactgcacactagccttggtgacagagcgagattccatctcaaaaaaaaaataataatatatcattcatgaacagttgttggccagagattcatttgatggatctgatttttctgaaatagacaatcctgatgattcagaccatcctgctgttagttttgtttagaaataactccaaagacagtttttatattttatgttcaccttgaaaatcaatcagatttccagccaggcgcagtggctcacgcctgtaatcccagaactttgggaggccaaggcgggcagatcacgaggtcaggagatcgagaccatcctggctaacatggtgaaaccccgtctctactaaaaatacaaaaaattagccgggcgtggtggcgggcgcttgtagtaccagctactcaggaggctgaggcaggagaatggtgtgaacccgggaggtggagcttgcagtgagccgagatcgcgccactgcactccagcctgggcaacagagcaagactccgtctcaaaaaacaaacgaaaatcaatcagatttccttcagcatcaaagagcatgtttatgtaaaattaaatgagcactggccgcgagctgctcttttattttcta

SEQ ID NO: 9062 - DNA, 1201 bp, Homo sapiens
gcaaatcattgctttctttcccctcttcaggtagattagaaaggaccggggaggccaagtataggccaactgaaaataaactagtctctggtgcccaggtggttgagtcctcctcttccccagtcatttttcctacccaaaacctccgttctctccaccctgcctccatgcttccaggtgtttagtagagaattataggacccaaatctcccatcttcagtttaagggaaactgaaatgataaagatctgagtcagttctcttggattctatctttgtcctcttgtagcccagactgcctcactcagtcacatgttccctctgtggagaggtggatcagaatgaagagacacaagactttgagaagaaactcatggaatgctgtatctgcaatgagattgttcatcctggctgcctccaggtgaggagagctatgaggggttcctgaagtctcagctaatggagtgagtgacacaacagaatgggacacttgtgatgggagtgccagcatccctactgtaggccatcagctctgtggtcacataatgcagtggtctaacatcagcccttgattcatatatgtacaatgtgtcaggcactgcgttagaccctgaggatagaacagtacacaaaatagacccagttcctgtcctcatggagcttagaatctggactctggattgggtatgtagagttcccaggccataatggaactgcatggtgtgttttgggatgcctcaagcctttaggcatctctgatacatacttcagtgtacctctggatattagttcctaagggagagtgaggataataatatcagataacatttaatgagtgctgagtctgtatcagactcagtgcagagctaaatagctttaaaaaaaaaaagtaataaaaagtaataaattcagatctcagcctcagagattgagtccagcatgggccttgtgttccaaaagctcccctactgatccgaattgtgcagcctttgtggagaaccactgtttccttggccttcttagaaagtatcagctaaaatcatgactgtcgcctgacagtgataataagacactgtcattcatgagaagcagcccaatttcagaaaggttaaaatgtgaaaagtataccttttatagatttttggtttttttgaatactatatagtagcaaatctataacagaaacaatagtaggtcagtat

SEQ ID NO: 9063 - DNA, 1029 bp, Homo sapiens
agcatgcgtttcacttatttgccattaagtcgcccgcctgccgttacctgggtaaatggatttgaagggagtgtgagcaatgcaggttggaatctgtgcaggggaacctgggctgttaacccagaatgaggtgtcctattaatgcacaatcaattcctagtagtaagttcccggtgacgtcaggtacaggagcgctccgcagccagtgtttcctccccgtgcctaggttgcacccaggtgggcttggcagagggactgagtgctcaggctggtgggtttgggctccacgcgcttggctgttgctttcagggtatgctcttgcctcggaacacacagtgggaaccaaaagcacagtgtagcccttgaggatgcacagcctccctcacacctgccccttcttcctgggccccttccctactccccgccggctccccatgggtcagtttccactgctggatggagctatattcacgttatttctactctgctgcaactgagatactaaaaatgaggtgtttgactgcagcttttttctaaaacagtaatatcccttctctgctttgctgtttactgcaaaaggacgcgtctatgctggcagaagtgggttttctggtattaacatgttggcagctctgttcccaggtgggggcaattttctgactctagagccatttcgtgtttgggatgggggataaccccctcctggaaaccacagggcatggaattctggaagtttgttcttggtgcattctagcgtaatgcagattacggtctccatgtcagcagtaaattgcagggtgtgggtgctcatgtcatatttgtgaagaagccgtgacatttgacaaggccgccagagtgcctcttcctgagcatccccgcaagggagctgctttgtggccgacacgacgttccggagcccaggctgctgcagaccctggctgtgtgtgcggggccagctggctttttctctcccctgctcagggcttaccttggacctgccggtttgggctggcctttcctatttgatct

SEQ ID NO: 9064 - DNA, 1032 bp, Homo sapiens
attcttccagaccctcgggcccaaagcctggaagccctcacggggctggcctcataacccttctcccggtccccgacagcctgagccttctcccacccacccccttccccttcttcctgcccaagtgttgcctctgcctgggcttcctccgcgtggcgcctccagtggagtcgggccacccaccgccctggaccaagcctcctgagtcctgctctcctgcccactccttggctgtgaagccccctggtttgcaaggccctgccctccgcctcaccatggcctttgtgtgccctctctcctgccccattggccccttgctcatccctggacatactgtcccctgcctgttcccacgtctaccgacccccctggcttcgccagctgccgagatcccacttgcactccaggaacccagtggagttccaccttctccacacaggctttccagacccagaggcctcctctccttcccaaggcttctgcacacgctgtctggtatcacaggctcagaaccatgccctgggcagggctgtttggagcagggggtggctttggcatgaggtacacagtgcctcaggggtagatgtgcagcgggtcctcgtgaccacagcctgggtggccagtccgaccagccctgggctgggctcctaggggcaggcagggccggggtgcagaaaggcaggggccatggcaagcacagagaacctggacttgcggatccaaatctccaccagctgcagtcatttcacgggaggcctgctggtggccccatagacctgcagggccatgtgagcgtgacatgggctcaggtgtgttgtcccttcaggcccccagccttgcaatgccctcagcatggcagctacacgttaccccaggagcccagactagtgaggaccagatgcaggcctcagctggctgttgggacagaccggcagggctgggcttgaggtgggccaggagagggcaggaggggacagtaaggtggtatttgaggccgggagtgtagcctggtgtggcgctcccagacagcac

SEQ ID NO: 9065 - DNA, 1027 bp, Homo sapiens
ggatgtggggagggaggtgaaggacaggaggcagggagacaaacctccgcagtgggagaggaagagatgaaaagaggccagacgggaagaacgtggtccagcagaaacaggctggacttggggctgagtgaggcgggagtctggggaagagggtaggtgtggttgggttggcttcggacatactgatgggatagcatgggatccctgggcacagagatgtcctggagtaagctgaaatgtggacctgggggtggcatcagggtgacaatgggaacggacagtctctctcccagggatgtgggggtcagggagagagaggaggccgtggaagagggttgagaaggcactgtcatggaattaagtgccagtggggagctgtgttcaagatggcagaaatcaggagaggctggaaccaagaaagtcctgtcggggttgagtttggagagggctcagggaagggaccgcctctgagaaaaggggtggccagggagggctgcagtagtggtgagcaggtgagctctgggcattcagaagccttcgggctgctaccaaccccaggacctcacagattgacaccatagcgtggggtggcaaagtgaccccagatggcacaggcgccatgtgactacagggagaaggcagggtaaaaatggcaatcaggccttccagcccagagtctcagaactgaggacgccctacagcaggaagtgatgctcaagctagctggccctcctcaatcatgttccacgtagggaaagggagaatagagggtcagccttggccacctagcaaaaccagggccccagaccccaggctgggcctccagtaatcaagggccggaactgagctgacggaggcctgcaccctagttccggtgtgggtggaggggccggccctgatttcgaaactcgccttcctctcctgacgctggcagccaaccgcagcctctgcaaaagggactcgtgcggcgggcgaaggcagccgttcgccgcgggcggtcctccgccgggacggctctgccgctgcc

SEQ ID NO: 9066 - DNA, 1072 bp, Homo sapiens
gctaggttactgataactcattgtttaattgactgtttaccaaacgagctgtactggtttacattcccaccagcagcatgtgagggttccagtttctccacatcctcatcaacacgtcattattcactcatttgtttttggaatctagccagcctagtgggtgagaagtgatagctcactgtgattttgatttgcctttctttgatgactaatgatgttgagcatcttttcatgtgcttattggtcaattgtatatcttctttgcagaaatgtctattcagatcctttactcattttttatttaacttaattaacttatttattttgagatggggtctggcctttcacccaggatggagtgcagtgacatgatcatggctcattgcaccctccacctcccaggctcaagtgatctaagtagctgggactacaggtgcatgctgccatgcccagctaatttttaaattatttgtaattattttattatatcatttaattgttttgtttagttatttgtagagatagagtctacagactggtcttaaactcttaggctgaagcgacctgcctacctgggcctcccacagtgctgggattacaggcatgagccaccacacctatcccttcacccatttaaaaaattgggtcatcttttgattattgagtcataggagttttataattttagctgttacacttaggtctttgagccattttaagttaatttttgtgtatagtggaaggttcttttgcatgtgactatccagttgtcctagccccctttgttgaaaagactatgtttttcccactgaatggtcttgtcacccttgtcgaaaatcagttgaccatagataaattggttactttctgactcccacattagttccattggtctacatgtctgtctttatgccaatattatactgtcttaatcactgttgctttgcaataagttttgaaattggaaagtgtgagtcttcctactttgtttttctttttcagggttatttcagtattttgggaccctcgcattttatatgaattctattttcttttttctcacaacccagtg

SEQ ID NO: 9067 - DNA, 1199 bp, Homo sapiens
gccacccggcctatagacagaatctttacagaggtgtttttttttttttttttttggatgcagtcctgctctaacacccaggctggagtgcaatggcgcaatctcggcttgctgcaccctccggctcccaggttcaagcgattctcctgcctcagcctcccaagtagctgggactacaggcacacaccaccacacctggagatattttgtatttttagtagagacggagttttgctgtgttggccaggctggtctcgaactcctgacttcagataatccacctgcctcggcctcccaaagtactgggattacaggcatgagccactgcacctggcctacagaggttttaagttaaaatgaggtcttagggtggatgctaatcctctatgactggtgtcctcataagagaaaattcagatatagacacatacagaggaaagatgatgtggagacagccatctataggccaaggggagagaacagaacctagaacagatccttttctcatggctcccaaaaggaatcagccctctcaacaccttgatctcagacttctagcccccagaactgtgagaaaataaatttctgttgtttcagctacccaatctgtggttctttgttatggcaacctgtcttagtctgttgtgtgatgctgtaacagaacatctgagactggataatgtataaagaacggaaatttattctctcatagttccaaaagtgttcaagtcttctgattgcgtcctcacatggcagaaggtagaagaacaagagagaatgaactctgtgtcttcacatggcagaaaagcagaagggcaagagagagtgaacccactcccacaagccctcttcatagtgatattaatccattcatgagggcggagtcttcatgatctaaaaaatcttagaagaccccaccttctaggctgggtgcggtggctcacacctgtaatcctaacgctttgggaggctgaggcgggcggattacctgaggtcaggagttcaagaccagcctggtcaacttagtgaaaccctgtctctactaaaaatacaaaaattagccaagcttggtggcacatacctgtaatcccagctactcaggaggctgaggcaggagaatcgcttgaacctgggagatggaggttgtaaggagctgagattgtgccactgcattccagcctgggcagcagagcaagact

SEQ ID NO: 9068 - DNA, 1107 bp, Homo sapiens
taaaaaattagctggccatggtggtacacacctgtagtccctgttacttgggagattgaggtgagagaatcgcttgagcccaggttaaggttgcagtgacccatgatcatgccactgcactccagcctgagtgacagagggagaccctgtctcaaaaaaaaagaaaaattttgatgccgtattaaatcataactgcataaaattagtacatactgtactactgtaataatttcataaccacctcctgttgctgttgcattgagttcagttgtttcgagtatccacttaaaatgctgtgacactaatcatctctgcatgagcagtttgtctatctagtaacttgcctattgcagtaaaaaggtgatctcttgcagttctcatggagttttcattgtctcgtgcaatgccatcgaccttgaatttcagcataggacccatatgaagtgccactgttaatgctgggagcactccaggaagcagagaaaagttatgacatttcaagaaaaatctgaattgcttgatatgttccacagattgaggtctgtacctatggttgcccactatttcaatagtcagtgtaaggactattgtaaaaaaaaaaaaaaaaaaaaataaaggaaattggtgaagctataccaggaggtgtgaaaatcttgcactttttgcaaaataactttttatctcatattgaaaattcaccttttatgtgcagggttgctataagaaaggagtacatgtagactctaatatgatgtgagaaaaagtgaagtcattatatgacaacttaaagcaaaaggaaggtgaggatctaacgctagagagcttaatgccatcaaaagatggtttggtagttttagaaagaggtttggctttaaaaatgtcaagagaggctgggtgcggtgactcatgcatataatcctagcactttgggaggccaagatgggaggactgcttgagcccagaagtttgagactagtctgggaaacatggcaaaaccctatttctactaaaaatcctaaaaattagccaggcatggtggcatgcacctattgttccagctacttgggaggctgaggtaggagaatcacctgagtccgagaggtcgag

SEQ ID NO: 9069 - DNA, 1120 bp, Homo sapiens
ttttgttgttttttgagatggagtcctgctctgtcatccaggctggaatgcagtagcatgatctcagctcactgcagcctccacctcctgggttaaagcaattctcctgccttggccttctaagtaagtgggattacaggcacgcaccactatgcccagagaatttttgtatttttagtagagacagggtttcaccatgttggccaggctggtctcagacccctgacctcaagtgatccgcccgcctcggcctcccaaagtgctgggattacaggcgagagctaccacacctggcctgggattgccttttaaaattctcttgttattggacaatgcccttggcattgaaccccatcagttcaataccgaaggtgtcaaagtggtctgcttgtctccaaacacatcgtctctaattcagtctctagatcaaggggttcgtaaggaccttaaaggctcattacacatatacatggtactctatggaaaggactgtcaactctatggaagcgaaccctgatagaacatcgtgaaagtctggaaggattataccactgaagatgccatcattgttatggaaaaagccatgaaaaccatcaagcctgaaacaataaattcctcctggagaatactgtgtccagatgttatgcatgatttcacaggattgatgataaagccaagcaaggaaatcatgaaaaagattgtggatatggcaaaaaagatggggtgaagggtttgatatggatctcagaaaaattgaagagcttaatagacaccacccaagacgaattaacagaagatgactcgatagagatgagtgcttctgaacctgtgccagatgaagaagaagatgtagaagcagcagtggcagaaaataattaacattagtctagaagaagggttctgattattcaggaccacttttgacattttttatgacatggacccttctgtgatgcaggcactgaaactcaatcaaacagtggaagaaggattaataccatatagcaggggtccccaacccccaggccaccggaaccaggccatatagcaggaggtgagcaacgggtgagcaagcgaacacaagcttcatctgcatctacatctgctccccatcacttgc

SEQ ID NO: 9070 - DNA, 1029 bp, Homo sapiens
gatggtggatcacaaggtcaggatttcaagaccagcctggccaacatggtgaaaccctgtctctactaaaaatacaaaaattagctgggcatggtggcgggcacctgtaatcctggctactcagaaggatgaggcagagaattgcttgaacccaggaggcagaggttgcagtgagccacgattgcgctactgcactccagcctgggcaacagagcaagactctgtctccaaaaataaaataaaataaaataaaataaaataaaataaaatgaaattgttaagtccctagtaagactaagaaaatagagaaaatataaatccccaattatcaggaatgaaacagtgaaattaaaaatagatcctaaacctaaatgtaaaagctaaaacaatgaaatatctagaaaaaaatagaaaatatttgttactttggggtaggtaaacatttcttaggacataaaaagcagtaacaaaaaaaatgataaattggatttcatcaaaatttaaaactttgggccgggtgtggtgactgatgcctgtaatcctagcactttgggaggccgacacaggtggattatgcgaggtcaggagtttgagaccagcctggccaacatggtgaaatcctgtctctactaaaaatacaaaaattagctgggcatggtggcacatgcctgtaatcccagctacgtgggaggctgaggtaggagaatcgcctaaacccaggaggcggaggttccaggtgagccaagatcacgccattgcactccagcctaggcaacaagagcaaaactccatcacacacacagacacacacgcacacacacacacattttaaaactttcgttcttctaaagatactattatgaaaaaaattctggccgggtgcagtggctcacgcctatgatcccagcacgttgggaggccgaggaaggcaggtggattgcttgaggtcaagaattttgagaccagcctggccaacgtggtgaaaccccatctctactaaaaatacaaaaattagccaggtgtggtggc

SEQ ID NO: 9071 - DNA, 1025 bp, Homo sapiens
ctctcagccttggtttccttatctgtaaaacatggatagtacttccctaatgagattgttctcaggattcaactagataacatgtgtgcagcatttcacatagcagatggcatggataggcacttagtaaacatcagagccctcccagcagtgtcaggctcttagtaaatatctgattcttgaatattcccatccccaaatatatccccctacctgaggctcctctcatattctctgcctcccttcctgtcacagtgcatgtgtctactgaaggccaccctcttcctgtatcctggttcctggccctcctcaccctcacaaagatctcactcacacaactgcctcctcatctccggtaacctcaggttccctcgctactggatctctcagatcacttctctctctacactcactctggggatctcatccactgttggagctttcaaggccatctaaaagattcccaagtttatattttaaacctagaatgcctcagaatccgagacttacatatccactgcctataccccatgtccctttggaagtggcacagatacttcagcatgtctaagatggagctccagattcctgccccacccttcccacaagtcttcccatcttagtaatgagaactctgtccttccagtcgcccaaaccaaaacctttggagttatccttggctcctccctcttaaatcccacagtcgaccaataggcaagtcctgccagtcagctcttccttaaaaatacagagcgtacctggccacttctgagcagtccacctccccacgctggtccagatcaccctcagctctcatgaggccaacttcagtagcctcctgagtggttttgctacctctgttttccccagctccacaatcttgttttccaccaacagagtaatgttttcgaaacataagcttgactctgtcatttattggcttcaagccctccagtatcctcccctctcactcagaatcaaatccagtttcttatcatggccctagggaccagcccgctgcctgt

SEQ ID NO: 9072 - DNA, 1027 bp, Homo sapiens
tattctaccattcagggaagggtttctattcccttttctagattgttttgtccaacacactcattgagcaccttcttttggatggagtctaagctgggtgctggtatagtgagtagaagaagactcaaaagctgtccccaagaaactcaacaggatagtactgtgtaagctctctgatgataagacctcctcctttacctctgtattccttatagcccctacttaatgctttgcatatcacaggccacagcttattttgactatgtgtggagacagccctgataccctctcctttctatcttgttatgcagggggcagggtctgcaggtgcccttggccatgcctaggccatgcctaggcagatgaggagcccggacccctcagggtggggcatgtgccctctaacttgggccagatgactcagggccattcagcagagctggcttgcctcacccacaagcaagttagtagctcctgcacctacactctgacctctcccttttctagtgattcttgcacttgctggcagttctgtgtctgcatcgcacagatatgcctgtggcccttattatttcaggtacattgatcttttcttcccaagtagattagaagctccataagggcaggagccaaattaggttttaggcttcttttggcttttctacaccacaggcaggtaattagatcttgaaaatatttgtcaactgattgacattgccatcatttcttactttcttcacttaaggcattatctccaggaggcccttataaaatatccatgtaggatgtgaggatgatctggctgtgacatctgtcaccccattgatcaccagggttgattcggctgatctggctgtctaggcgggtgtccctgtcctccctcacagctcctcgtgcatccctcccgaagctgtgtgctctgttgaggacgaccatccctgatagaggaggatcagtcttccgtcaagggtatatgagtagcctcgctcccatgctagaacttccaaacaagctctcaagatccata

SEQ ID NO: 9073 - DNA, 1025 bp, Homo sapiens
gctggcaggctgagcacagtcagccctaagggaggaagcaggagagaggcggccgccaagaacagactcacccataggaagcaaggtatagggttagaccactagggtcgggctgccttatggggcttagttttgggtatattctaggatgtgattcctgagtgtgggaagtgtagggtggggttagattgaaggagatttagtgctcactctcagggaacggtggcagtgtggaggttcaccccgttcttggtgttaggtggggaaaagttggacttcaatgaggcctttccatcagcctgcaagggtggggacaggaagggagagaggtgcatttgacgagtcgggcttgttggctgatggcactgcagagtttggacatcccaggataccaggagtccagaggccagggttgggtgctgtaaggagggatgtgggcagtggggaaatatgcttttctgggattttaagtgaggaccaaggtgaggattcagtggacactttggactggcaaaggcagttagggtttggctagggtagatataattggcattgggctaggttaggtttaaggactgggttactttaaaagtttcagattagtttagacttgggatttggttgatttagtgcggttgaggtttgagtccagcaaggatgtggtgaggtctgggcaggcagagggtgagttggagggctgtgacttggtcggtttaggtatcagatggggcgctgcttgtcatgttatgaagagcagggctagtttgggttttcagcttgaataggtgtgaggtcatgagtggtttctttcctatagttctttttttttccttttttttttttttttttgctgccaccttctctttccaccacccctatagttcatattttatactctcagatttttctataatgacataggttgctttgataggcagaaataacttagataggtataacgctttgcccatggttaggatgggatttggattcaagaaagaatgaagactaggttaggtctaatc

SEQ ID NO: 9074 - DNA, 1045 bp, Homo sapiens
tcacgggcggcaacgtgaagggtgagtgcaggtcggcctggcagcggcggtgcagcagccgcggagccgccagcctaacccccttccgctcttctccccgcagtgctcggcaaggccgtccactccctgtcccgcatcggggacgagctctacctggaacccttggaggacggggtgaggggctagggtgtggggggcgggtgggactccagccgggagcgggtaacccggactagagtctcgcccccactaggcgggatgaccgctggcagatttgtcggcaaagtttcagtttcttagtctggcggctgtcatcttcccaggccggtgtgtgaattgaggaaagctgtcctgcgagctcccagggggtgacgtgcacttagagaaactcggggaaggcctgggtgtgcgacccctcctctgcggcagcagcgccggggccgactctgaaggcttccatggggaaaggagggtttttcagcaggtggtggcggagcgggaggacgatagggcaagtgtgtgagcagaagcagccagagggctgggtctgtggctgccccctgaccacgtccctctccctgctcttcgtggcccagctctccctccggacggtgaactcctcccgctctgcctatgcctgctttctctttgccccgctcttcttccagcaataccaggcagccacccctggtcaggacctgctgcgctgtaagatcctgatgaaggtgaggcccttccctcagcagtggcactactccaccccaggaatctccaccagctgtgcctctgccctggggtactcagtagatgctaagtggggagagagacacgtgcaagcccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcga

SEQ ID NO: 9075 - DNA, 1021 bp, Homo sapiens
cccaggttcaagcaattctcctgcctcagcctcccaagtagctgagattacatgtgcctgacaccaggcccggctaatttttaaaaatgtttttagtagagatgggcttttaccatgttggccaagctggtttcaaacgcctttttttttttttttttttttgagacggagtcttgctctattgcccaagctggagtgcagtggcatgatctcggttcactgcaacctccaccttctgggttcaagtgattctcctgcctcagcctcccaagtagctgggattacaggcacccgccatcatggccagctaatttttgtatttttagtagagacggggttttgccacattggccaggctggtcttgaactcctgacctcaggtgatccacccgccttggagatggtcttcccctggggttgggccacttggtggccccacctctcctctgactgccccagccaaactccgcctcttcctgccagttgatgacctgccagcgtgcaggtgcctgtcagtgtgatcttctgcttcttgctcccctgacatcctctcaatgaccaggagctcgtcttctgctgatgggctcctctgacatctggctgcctgtgggtctaccccctaggggtgttgggtttttataggcacaggataggggtgtggcaggccagggtggtcttgggaaatgcaacatttgggcaggaaatgcctgttctcacctaggtctgtgggggtggaaccctacccagggaccacgccctcctctacccagcacttcccttctccccttccaaattatttaacaggaccatgctcctcccttcccagcacttccatatcacattgtcccactgcaaggcttttttacacatgctgttcttttggcctagaaagttcctatcccagggtccacttggcttgctttcttccttactccccaaccccccactctgtttaatccagccccaaccctcttgccctgctgtttcccaagcacgtggcttcacctgccatgacatattg

SEQ ID NO: 9076 - DNA, 1083 bp, Homo sapiens
atataaaaggcccctggcctacccaagttttggtccagcaggggagccaggccgggaaagggccaagctgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtggctcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctccctagacagcacccaagaaaacctcatttggctcgctgaaggatgaagaccggattttcaccaacctgtacggccgccatgactggaggtgagacagtgcccttagtgtgttgggtcccggagcaaggtgtccccttcattgccttccctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaat

SEQ ID NO: 9077 - DNA, 1049 bp, Homo sapiens
ttgaagacccagtcctgatggccctgtagcctgtctgacctgtgggcccctgcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtgggtagggagagatgtagacagatgagaaggtgttcagtgtgcactcacacacccctcacccagcacagttgttctgaggtgttagtacctggtctgtcagtggttgaactgggggagtggtggccagtcctgcatgcatcccaaatgggacttggctcccaaagcctccttccagggctcctaatgctgctggtgtaaattttttttttttgcttcaaaaatatagtattttttataaaacaagtagcaagaagaaaaaacctaagtggaactatgtgtttagcaagagagcggaataattatgaatataaacaattcctatttggagaaaatacattatgttcattgcttggaactatgaataatacttatatctgtaggaaatatagaaaaataaaataggttaaggcaataaggatataggcaattacatttttattttaattttataaggacttttatttttcctttacagactagggtagttaggagacctgatagtagctacttcgtttttattttcctggcagcaaagcagcttacttatgtgttccttcttgcttatctgttccagatcatagtcaagttttccaattcgttttactaagctagcaaaattttttataccaggagcattaggagcttcaccgtgggaggccttcaagggcttcatgactcctgaagttataggctgactcctgggctgggggtgggctgggaaactcacacctttgtcctgcaggtggccatccgagaggcctatgaggcaggtctgattggcaagaatgcttgtggctctggctatga

SEQ ID NO: 9078 - DNA, 1045 bp, Homo sapiens
cctcgggcccctttgtctgggcctccttaaggcaaacagctgtctccctgaatatttccagtgtgaatggtgcagcggggtggccctgtagtcagatcccccaggctgcagcctctgcttggaggtgtgggggacagcggggaacaggaggagcttggagtttgtttcacgtcctcctgcctctgacccaagcctagagattctatggacagtttcaccccaaatctgcctctttcaggagcgtgtttacattgtggggccttgtctggagctagcaaaacaaggtgaagacaaaacagcgacagtatctggggagtacaggccagcgccgctcctttttccggaaatgcctgggtcaaggaggcaaaaggggttttggggaaactgtttgttttaaagggggggtttctaggccgaccgcgttgcctttcacctcattgcagttttgggttttgtgcacgttttggggtgatgttgctggagtcaaatgcctgtcgtccatgtggttcgagcccctgaggagaaagaattatagctgtagagttcagttgtgtgtgaggcaaaaatagagttgattattttaacattaggcagcaaggcctgggagccccagtgaatgtggtgatccaggcctaaaatggaaggaaagggaggaatctttctgcagaacggttttgatgttatatccctggttttactgtgtgaaatacatgcctcggacctcagcgaagccagtaagtgggccgctaattatttttcctgattgcttcctgttgcaattggaagctgtgaacgcacggaaatggctttgttctagtggtcccagtgctgagaacttccccagctcccaagccctagtcctctctcctcggggcccaagtgcttgttccagggccggcctgtccaggcaccccctctccccctggaggttcctcctgtagatgcccaaggccaaggccgggccctctgggagagcccagaagggctgagtggggttaaccaagtgctgtgtggagcaccctgagagagtcccctccaaagcagg

SEQ ID NO: 9079 - DNA, 1027 bp, Homo sapiens
cagcactttcctggggagattcacctcgtgcttcctgtcgtttttggaacccgtttaatttcagccgtgctgtgtcactgctcaggcatttagtagaactcacacacacgggtgggggatgtaggcaggtgaggcctctgagttgctttctcccttgcagcgacgggttgcagggctgatgggggtggaggggtttggggtcagacccacctgggtttacatgctcagtggctgtttgacttcgggcaccatacctagtttctgttatctcaccccgttcctctcccaggctatggggagccctaactgccctgtgtgagacctttagccccatccctggcagagctgcagtgagcgcagttgtgtgtcagcgtcctcgatctttctggccccagccggtctagaggctgttattacaatagtctggatttttcctgtatgaccttggacatccagtccactgacaaactcactcactcaccgctgcagccctcgggggcaggagtagttagttagcactgtggacagagcccctgcgcccagggtctgattccagcctggccgcttcctgtgctgggaggcttaggaagctgatgctacctttgtgtgcctcagttttctcacctgtaaaatgggaatagaatccttcctaccatgaattcagtgagttaacgtgcacctggcccggtataatgctgttgctgttttgctttggtgtctgctaccgagtgaagtgctagggttgagtgcgatagaatggcagataaggccccgcccctgcgggcagagcttcccatgtagaggggaggacagggaaagaagctttgcagctatgcagaggtgggcccacgggtgctccttcaccctcggggtgtcctgcgagaggcccttagaggccagatcatgctgtggagtctggttgtgatccacaaggcagcggaagcttctggaaggctttaggcaggagttacaggaaatgcaagctaaagccagatctttcctaggtgaaaggtgtcgagttgttttt

SEQ ID NO: 9080 - DNA, 1046 bp, Homo sapiens
tggtcgctgctcagggggcccagggagtttgctgcagtgccggaggactcctgggtcccggctgtgcctccccgcagccgcctgctcccttgggacactcattcatttgctgtggccactgccacccacagtccttgcctcgtagactccactgcagctctggttacaaagagcgagtggtcagggactcctgacctgccatgcagggccccgtgggcttgtggtggctttggtgccgtccgctgcgtctgcctcttagagcatggagttctccttctcaggagggctgagctgctggagctctagtcctgccgcagagcagcccccaagtgcggcgttgcctgtccctgtggagcaggtgactacctggctgcgggcggaacagcaggccatggctctggtagtggtctgtgacagcatatcaccctgtgggacagatccccgggacctagtggggtgggatagtgagagctgcgtccacaggggaggctcagagacttgtgtgcccagtgtggccctgtgtgctgacccagctgggctctgccctgtgtggcccccagggtgcccggcgtgtgccctgatggcctggggcagagctccagagagccatggctggccgagggctcacggattctcacccgcccccagtgcctcaggagacacctgggcagcgaacagcttgaggtgtgcagaggatgggtcacgatgggagggaggcacaaggggtgctttccatctctttggccaccagttttaattaaaaaaaaatttccatctgttttgaaaggttttatcctcttaaggaaatgacgtttattaagcaacagccccttctgctcatcgtccagctgtgcccactggcagagcagaggctggtgggattccgcctgctccacaccaggaggtgccacttggcttcccagtgtcgaaggccttcttggactcagcacaccttcacggccccgtgggctgtgggtccctgggttgggcatgactgacttggagggtgatgagagatctccaggatccaggcaggtctggcacgc

SEQ ID NO: 9081 - DNA, 1064 bp, Homo sapiens
gtgcctgccttttaattggtacttgaattatacgagtgttttcttccatcaataaaagaaatcggcgaacagcctcccatgggtttcagtaagtgcaagccctccttgtcatcccagacctcagcctgcccatttaatggatgaagacactgaggcctggagggaacagtgacttcggagccactctcctggactctgccactcctctcgcctcccatatgaacctgagtggccacatgaccctgggggagagctactcaactgtcccaaggagagggtgatgactgctggcctcccaccggccatcagcgccccactgactgacacccctgagtcagtctccaccctggaactgtttctctcactatttgccatggccttgggccgcttccgggggcttggcaaggcaggaggcgtggaaccaagatggtatgtaatcagaatgctatattttgttgaaaataagaatgttagtaatgggctggtttctggcaggtcaaactgggactctgaaatacatatttttctctgctctgccctaaaccttctaattagtgaaaacgcacatttgcagacatcaatcaaatgtcatattccctagcagcttgtcctgggatcactgagctggtcacattccacagttgctaactcagggcttgcagagtatgtgtgcacgtgtgtgtgcatgcgtgtgtttgtgagagagatacatgccttctggggagccctggtggcctgtttccttccctcccaggcccctgagcttctgctccccaccccgcccccagccccttgtcagcacatgcgcggccactgcaatgagatacagacgttcgcccaattaaaacacagttagtggaggacacatggctttcagggaaaactgctttctctcaggaagatctctgctgtgcagtattccatagctagaccccagctccactcaacagtggactccattaatagcctgggttttggaagaggcgatttgcttctggtaactggctccggtgcatggatgttccctcctcttgctggaatctctgcccgacccagacagtgct

SEQ ID NO: 9082 - DNA, 1114 bp, Homo sapiens
atgttgggggaattggtgggatatagatggttcagccaaggtggaaatgggggagtagagctattcctggggtgcttgaagatgtcagcaagtatcccactccagcttgagtttgcagagctttctctaaaaggcagaacatgtgcttggttaaaggaaacccaagattttattattgttgtaaatgtcaagtccctcattttgaatctttagacaactgcagaattgtgtcactgacttgggtaaaagcccaaggaaaaacatgaaattatgttgccaaaattgcggtcatcgtagctgcatgagggtttgagtggccaccgccaccccagtaggagagacgcgtagatgttgaatacactgtgagctgcgtgcaggtaattgaaacgtggatgtggggaaggtccctggcttcatggaactgtctacataaaagcgagcctgggtgtttcctgtttcttctaccttaagaaatttccacgagaagctaaggtatggttttgccaagaatgttgttaatggcccagcaatgaatattttcagccacttgtagacacctgaacttcattcttggcaaacaggtgtatgattcttggacttggagagactgaactttgctgtgctcagaatggaggagaccagctcacttgtactttgatttctccctggtccctgtcattttagcctgatcagtgctttttcaagcatttccccttgaaggggagataggactttctggctcagggatggggaggcttccaggcagccttaaacattgtccctgccccaccctaagtatctttgaagtttcatgttttatcataaagtctgtgagaatgttgcagactccgttatagtcatgctagttttatttttttaaatgtggtttgaattttatataaagtatatggattatatctgagaactaatatgcaaggcctgtatgcaaaacataatacaactttacagaaggacattggagaggactgcagtagatgttcacggataggaagacaggagatggagatggcagttgcccccagattgatcagtggattcagtgcaggggccggcagtgcgctctcctccctgttctttcctcccaccccattgc

SEQ ID NO: 9083 - DNA, 1814 bp, Homo sapiens
agacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacctgggctcctccctcactgagtggagggaactcagtgtcttggagttggggtgcctgcaggctgggtggtgcaggtgaaatgcagacctctcagctggtgttccagagcagctgccttcccccgcccgagggacttcacccgcagcccagtcaggggtggcgcctgggtgcatcgcccgcaggctgggtaggggtggagcctgggtggccctgcctgtgagctgcatagttgtcgcctttgaccctgagttttcttcgttatctgtttggacctgtttggggcaggcaggggatgagatctgaagataaatgccttagctgtgaccatctccttttgtgagaggtcaatgtccagttccgctgcagttataacatcccattttttgatttctttttattttttcctttttctttttgagatggagtctcgctctgtcacccaggctggagtgcaatggggtgacctcagctcactgcaacctccacttctcgggttcaagtgattctcctgcctcagcctcctgactagcaggggttacaggcgtgagccaccacgccccagctaatttttgtatttttagtagaggcaaggtttcgtcatgttggccaggctggtctcaaactcctggccttaagtgatctgcccgcctcggcctcccaaagtgctgagatgacaggtgtgagccaccgtgcccggcccagaactctttaattcccacctgaaacttgccgccttaagcaggtccccagtctccctcccctagtccctggtcccaccattctgctttctgtctcaatgaatttgcctaccgtaagtacctcatataaattgaatcataaagtatttgtctttttatatctggcttatttcacttagcataacattcttaagtttcatccatgttgtagcatgtgtcagaatctctctcttttttttttttttttttttttttttttttgcagacagagtctcgctctgtcatctagactggagttcagtggcacgatctcggttcactgcaacatctgcctcctgggtccaagcaattctcctgcctcagcctccttagcagctggaactacaggcgcgtgccaccatg

SEQ ID NO: 9084 - DNA, 1095 bp, Homo sapiens
ttgggatctgttctgaagagaaaagacagctggatttgctggcactctgcatgtaggttcgataaaaagatgagacaaggttggcacggtgccactctgtgcctcagtatccttgtctgtacagaggcgtgaccatgctgcatgtcatgaggaaaacaccaagaacagtttgtgagttcaacaaatgttagctgtcgttataataaaaatgccctttcctcgccaccagaagtccagtctccatgcctacgtggttttgtctttttacttctttatggcttttgctatgttggttgggaagtgctcagtgctaggttgggaggtgatcagtcgggaggtgctaggtgatttgttgggaggtgcatgatgctcagttgggaggtgctaggtgctcggttggaaggtgattggtactttgttaggaggtgcttggcgcttggttgggagttgttggtgtccagttgagaggtgctaggtgcttggttgggaggtatttgattgggaggtgcttggcacttggttgggaggtgctctgcacttggttgggaggtgctcggtgctaggttgggaggtgatcagttgggaggtgctagatgctctgttgggaggtgcatgatgctcagttgggaggtgctaggcgcttggttgggaggtaattggtacttggttgggaggtgcttggcacttggttgggaggtacttggtgcctggttgggagtagttggtgtccagttgagaggtgctaggtgcttggttgggaggtatttgattgggaggtgcttggcatttggttgggaggtacttggtgcttggttgggagatgctgggcccttggttgggagtagtctttcccatgctcagatctgagctggctttgcctgcatcatctctgcgagccaactgtccctgtttggctctggcttttcttaactatttgaaatggttcctttacatgcttgcctctgaattctctcccagaagccctccccaggatcacacctgtggctgttcactcccacccctgcccctggggcaaagttgaccttagtgttgattcctgggcctctccccacaccttccctttgctccagtcat

SEQ ID NO: 9085 - DNA, 1034 bp, Homo sapiens
ccatcacctctggggcccttcgctgttgaccgttcacctcggcctcaaaggcaatgttgagagagaaactggacccagggaaggagtccagatgagctgcctcctgagtgacctggcgacaccaggggtttggaccaagcaggttaagggaggattatagacccttgaaggggaggagtggtttgaccaggttggatgagccctttgtttacagaggaggccagggcaagtcaccagcctggggttgcccacagcaggtggcatagtaggttctagcaggtggggtctggctcccagagccatgagtttgctgctgccccatacctgggccctggtggagcaaggccctggtctccctcgcagactgccccaggacgctgcctgctccctggaggagggggtgcctcggctgcacaagcctcagcggagaaggatgcttggcttgctggctgcccgggaaccttggccttctcagagtttgttttctttcctgcctgtctgttggtgagaagaggctgaactcagtgctggagctggaccctgcgctctgcagtgttggttgaagtcctggcggaaagggaaagagtgaggacatacgggctcatgacggcagggagtggccaccacagtcagggccgggggacggaggggagagagaatcaccggaatatggcaaaggtgtaaaacaggcagctcgggccgggcgcagtggctcacgcctgtaatcccaacaatttgggagtccaaggcaggtggatcatttgaggtcaggagttcaagaccagcctggccaacatggtgaaactccatctctactaaaaatataaaaattagctgggcagtagtggcacgggcctgtaatcccagctacttgggagactgaggcaggagaattgcttgagcctaggaggcggaggttgcactgagccaagatcatgccgctatactccagcctgggcaacagagtgagaccctgtctcaaaaaaaaaaaaaaaaaaatgcagctcgtcctggctagtctgaaaaaggtggag

SEQ ID NO: 9086 - DNA, 1050 bp, Homo sapiens
gccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagcctctgttgagcatattttgaggttctcttggtgccagtgatatgttacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtctcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaat

SEQ ID NO: 9087 - DNA, 1031 bp, Homo sapiens
cacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcagggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtc

SEQ ID NO: 9088 - DNA, 1102 bp, Homo sapiens
gtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtaaagttgcggctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacatttttgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatt

SEQ ID NO: 9089 - DNA, 1072 bp, Homo sapiens
ctgtgtaagactcagttgggctgaaaaagtaaaactataagttattttaattttttcaggacagggtttttgaccattccttaaattaggaacatttaccggagtaattaatgagtagtagcgcctcataatgtttaaagagatggttaaatacagaaaagcccatcacaagcttaagtcgggctttgttcctcatgtgcttttggatactagtttctgggtgactgccacccgaatcagtaactagggtttcttagtgtaagtcctccttgttactgaaaactgtaagggtgccgtggattgcagtattcttcagcaaagatagtttgggaaatagcttttgtcctggagggatactttggaaggtattctccacttcagcatgtctggtcagggagtctagaacattgaacaaaatgcctgcactcagtcagaaataaactcacaatcctttaccgcttgcccgatactctcctccatggtgctcgaaaccttgcgtgcaccttcccctggtattgttgtgtttacttgggacttggtttgctgtattggagatgtgtgttttgatggactcagtcttaagtagagatgagtatcttgctggtggaacttaaggacaggaagaagattgttttcggtttagaactctagcctttgtgtaaagtatagcaaagcaaagtcaacaagcaaaaagttgttagtttcaatgaactaattgagaatttgagaatcagaccatagctgagcagaaaatgaatagaagtaacattgacaggatgaggttgcctagctttttaagataaagctttggccgggcgcagtggctcacgcctgtaatcccagcactttgggaggccgaggctggcggatcacttaaggtcaggagttcgagaccaggccaacatgtgaaaccttgtctctattaaaaatacaaaaattagtcggtcatggtggcgtgtgactgtaatcccagttatttgggaggctgaggcaggagaatcgcttaaacctgggaggcggaggttgcagtgagccaagtccagcctaggagacagagcgagactcagtctca

SEQ ID NO: 9090 - DNA, 1035 bp, Homo sapiens
tcttttgccctccttttgtcagtcagtggtcaggtctggttttagatgccagcttcaacttttttttttttttttcggagacagtctcactatgtcacccaggctggagtgcagtggcatgatcttggctcactgcaacctccgcctcctgggttcaagtgattctcctgccttagcctcctgagtagctaggattacaggtgcgtgccaccacacctggctcatttttgtatttttagtagagatggggtttcaccatgtgggccaggctggtcccgatctcctgacctcaagtgatccgcccgcctcggcctcccaaagtgctgggattacaggcgtgagccaccatgcctgttttttgtttttgtttttgttttaataaagacctattcccagagaattagccctggatcagtttaccagttctgcccattgagggcacagataggcatacagtatgctcagcctttaacacagtgatcctgcccactggtaagttggactcttctgtgccctagactctgatcccagcagagaagtgttcttttctcctggggagatgagatgcagtggtagagagaagggtagatcttttttgctcatattaaaatttagattatctagtttatggaatggaagaatattaggaaaactataaatttttagcagctaaatgttaatatctgaagttacaaaaggtcatggaggcattttcttattcttcatcctgaaattcggcctgtgcctatgttgagaactaccagtgaccaccatctacttctaatatccatttatttcatcagcaaatacattaattgagtccttactctgctaggaactgtattagggattcactgatgaacaggcccttaaggacctgcagtctagaggaagaggcaaacaagagacgacaaagctgttaagaattgtacatggtgtcaatggggcctgggaggaaagagcttctgtttgctggtcagttggttgatttgtttaaactttgggtggttgagattgccagaagttttgcaaaag

SEQ ID NO: 9091 - DNA, 1035 bp, Homo sapiens
aggctctgattttgtacttcacagtaactctggggaaaaccacgggattattagttccagaatttcttacagtggaaatacatagtgacttgaagtgatttgaattccccagagattgactaccgtgaaatctgatggcccaagaaaagatgaatgaaagattgtttttaggaacattagagagcaggactaaaacggctgcagactgatgttgagtcagacagacttggagaaagctgtgtgggactgttagttggagccttgggtttcctatacctacatgtaaatctgaacaaaaattctggtggcagagacacactttgagaaaaaagagcttgcctgagaacacatgtcacactgagaccctaatcagggcagttcacactgcctgctccatggttggctggtcagattggttgggctttggtcctcagatgggcgtagcgggaggaacactgactagtcttgacaattgactgaggcttccattcgtgagaatcatggttttgggctgcaacaacacttagacgtcatttattttctatttatttatttttttgagatggactctcagtctgtcgcccaggctggagtgtagtggcgcgatctcggctcactgcaacctccgccttacaggttgaagcgattctcctgcctcagcctcccgagtagctgggactacaggcgtgtgccatcacacccagctaattttttatttttagtagagatggagtttcaccatgttggccaggctggtctcaaactcctgacctctagtgatccgcccgtcttggcctcccaaagtgttgaaattacaggcatgagccaccacgcccagcgcatttattcttacagaaaaatggaggccatgcagaagaatggaaccagaaggagcagagaaatctcagccccggtgattccataggattgtgatgttccagaccacagttttaagtgctatttgtttcaagagtgacatcacagctggattttacttagaattcagaataagtggttaacgtctggaattttatt

SEQ ID NO: 9092 - DNA, 1022 bp, Homo sapiens
ctgccccttctgagtaaacaacactctgtgaatgactgtcccttttcactgtggacttcttgttattacacccttagatggactcagcagctatgagatcctcccatcataggtatggtattttgtaacaaaagtacagaaacacctccaaggtgcagtgaatgatctcaaggagagaaatggagtattataggatcatagagaggcctcgaggtctaaccagctgctctgcggaagtcagggtgatggtggtttcagtgttggggaggttacagagttagtgttgatatgcaaattttcttcctccaaatttggagtatgttatatatgttttaatgtatataactgtgaatatgaatataacattagaacatatataacataatttctgctggtggagtagagatcataaatttgaggtttgcagtttgctttctaaaacatcttttaagtttattcttttctggcacacaggacgttgtagggtaactttgctgtggagtctcacattttatatagaatcattttttcaacatagtgtggataatcacatacgccttgaaggatcaatatatgttaacagatgattggatctttttgattttgcacttaatttctttacaaattctgcattataaccagacagctctattgagggtttgcagattttttctgtaaaggaccagttagtaaatattttaggcattggaggctaaatggtctctgcaaggactcatctctgcttttgtagtgtgaaagcagccatagccaatctgtaaacaaatgaaggtggctgtcttccaataggactttacttataaaagcagacagagagttggatttggcctgtgggttgtagtttgtcaatgcctgctctaatctgttttgtctttgtttatctttttgagatagagtcccaggctagagtgcagtggtgtaatctggagtgcagtggtgtaatcccaggctagagtgcagtggtttttgtttatttttttgagatagagtcccaggctggagtg

SEQ ID NO: 9093 - DNA, 1047 bp, Homo sapiens
acaatctggaaaaaggggtgtggatcaaaatagattatgagccaaatctgtctcgaggaaggaagagagtagagtttagcatttataatacatggcctatcccaagagaggggagggactattttatacataaaaaaatattaaaagccttactttgaccaataaattaaaaagaggccatcagaaacaagagccgtggagggacataatgacacataggctggggctagtactggagttcattttgtgacactctggtggcaaatcctgtcagttctggtcctgtctctgcctctgccatggccttcattgaggagggttaggggatttggtggcagcaggagcacactgctgatcccagaagcatagggttaagaactaactgccttgaatacgatcttagtgattttcagtggagccaaggagtttgaaatgcataggcaatgtaacttcatcaaacttcaaagagccaagcttgataatctttcagggttgtgagaaaaggatgagaaaggattgtagaggacatgggttagagagagcgagctggtttagcagaattgttgtgaggattaaagataaatattggtgggcatgtttgtatctatctctagaagaaactagagtccattctctgtttaccatattgtcaggcctaactaacatttttcactttttggtatcagttactagtaaagtgcctcatggttagtgtaaaccttcagcagcctgccgtgcttactcacctccacttgcaggaggcaggtgtgtctttattttgcttgctgagtccctgctattaaattgtcacttgcgcttggttctttatatgtgttacttttaactctttattccttctagatgagtgtgaggtagtcatcttgagatgaagcagctgggaagcagggaggcagtctggccatagcggttaggaagagggtcattaaggtggtcagaagtgggatagaaccttggtttgaccactgactacctgtctgaccttgggcaaattatctcacctttctaagctccagtttcttcacatgt

SEQ ID NO: 9094 - DNA, 1075 bp, Homo sapiens
tgttttcaaatgcttacttgctgtctgtaatgtttgctcaggtcttttgtccattttttaatcaggttgttcatttttttgagttttaagtgtctatatatatttttatatatatataatataagatacatattttgagacggagtttcgctcttgttgcccagggtggagtgtaatggcacagtcttggctcactgcaacctctgcctcctgagttcaagtgattttcctgcctcagcctccggagtagctgagattacaggtgcccgccaccacgcccagctaatttttgtgttttagtagagatggggtttcaccatgttggtcaggctggtcccaaactcctgacctcaggtggtccacccacctcggcctcccaatgtgctgagattacaggcatgagccacagcgcccagccttctttatatatttttggataatagttgattatcaaatgtgttgtcagattttgatcaggattgcattgaatctgtagatcaagttaggcagaactgatatcatgacaatattgaaccttcttatccatgaacatggaatatctcttcatttgtttagttcttctttggggtctgtcatcagagttttatagttttccttatatagatcttgtacatattttgttttatacctaagtatttcattttttggatatgttaatataaataattttttttttattttcaaattccacttgttccttgcaggtatataggaaagcagttgatgtttgtatattaaccttgtagcctgtaaccttggtataatggcttataagttctgggactttttttttttttttttttcaattccttcacattttctccatcatgttgtctgtcaacaaagacagttttattttatgctttccaatctgtatactttttatttccttttcttattgaattagctaggacttccagtatgatatgatggaaaaggatgatgagagggaacatctttgcccgcttcctgatcttagtgggaaagctttaatttctgaccatcaattatgatgatagttgtaggtttttgatatatgttgtttatcaagttg

SEQ ID NO: 9095 - DNA, 1059 bp, Homo sapiens
acattggatagatggtagttttgggctgttacagatattgctgctctgaacattcagtttgtatcttttggtcaacaacatacgtatgcatttctgttgttcagtatacctaagggtgaaattgctagggcatagaggtatatgtatagtagtggcatctactaaagctattgtaccaaattaggcttccatcagcagtgtgtgaaagttccacttactctggatcctctccagtatttcatccttttcattttagccatgctggtagctgtgtagagatgtcttacttagggcaattttaatttacagtagtgaggtcatacgtttattggtcatttggatatccttttttatgaaacatatgtttaagcctttttttttctattatcttttttctgtttttattacctttctattttttgctgcataataaattatccccaaacgtagtggattaaaacagcaataaacattatcttgcagtttctgggagtcagaaacttgggagtggcatggttgtctgcttctggcttgggtgtgattagccctctgaagccttcatggatccgctggaggatctgttctaaggtggctcatttacatgcctggcaagtaggttctggttctggctgttggtgggagacctcaggtcgttttcacatcggcttttgccagggatgtctgagtttcctgttctcaggacatggtgataacttcccactgagagagtgattcaagagaaagagcccctaagtggaagctatcatttttgtgacctagtcttggaagtcacgtagcatctagctttgccatgttctgtttgttagaagagaggcacattgtggacttctaaaaaagtgacagggtcttattctgtcacccaggctggagtgcagtggtgcgatcatagctcactgcagccttgaccttcctggctcaagggatccccccacttcagcctcctgagtagctagctgggcccacagttgcgcgcaccaccacacccggctcagttttgtatattttgtagttggagttttgccatgtttcccaggctgg

SEQ ID NO: 9096 - DNA, 1026 bp, Homo sapiens
ctttttttttttgtatatgggttcctcattttttgctcttctcccaccatgccttccatttgtgggaggactgggctcttttgttttgtggtattccccacagtgttgtgtagcctctgttttatgtgcactggtagttggatcttgaggaagtttctcttggagaatacactttgttggactttcactttaaaacttttttatttttttgagacgaagtctcagtctgttgcccaagccggagtgcagtggtgtgatcttagctcactgcaacctccaccacctgggttcaagcaattctcctacctcaccctcccaagtagctgggactgcaggtacgtgccaccacgcccggctaatttttgtatttttagtagagacagggtttcaccatcttggccaggctggtcttgaactcctgacctcgtgatctgcctgccttggccacccaaagtgctgggattacaggcgtgagccactgtgctcagcctaaaacttttatctgaaaatggtgctgtttctttggttgtgatctgtctctggaggttgaatgtggagctaaactgaaatttttaagggcttctaacctaaatcacattgaaattcatttagaccagagctgttcaatacttgaagggtgagggttcattttggaaggcacttccgccgccttccttttctgtgtgtacgggaggccagtggcagtctggtcatcttgagtgcatcacgccctcactggcagttcagaatgttgcagggcatcgttagcatggattttgctgttgttagttttttcatgtttattgtctacttgttttctcctcgtgctgtctgctggctttccttctcttgttgccagttttggagttgtgatgaacaatatgttaagggttgataactcaaaattcttaagttctttgtgggttaacattgaatttgtagtgttctccagtctctttcttttctaacagaaactttcatgatgaaaagttagaagaataaattacaatgtgattaaccctgcac

SEQ ID NO: 9097 - DNA, 1049 bp, Homo sapiens
ctatggattatggaagtttcagcttttacatcaaattaagcttgattgtataccttggctgagcccactaaatgtagctcggtgattgggatcatgtagtcatttgtacctttgctgtgcgtccctgcccactgttgttacaacaggcagaggtagttctttgggccttattctagatgttgatgtactaatttatgacttggctctgttttaatagcagcttagattgtgttggcttcatatatgcctgcagtgatttgagtgtccattagggtgcatagccaaacaatgatgtagtccaattaggtgccaaagtctttacttcaagtactttacatacatgattttgcttttaggaggtgatagtatggatttactttgggtgttttgtacttttcacagtagtctttttgcatttttttttttttttttttggtatagtgattattgattaacggcttagaagtcttggtgttcctacctcgggctgtactaaaatggttggtgtttctgaaattggctgattgagttgcctgtctatagttatttttgttggaagatgcctctgaagacatgggaattaggttatttatcaacagtcatggaagttggttgttgcctgattatgggcatttatgcagttatttttgatgatttttgtattcaaaattttgtggatgatttttaaatttacggtgtgctaggcattgaaggtaaaaatggtgaacaagtccttgtagagatgaattatcttcccatctcattaccttcatctcttcaaacttgggtgctttagaaaacgtgtgagggtacttgcagcaatgggatttttgagatttgcattaggagggcattctgaggtggcctgtcctgggacttcctgatgccagttaaaaactagtgtttcttgcttttgtgtatccaagctttgtgatataccacctgtctgtctaatggagagtgcatctttagttgtgtatgatatgtgctctcaggagaaaatgctttcttgcatgttatgcaatagctatgatttcctcttatgagtt

SEQ ID NO: 9098 - DNA, 1094 bp, Homo sapiens
gtactgaaaagaagagaaatcttttgacagggttaggttgtgtgacagggttaggttgtgtgacagggttaggttgtgtgacagggttaggttgtgtgacagggttaggttgtatgactgttgagaaaaatgcagtgtattgaaggaatgattggctgcaaataaaagtatactattttcttttcctgtcttgatttcttttttggagagagggctttggattcatttcctctaagagaatagtctaatgctgtcaactactgaaccacatctgatattattgatgattaaaaccatagtcttcctcgttagcttccatgatgctgtgcagcagctcccagtgtttcagagtagtcttactctaaccgtgtccttttctcaccctgtcctttgattatgatgtaaatagaaattaaatacttggagaattcccccgttttcacctttagtgttctttagggagaacctttcatcatccttatggattccaccctcatctgtttgtgtttaactttcaaagcatctctttgtggcttagctttttttagtggtgttgtgctgtagtatgtctggatactgtcagttaaattctttccctgtgaggataggaaaccttggatcttgatttcttcaaccgtgcttgtctgacttctccttcaccatcagtacgttctcagtccctctgggcttaaagcagattttatttttttattttacttctctatttttttttttttttttttaccaagtcctgcttaattttttctgtagccactggtaccatgtttaaagctttgattatttttatattagattcataaattgttgaagcaacaagaaaatttagagttaatttaccccacctctcttatttttatttttgagacagggtgtcactcctatcacccaggttggagtgctatggcacaatcttggctcattgaaacatccgccccttgagtagctgggactagacataagccactgcatgtggctaattttttttttttttttttttttgagacggagcttcgctctcgttgcccagtttggagtgcaatggcacaatctcggcccactgcaacccttgccac

SEQ ID NO: 9099 - DNA, 1028 bp, Homo sapiens
gtagctgggattacaggtgtgtgccaccacacctggctaatttttgtatttttagcagagacggggtttcgccatgtttgccaggctggtcttaaactcctgacttcagatgatccacccgcctcggcctcccaaagtgctgggattacaggcatgagccactgcgcccagccgtgtgtgtgtgtgtgtgtgtgtgtgttttttaaatgtacttatcactaatttagcctcagacttttagccagttacatattcagatcttccctcatctttatccttttgaaggaatctttctagtttggactgctggctctcccattctgtgaccttgggggttctttttacctctttctccccattggatctcctattcctgtgttctgtgttaccttgttgctctccttagttttagtggagcatagttgccagtagttttcagtgagaaaggtgtataggagctagacctgttgagactgtgtgtctttctgtgtactcgtggttgataaagtttgactgtgtatatgcttttggattggaaatagttttccttctatattagtctgctcagggttgccataacaaaatatcataggctgggtggcttaaacaacagaaatttattttctcacattctgtaagctagaagttcaagatcaagcttcttgacaatttggtttctagagagtggcctctttctggtttagagacaccatctcttctcacatgtggtgccaatcatcataccagatgacacagtctggagcaccataatcccaaatgttggaatacctaaagatcagaatccctgaagatcaaaatccttaaagatcataatctctaaaatcctgaaaatcacaaaagattaaaatcctgagtgttgaagccctgaaagccaattaccggggaagggacagtatgtttttggttgtgcgtaggatagttgcatcacgttagacggaactattaccttgttattgtctttattcgtaaattaagtatggtttaaggagatgcgtgtgggtgccagg

SEQ ID NO: 9100 - DNA, 1094 bp, Homo sapiens
catttactaggaagtggtagaagtggcgcagtaggtccttttgggggacatgcaaacatagttaatcaaatttcacttgtccccattgtatctctagaaggtagacaaaaatcatttaatcatctaccttcctgaactggtgctagctctaagacttgaaattttagtcactttttacttggctttctttttatcctgatgagcagtgatttaccagggcctattggttctactgttgactcttgcaactgtctttttctttttgttaccacggctgcaaagctaggtcagactttgttgcctggagagatactatggtggttttgctgtgaggggtctctgcttctaactggcaggtggatgtttcctaggcatctgaaatactactttgcatatgatgtctcctcagccccagctcctgaagaacagtcctactcaacccttgcaggttccccttgagcttaaacagtgatgtccaattcttgcccccgatattcagattctcgtacacgacttaggatttcctcagctttacctcaatattcttccggatgaatcccatgtggagaattctctgcaagtattcattccccttgtggccccttgtctcatagagtttttttgtttgtttgtttgttttctgagatagggtcttgctctgttgcccaggccagagtgtagtggtgcgatctcggctgactgcaatctccacctcccgggttcaagcgattatccggtcttggcctcctgagtagctgggattacaggcgtgcaccaccacgcccggctaatttttgtattttttgtagagacggtgtctcactatgtcggccaggctggtcttgaactcctggcctcaagtgatccacctgcctaggcctcccaaagtgctggtattacaggcgtgagccaccgcgtccggcctcacagagttttattattgttctttgtatttgaattcacgtcttctggggctcagctttcttcctgccttttttgtcaaaccaccttggattgttccagttcccttgtgatcactcctttgtgaactctcagagcatctcattaagttattttaggattatttttttctc

SEQ ID NO: 9101 - DNA, 2454 bp, Homo sapiens
ctttaaaaaaacgggcttttgaaagatttttttgtgactaagttgccaatctgtctttcattatagaatttgatagctcttaatctgaagactgcttctttttgaccatttgccaaaagcatctcagtgtgctcctgaatttctacttgattaggaaaggccattttctttgggtaccttgtctgtaagatatttgaataataaatgaccattgtcacttacctcaagttgggtgagttataaatggcacataactgggtttcacttaatacaaaccacactgacttggattttccaagctttgccttcaccacgttagtatagaattccctttctagccaagcagtttcaccatttttcatttgctgaggaccacctcgtatctcttcagttttggagacttagaaactttttgtgttgttgcaaatagccatgccagtcataaccatgtttcctactctcctccagttacctgttgcttcctttctgatgtttgactcatttgttcgctcttggaatcctgcccagtttcagaaattccaagaatcttggatgcttcagatgggaaacctttctagggcctatgagaatttactgattttactttgacttacatttttttttttttaaattttgagacagggtcttactctgtcagccaggctggagtgcagtggcgtgatctctgcttcccaggctcaagtgatcctcccacctcagcctcctgagtagctaggactacaggtgtgcaccaccatgcccgactgattttttgtactttctgtggtggagacaagatctccctttgttgcctaggctgatcttgaactcctggactaaagtgatccacctaccactgtcccctccaaagtgctgagattacagatgtgagccactgggcctggctaacgttggcttttatcataccatcttacctctattcacacaccctcacctccagcatgcacacgtgcatctggaaccagctgggtgttccttgcctctcctcggtttccttcatctcttaagaagacaactggcaaaaactcgactaccattgtgccatccttattacttgcctttccccacacaacccctcagtctcacttcaatgaaacttgttcgtagtagaaataacccatgctttgcatatacttggactgaagtttttgaaattgtggaaaataggcacagaaattcctgtacattcaaggtttcataatgagaatttgtagaggaacacgttactgtagttgctttaatttgaactagttgacaaaagtaaggctggattttttggttggtggttgactttaaaaaagtgaagtgaatgataaggttgtacatcttgtcttgctgttagcatcttagcagtgtatttggagttagtacagggtgtatatatagacatttgccttctgagggttgtgtatttcccagacagcttagaattctaaaggcaagtataaatttgtatcatttgacaccaaagtacagctccagaatgaagaaaaagtggaaattagacttggaggaggcagaatgctggtgacattggagaagtaatggtcatttagtgtgaaatcttgtagcggataccttggctttgaacgtagaggccattgcaaggcatcattttctgctccggtgggcccctcttcattaggctcacccctctccaatctgtctttcacattgttgacagttaacgcattcacactccagatctgctcttgcagactccagtgtctgtcttagcaccgtgaccagtctctacagtgccccacctcaggcgtcttaccttcatccccttctttcctgtcccatatttaagtcatattcacacctggccagacccaaaagaggtttgtcctcttccctctgtccttcacctttgtaggaaatacgaactctgttgagagtgtactaaccacagcatcagtgtcatctccacgtcacttccaatgtctgcttttgttcagaattgttctatgttattaaaatactttgttgaatctctgctgtagatattttaatgcatactttcctcagttaaaactcactggatctgtctgcttctgcagcaagcctgcacagtgccgtgcattcacacacagccctttgtggtctggccttgtgttgccaacctaatcctaccacctacccaaaggctcctccttcctgttgtcctcagggccttctcactgctgtgactcctgaagctactgggtcttcctgtccactgctttcagggaggcgtcgcctggcctggaatatgttatgcagctccattcatcacctcctaaatgctccctgtattttgaggctcaacttaggcttgatatataatgaggcatttttggccaggttgtcctcccttgagctacctttctgtggaacaaggttgaaatgtatgcctgcctgtctctgttttctctgttctcaattttattg

SEQ ID NO: 9102 - DNA, 1034 bp, Homo sapiens
gtagttctagtagttttaatagtggtgagagaagggagtgctgaagggagacttggggtgtataggaattagaacttgggcagcgtgtgcttgcatgtctttgtataagattgtgtgaaatttgtgtgtcaaatattttctttgtagtgttctgttaaatatatagtattaaaagtcaataacacattttgttgtcttaagtctttcttgtgtgttttcttgggtggaagcagctgcttctcctattttgttctgtttgtgctccgtatgtttaggtagcggcaacttctactagaaatatcttatgtgtgtttattgccagtctggcatatgatatcagatattcacttcggtgttgctatcttgaggattccaatggggccagttattaaaaggtatagacagagctggtttgatgggtgtgtgacctgtgcagtctcgcatgctcagaaacacttggattaatgctctcctgtttgggttctgtcttgaaagccatcataatctttgaatcttctttgaaatctctgaacattttgctctgggcccagctagtcctgggtacagttatttcgcagttgatagtatacagtttattgtacttagatataaagttgccaaatttaagcatagtgagttcatatgaataggagattttgaatttgaaattcattgacgatcttgtcatccccacagttgactgcttgtttgtgggtaggatcaccagtagtttctttcttcagggttctaatagtttatcttttgtcatgtttatggtatggtatgttctgcctctgtcttgttgaatgaaaacccactgatatcaactttttcagaggtagtttctgaaataacacagtactgtttgcactagtatgcttttcctatgtttttcatggctgtatagttattttgaatatatgtatttaaatttgtgaagatgtagattaaaatgatcctccatttatgaattacaagctgtcagcagtggtttaaaatcaggcatcagcagcatctgggaactagagatgcag

SEQ ID NO: 9103 - DNA, 1020 bp, Homo sapiens
agtctcagctactctggaggctgaggtgggaggatcacctgagtcctggaggcagaggttgtagtgagccagggtcatgccactgcacaccagcctgggtgacagagcaagaccttgtctcaaaaaaaaaaaaaaaaaaaaaaaaaggaattaatcactttacaacagataattgctaaagaattccttttcttgtgtttaaatctcaagtttaaaatcagcgtagtaaacccacaaagtgatggctggggaattggaggacctcattcatcagttaggccacgctgctggagcacacgggctctgctacaggaatgttgcttctggctcactggaacagcatgggcaggaacttacagcagtaggtggctttcttccatatagtgatttggggaccacggcacgttccatgttttggttctgccatccctcaggttcttttggtcctcagcatttagctagatacaggtgaaggaccatgggaggtttgatggttcctggcacaatggaggaaactctgtcatgtggccacacctacacggtgagtgccccaggaaggggagagtagagacgggtgactgtcagcacctcactgggcagggcgcaagggctgtggggtagacgttgggtggattcaggagactgcagaaagcaaagtgggtgttaatgggacttttatttcctgtggaacaaaggacactacacttttctgcaaaagaccaagtagtaaatattttaggctttgtgggccgcagatggcctctgtcatatattccttttttttcttaaaacaacccttaaaaaatgtcaaaatcattcataactggcaggctgtgagctggatttggtttgccaacaccttcttatttcatcacaactaattaccactcttctttagaaatccagtgtttaatgagtttcctttataataaggttgagatttgggaagtcagtttttacttgaggcaaaaaagttgtatcttgattcataattcagaagtgtcattttatctaggtttt

SEQ ID NO: 9104 - DNA, 1035 bp, Homo sapiens
cccaggtgtgtcgtatacgtgtccctcctgccccagtcttccctggtttcttttgtcatgcagccacgtttggctattttgccatctctctgtcttgctcagcttttgagcttgccactcctgatgacttgttggggcgctgggtcctggctgtccagcagggaggagtgtaagagcagagtaattctgggtcagctagagtatcgtctggataggctcaacgtctctgttgttgctagtgaaaacagacacgagattgtcatagtaggagtaagtggaggaaatggacctgctgcctgtttgcagagggtcagtggtctggttgtcagaggcaagcatttctaaagccatggggtctgtagaagagcctgtgtgggtccatatagagcaggtgtcatgttcttagccgtgggccttctacaggagagacagcatggtgaagactcatggtgggctgactttgtgtctgtgctgatatccagatactggaaggctgatgtggagagcactagttttgttttgttttggttttgacacaaggtctcactcttgcccaggctggagtgcaacagtcatagctctttgtagcctcaaacttgtgggctcaagtgatcctctaatctcagcctcctaaatagctaggacaacattttttttgtatactgcttcctgccttggtagcccaggctgatgtcctgttccccccttcattatagtaggatgcttactctcttaagatgtaatatagacttagtaccatttacaacccatctaaagataaaggctggtccaggtccctacagagtgccttaagtcattacaaggtgctgcatgcagtgcagtttcctggaaaccagtgtcctccacagttgtccgcaagctttgctgcttcccatgccagaggaggctgtagcctgatggctcgtacgtccagccgctttcctcgctgatcgtggagaaggcccgggccctgcagcatgacctctctgggcttctgagtactaggtgcgctctagtttcttcagggaaaatgta

SEQ ID NO: 9105 - DNA, 1575 bp, Homo sapiens
atccttccgcctcagcctcttaagtcattgggactaggtgaaccacctcgcccagctttctctgaatatttttgatttccagttaattgagtcagtggacatagaacctgtggatacagagggccgactgcaagtaacaaaatgccacaagagctgaaatgtaaaattcctcaagaaaatatgagtgaatcaagtctaacagtatattgtaaggataatatatatcataacaaagtatggtttgtcttgggaatgcaaggctcattcatccttcaaaatcttcacatcaacagacagcagatctgatcacatcagatcaatgaagaaaaaacatatcatcattttgttaaattcctttatgataaaacatctcagcagattagtattagaagggaacttggatgaaaactgataaagccctctttcattttatttatattttttgagataaggcctgccattcagactggagtgcagtggcacaatcatagcttactattgacttgatctcctgggcctaagtgatcttcccactttagcctcctgaagtagctaggactacaggcacaagccatcatgtccagccaaattttttttatgttttgtagcgatggagtctgtgttgctacattcagaggggagggggcgatgtgagactgcatctgtttacagatgacaggattgtctttgtagaatatcctaaagaacattaaagaaaaaaaaaaacgcatactcctagaactaacaaatacatttagcaagattgcaagtatgaagtcagcactcaaaagttaattgcatttctatgtactaggaatgagcaattggaatttgaaattttttcgaagtattattttttatagcatagagaaaagaaaatactaagatacaaacctaacaaaatgtgtgcaaggcttaatgccccaaaactatagaatattgatgaaatcaaagatgacctacataaatggagagaaatactctgttcatggattagaagactcagtattgttaagatgtcacttctccccaaatggacctgcagattcaatgcaattccgaacaaaatctaagcaggattttttagaaatcaagtgaattctaaaacttgcacaagaatcaaagtacagtagccaaaacaattttgcaagagaaaaggactcacactctgattttgagacttaatacaaagcgacagcaatcaggacagtgtggtgaaagaatagacatacagatcactgggacagagcagagtccagaagtagacccatccccatgatcaggcggtttttaacagaggcatgggggcagttcagcggagaaaggacagcgttttcagtaaatcgtcctgaatggttaggtattctatgcagaacgttggactttgatatatattttgcagattatgcaaaaattaactcaaaatggatgatagaactagacataaaactagtagttctagaagcaaacaggagaaaatctttgtctcagagtcatgtacagattgtttagatacattgccaaaacccaattcataaaacagaagttgataactcagactacactaaaatttta

SEQ ID NO: 9106 - DNA, 1060 bp, Homo sapiens
gtttcagctttgggttaaatcagtatagagcacagaaaacaggagcaatttggaaaaagagatgaagatttaaagaattacagtttctttgatagctagcatggtcattgccttctggggacgtagtttttgtcctaccttctagtgtataaaactccgggaatataacgttcctaagtcattgatcactggtctttaattttactaataacaatatacagttattgttaatttattctgttaatctttaggactacttctgatgagactaaatttgatgagactactggaggagttactcattacttcttcattttgagattagataaccagacccaaccatttcctaaatatgacatactaaattgacttccaaaatatggcattttgtacttttagaaattctttcccttttgtaatgctattaccttttcaagtaatttgaaaacccttgtacttccaggagattcacgttactgcctctcgtatcctcatttgtttttgctgatagctctagtttttgtatgctggagttgagtcatgagcacctcaagactgtggaccgtatttttgtgtatctctgtctgccatgttgcatctcatacaataccctgcacaaaaaccatcagtaaatatttgttgcatcaaaatgaaattcttacaatttttttttttttttgagatggagtctggctcagtcgcccaggctggagtgcagtgatcttggctcactgcaagctccgcctcctgggttcacgccattctcctgcctcagcctcctgagtagctggggccacaggcgcccgccaccacacccagcgatttttttgtatttttagtagagacggggtttcaccgtgttaggatggtcttgatctcctgacctcgtgatccgcccgcctcggcctcccagagtgcagagattacaggcatgagccaccacgcctggcctcttataaatttttttgaaaattatagaaaatttaccacgctaactatttgtgttagttgctttgaagagaaaaaagatactccctttctcttggagaaacgtactctt

SEQ ID NO: 9107 - DNA, 1063 bp, Homo sapiens
gctgggactacaggcacccgccaccgtgcccggctaattttttgtatttttagtagagacggggtttcaccatgttagccaggatggtctcgatctcctgacctcgtgatccgcccgcctcggcctcccaaagtgctgggattgcaggcgtgagccactgcgcccagcctaggtagatcatctttttagctcattttgttaatgatttcagactcagatggtgtaggtagaatcagactcacatcttccattaatgtaattatgaagatgtgtgtgcattgtgttactaataagttgctaaaactagtttcattttggagaaagcttttttaaatatcttctagtattgctttgaggatccagtttaagtagaacatgcgaaggggaggtcacaatgtctggcacatagtagttcaataaaagttagtttctttctcatctttaattaaagagtgttaaaatcttattttgtaggaaaaagcgaaagtgtgaatgaggatacatcgaatcctattttaacttagacagcaagacttggctaagagtcgccaactctgttttgtcctattttgctcagttctttgcatggccttctatttctgtgccccaccatggggttacacccctaaaacacactggcccagcatgatatgtgtgctggcttgccagccaagtggcccgaagctcctcttgagtgcactgcagtacaaccacttgacttgctctttaacatagtcctgtgagatgccagctgccatgaccaagcagtattcccactcctcctctacactctggcaaggctttcctggaacatccccatgcccacatctttacccagtaactcactaaagccactcttgactcaagcaggtgccgttccttgatcacggaatctacctttgatttcatcaggccagattcacaaacagaatgggagtgctttatctatacctttgagaggatggagagtgaaataactggaaacactgggttatcacagcttaatttcatccaggcttggtgtctttaccaaagatggttggggaaaggaagggagattcat

SEQ ID NO: 9108 - DNA, 1045 bp, Homo sapiens
cacttgaggttaggggttcgagaccagcccggccaacgtggcaaaaccctgtctctactaaaaatacaaaaacaatagccaggctgggtggtgtgtgcctgtagtccgaacttctgaggaggctgaggtgggagaatcacttgaacttgggaggcagaggttgcagtgagccaggattgcaccactgcactccaccctgggcaacacagggagaccctgtctcaataataacaataacaataataataataataaaattattaatccctgtgttgttgactggggcatcacgttccagcagatgaccaggttggcaggaaaagctctgccctacatgtattctcatctctaggtgactcatcagaaggtagatttgggttttttgcaagagccagacacactaaccactcattttgcagtcagggtaagaagcagagaaatgagaattattgatactgtacagaattaacgagtagaaaatgtgtaggtagttaatagaaatgaaaacaggtggtctagcatctgacattgggatagaagagatttataaacaaaatattttgaggtagatattatagctcattgacacagagtttaagaaaaaaaatgaaggcagctggtatttgaatattggatgatgattctcacaggagacacggttatgccacagacacccagtatctgctgtggtctttggaagcagtaaattctcaataatttgttgaaccacagccagtggagcctgttgtttgtcacaggttgcagtttgcagtatgtgagaagctaaaatatttttacagcacgctcttaattgtgctataaacatgccgtatgggcacagtggaatggaggtgccgctgtaaacagcaagagttgaaggctgttacgtgccttgagaattggctcattttaactcaaaaagagcaagaacacaagatattctgtccataccccaggagcattctactcaggctaggatccaccacctcacaccagaccctgcaggtccctgtttggtgtctcgacattcacgtgcctggactct

SEQ ID NO: 9109 - DNA, 1309 bp, Homo sapiens
caaatgcagcattccaaataaataaatagtcgctgttgataggctatgatttatacataaaaattccaatggaatctgtagataaggattaatagaaaagtttagcaggtttactggagacatacaaaatcacttgcatcctataaatcaatataagatattccaaatgtgcctgtttttaataaaaatgtaaaaccttatctataactaggaatatgacctttatgggaaaacagtttaaaatctcatggaatatattgaagacctgaatataaataccaagatttgccatgtttatcaatgtgaagatatttttagcatttctgaacaagttagtctatgaaattaatgaaatttccatcaaaatcccaatagagattttcatggaaattgagaaactgattgtaatagtcataagaccaaagagagccaggaatagccaaaaacattttaaagaaaaaagtgaggggcttcaccatattagatatcaagacttagtaaagctggccgagtgtggtggcttgcacctgtaatcccagcactttgggaggattaggcagacagattgcttgagcccaggagtttgagaccagcctaggcaacgtggcaaaatcctgtctctgcaaaaaatacaaaaattagctgagtgtggtggtgtgtgcctgtggtcccagctacttgggggtgctgaagtcgaggctgcagtgagctgtgtcccccactgcactccagcctgggggacaaaatgagaccctgtctcaaacaaaagcgaaaacaaaacttagtaaagctactgagatggtgtggctttggcaaagaattatacaaagagaccccctccactacatgaacttgttacatgttagaatgccattataattcaatgaggaaagagtggactagtaaatagtgattatccacatagtagaaaaataaaattagatattttgtctcaacataaatatgaaaagcatgaactgtacagcttttagaagacaacaaaagagagtatctttacagtttgggtgtaaggcatttttttaaccataaaaagccaaaccataaaggaaaatcttggtaagtttgactttaatttctaatatcccagaagacataaaatgaaaagacaagccacaaccagtaaagaaccagtagccaggatattagaaataaccttatatcaatgagagatagtctaatttttttaaatggacaaaggatgcaaacaagcaactgtctgtggaggaaaacaaggagcaaaccaaatccagagtaaatgggacctgtcagttacagtagtaagtaaatg

SEQ ID NO: 9110 - DNA, 1138 bp, Homo sapiens
ccctctgttggagcccagtggagcctctgggagaaaagctggggtgacttttcctacaaggggcagagggactctgctagatttttgtttttcatttgtttttaattttgtaacatggaaactctttccttaggatataccagctctcattactcagctaggaattatacctctttaaagcctgaatttaaaagtctgacagttttaaatgcttactaactgtgggagttaaatcattacgaagtgaggaatacagagtgttgtccctgattctgggtttaatctggtaagaatctttacagaggacgaccacacgccgcttcctgtagcatgtgtcgtggttgtaattctctcatgtgcatattaagaagttgctgctcagatgtggctcttccctttgcagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaattacttgcaattgtctttttcttccacacctctgtctcatcaccagcgccacccatgggttttaaaagataaagcttgatcataatcgtggattagacatgaattttaaacccaaattctaccgtcaagagcatctgagacaccacctgttattgcatgtccaggggacataaatttatctccatattaagctgagtcaaatgtaattatgaaggtaagtctgttactgagatgaacaaaaacacaaaacagacaaaacccctgccctcgtggagctgatattttagggagatgggaatgaaaaagactacaacaaccttaaacagatgggtgagttgcgtggtactcatggaggtggtcagtgctgagaacagacgtgttggccaggtgggagggccaggagcaaggcaggagaggagagatgggcgggcaggtagaaaggcaagggcaggaggtgtgtgcagggatggtgctgtgtg

SEQ ID NO: 9111 - DNA, 1030 bp, Homo sapiens
ttttattacaagatacaaatttatcccacacagttgcaatgcaagccttgatgaaaccccagcttgatggtgtctcctctggtgtggctgcgctgttgggaagcagctgtgcccctggagactcccggctccctgtttccaccaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaagtaagacccctttgcctcacatgcccttctctgcccccgccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctggcccaggctgtcctggtggagacactggagtcctgatgcggtggcctggcccaggctgtcctggtggagacactggagccctgatgcagtggcctggcccaggctgtcttggtggagaaagtgctgcccgcccccccagcccccctctcacctctccccatactacccagcactcactgcttcagccacacaggcctcgctggcccctctgcctggaccactcctgcctg

SEQ ID NO: 9112 - DNA, 1531 bp, Homo sapiens
caggcgtgtaccccttccactctgctgacgcatgttagggacaggcctggggttggcgggcagcctgtcccctaactgtggctgccagggtacctgggggcagggccctaattcccttaggagctccatgaccacgcctgcctgagccccactgtgtctgtggacccgccagccctgggggaggccagctgcgtgtgttttgaagtagcagccaggctggaatcccagccctgggcagagggtcctggcctcacagtcatcctctggctttgcggttctgtctggggagggtggtggtgggtgcacccatgggtggggctgatcagtccccggctcctggcccgccaggtggtctactacgtatttgccatcattgggatcaacttgtttagaggcgtcattgtggctcttcctggaaacagcaggtgaggtggggtccgaggtgccacagggagtgtctcaggggtgctggggtgggcgggaagccttggcggtggcctcagtgggctcagcatctcaggatgggagggtgttctcccagttccttcgtctcctccctccacccccttttcccgacccccaatttccacctccgctccgcacctctcctaggagcccttgcctggagtctgctaaacacatttctcgtggcctgctcagagcagcactttccctgccctctgagcctctgtatcccaatttgtaccttcaggccaggctgagcacgccagcagaggaaaggggtgtaaggtatcaggcctcagaacctggagcccccgcccctgacccaggtgtgttgtgttccccagcctggcccctgccaatggctcggcgccctgtgggagcttcgagcagctggagtactgggccaacaacttcgatgactttgcggtgagccctgcgccctgtcccagcaccctgctccccgggctcctcccctccctacctcctgggccctcctggaccgctggtctctgcccccgcaggctgccctggtcactctgtggaacttgatggtggtgaacaactggcaggtgtttctggatgcatatcggcgctactcaggcccgtgagtcctcgtctccctgacggcagtgattctccgtgcagcctgggggttccctcacctccgggcacgctgcatctgcactggacgcccggagcgtggctgggacggggactcgggccttgacagggaagtcggccagcgtggcatcctggcttgccttgtccctgccccctgcatagccacatcgtgactctcaggatggtggccagtgactctgggtttacacctcctggaggtcgttggtgtgtttggggcttctgaggaattccatgggggtgggggagccccgggaaggctgagtgaacgagatagttcagctctgagcttgaagagctcagactggccccagctgatggtcctgggttttaatcccagcaccgcctcctgctggcttagctacctcggcagcttgttgcacgtttctaggcctcagttgggttgtttctgagatggaaatagtaa

SEQ ID NO: 9113 - DNA, 1085 bp, Homo sapiens
ttccacagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccgggga

SEQ ID NO: 9114 - DNA, 1050 bp, Homo sapiens
tggcgttccagatttcacggctgctctttcccactgacagtgtggtgtggacgctgccaagggagtctggagccccagagggtggaggtgcaggacttccaggagcgtccgtcgcactccacccgagggcgagcacctcagtggccgcagtgggtggatgcatgctgtgccaggctgatggctggccccggggcacaggcctgagcgggagaggatggaggggagggatcaatggtccaggtccccctggccacccagcattcatcctcagtcatgcacggcccaaggcttcgacagccattgatcatggaaggccaggttcacctcaagggctgccacatggagaggttaagtctgaaaaggctgaaaaggcagggttcaaagggcctcctgtccagatcagatggcactgaattccccagggagctggcacggccagtgggaacaggcggtgaaggcgctgttggacatggggacgggcagggggtgtgcagggtgggcgggcaagcatctggtgtcttgtggctccagagaccaggtgggaggtggaggcatttggtcctgagtgtcctgacaggtgatggcagctcccacatctcgctcaggttcagaggaggcagcatgggccgagggacagtttttggcttagtcttgctcttataaaggcttccgggtcatggcacctgggaaggggccctcgctgcaggccccttctaaggaccccctcttcccacctctccccaccctctctctctcaggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgtt

SEQ ID NO: 9115 - DNA, 1029 bp, Homo sapiens
cacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagg

SEQ ID NO: 9116 - DNA, 1031 bp, Homo sapiens
cttgttttcagcaaaaacaagtacagctttgcaaacagactaccccagggcttgcccttttttgtgagggtagtcctttgggatcttgaccccttccctggatttttgtctgtgttaatgtcttcatgttgtgtatttttgcacttaatatttgccctgtgtatgttttcccagcttatttacacacaaagcataacagatctgagcataatgagactgcccatctttttagctacagatacctgtaaagttgcatatttgtgggaacctgtattctgagcttaattactgtagcctgggtctttcatttcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggtatgagtgcttttaacctgaaactatagatttttctccactaaatgtttttttattagtgtcatcttttgttaatgtttcagatgagtattttccgtaacgatttgtgaaatgatagtttctggtgtttgtaagtcaaatacaaagttcctagggattaaacttcttagggagaacaaatcgttgtactctaaagtcatgtgaaaatacctcattattttcattcctatctttgggaactgcctaggttcaggaagttctccagagtttttgaaaaagggctctgaagcaaccaatctatttggtgcctccattctgttgtcttaagccttttctggctaaacttgtacttcccatggattatctcatgtatttctaatttcctaatgtaatttaatagacaaataggattgatttcacggaaaaaaaaaattattttgatagcccaccttt

SEQ ID NO: 9117 - DNA, 1050 bp, Homo sapiens
cagaattgctttacacccccgacatctggtgtcagcagtggtggtgtgtgtggaagtagggaaaacactttgatttttcctatcctcattagccagggaggtcagcaccccctcattttactagagaagtggggatgttaatcaagtgccctgcccttctcaagttcaaggtgcctgagacactggcacccctcctgtcacctgcatatatttacttcatgttttgattgtcccatcactgccagcatcaccaggcatgaccaccgtgttccagagcatggtggcagtttgtgagtgacagagtggcagccagtggcctagtgtcccgcaggcagagcagactctttgtttctccaaggcaaggatgtggcagtgccaccaaatggtcgtgtcaattgatgcccaaatggctcaccaaaagctgagtgacagttgccacagcaaaaaaaggggagaaaacataggttcagaatttcttggaaatgtttgaaatgcatgtgatagaactctaggtgggaaattggcttgttagatacagtaacttagcatgcaactagagtaaacagtttgacctaccaacccaccgactcatctgtttattttacttctttttttttgagacaaggtctcactctggccaagctggagtgcaatggcatgatcacggctcctgcagcctcgacctcctgggcttaagcgatcctctcaccacagcctcctaagtaactgggactgcagaggcacaccaccacgcctggctatttttttaatttttgtagagatgggttttcaccctgctgcctgggctggtctcgaactcctgaggtcaagcagtctgcctgcctcagctcccaaagtgttgggattgcagacgtgagcccctgaggctggccccatttgtttgttctaataaaaatgtaggactgaatttgactcacagttgactaatttacattctaaagtggccagaaaacttctattggtagtttccttcataggaaaattgggaggttctcactcaaaattggcttatatttgggcatatgttag

SEQ ID NO: 9118 - DNA, 1029 bp, Homo sapiens
catatgctttctcttttatactatgttaagcagtttttagttgtgtttttccaaaaggagttttgctatctttacttatttctcttatgtaaggtattttacactcatattcaattttttgctttcagctaatgattcttaaagaacagaataatcagaaaaaaactctaacagatggagtgctggacataaaccatgaacaagaaaatacaccaagcacgagtggaaaggcaagtctgtaggctttgtctttattctgtttgatttcatttgttcacagtatgtgtcgggttatgtggaaaacagttgctaaagtaccggcttagagctgaagtggtcatgaaagttgtgtaatccaacagattgcataagtcagttttgattttagctatttcctggaagtatttttattttatagctcaccaaacaagggtatttaaggatttttttttccccctatcagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagtgagcaataacaaaaactacagtcttgtcatgaagttgtatgtttgggacgttttagttaaatgattttttttctctgtttgtctcttactctcccaattactttcaacctttggattattgtataagttatattgaaaaagagagagtgctgtgaaactgccataagctacctccccatttttgttgtgaaatctcctgtccctgagctcttcaaagtagagaactagtcccactgactgacatggccatgaagtggacgccacactggcctctcctacctgtgctgctttaatattctttaatgtccttgtttgtagattcttcatctgtgcaatttctag

SEQ ID NO: 9119 - DNA, 1053 bp, Homo sapiens
gaagtaagaagttggtgtgctgcctgtgtttttgactttataactcccatttcatgtgccaccttgaaaactggcgaagagacctctgcagcatctgttgccaggcatgggggccctttgaaggaggaggtgcaaaataattagtgtgatgaagcgttcagaaagatcgtctttcctcatcattatgggagctgggaaaggattatataccttttgtttttatttcttatgatgtatagctagataaaagtgtttcctctttatgcagaaagttgacctgatgtaagtgttctgtccactgacttgtggattttcttctattaataatgatcaaaaagcacttttcttagaaatgtaagtagaactttaattggaagggttattgcaaggtttctatattttaatactagaataattattattggcacagtcaaatattaaaactgctgtctagtgatccatgacactctaggagagaggagcgttaatcttgaattccaaattaatgtagcatggttggcatgaatccagaaatttacatgaggatggtagagaatcccatcagataacgctctggttcaaatttaaactaaaaaaaagaaccaactcaatattttcgtttagtctaaacagttaagtgttgggaaactcctaattgttttgtgcatctgttctttatattagagttcctgatttccagttgaagaaatctgtagatttcttcagctttgctctaagaataggggagataagggtcataaaattttaaaatatcacttagtaaggaaattattaattgcaaccataggaaaaattgccatccagccttctccagaatttttgtgtaaataagtaaaatcaaatgttaatgatatccagaaccaacaagactcaatggaaggtttactttttgttgttgtaagatgtagtatattaaaaaagattgaggccagtgtggtggctcatgccagtaatcccaccactttgggaggaggctgaggttggaggatgtcttgaagtcaggagtttgagaccagccttggcaacatagga

SEQ ID NO: 9120 - DNA, 1542 bp, Homo sapiens
aaggaagcagatgggcttcttcccttcacagcttagggtcacctctcacctggaaatgcaatgaccttctggtgtttggtgtttgcaaagtgtgcagatctgaggaatgtttaaaactttcctttgggcctggcatggtatttcacgcctgtaatcccagcactttggagaggccaaggtgggaggattgcttgagctaggagttaagagaccaacctgggcaacatagtgagaaccccatctttatctaaaaaaaaaccaaactatcttgtatatttagaatttgtcagtgtgttgtcaatgaaatatttcatatttacaccatttgctttttaactgtgcttctatcatattttttcccgttaccatctattttcgtttttagttgtgttgttagccagcatgcaattaaatcgacggtgaatcattttagtggcatatgaggtggtaactagtctattttgcagtgttttgaaatactgtttttataatttacatcatctactaattaggtaacattttaaactctttgactgttttatttgtgggcttgtgcttatttctgtccagagaattcgtaaaaacagttgtgtatgtatatatattttttctggttttgtaattctgtatgctggctgacagtctctatgcttccgtcattggttttgatttcctgtcatccttttgttttattattttagccatctccagattcatttttaatccagacctcaggtccccatcagtcagtagtttactcatccacctcccctcccagttccaccccatgctatagcgattcttcacagcatgctcaggtaaccacgcaactgtgtgtgttcgatcatgtttgtgagtttgtgctgtgatgactttattaatgggttgtttttttctcagttaaaagtatctttttctcaatggtaatttaaattagtgtattactatatagtaagtatggatacaggcaagacataggtgtttaagagtttttttactcaaattatgtaggatttgtgtaattcataagtgtttcctacataactaatctaagcgtagaattaatggaagctgtttacacaaacagtatgctttctggttctgatgattgtgttcaagactgtaaatctcatcagcctgttgagtctcatcaactatctctaataggttatttttaaattaaaatatcttatgtgaatcataggatggatgtaaagattctacctaatattatgctagcttttgttcttatatattttcacaggataccttgctttaagcaataaatttatttttgaaaagtggtaaatcaaattctaggtaaggattttacattaatgtccaacaggtgattaactaaaagtaggtttgttcagttttataattggtattgcagtaacttcctcatccgttggaatatttttaattataacatggattttattaaagaaaactaagttatagagaggtttggcttagaatagatgattgttagggccttttattatatagaatgccatattttaataaaacacatgaaat

SEQ ID NO: 9121 - DNA, 1118 bp, Homo sapiens
ttcatcagttgctatgagaaagaagtgttgaattttttcaactataattgtgaatttgcctgtttccccatttagtcctgttggttgttgctttatctcttctctaaaactatattttaactgacttttactgattttgaaatggattttttctttaggaaaacaaagtgttaaaatgtaaaccaaccagagataattttagtgagcagtgttgaattgagccttcaaacttgttcatgagtcgtgatcaatctttgtcacattattatactaaaaactatctcagagaggaaatttatagccagttacagtttttttgtagtttgatttaaaagttaaatttatcacaacgaatcatatatttttcatgttactattcctgttgtataaaaattttactaacaaatttaaaaggtgagaagagatcaaattattttgcaattataaaattatcattagtttagcctttgagaatataggtaatagattaaaaattcattttaaaaatgatataaactacttttgagacttcctctgtaactgaccttttccatttatgaaaagcagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacaggtaacttaatggagatagttcttaataattggctaagatttttcactgttaccatctctaaatcatctctcttttcttccaaatagaaacagtttccagtgtggaattatgtgcctgagaaggttaaattatgaccggaaagaactggaaagaaaaagagaagaaagtcagagtgaaataaaaggttagtacatgacatttaattgattcggtttactcctacttgctggtgtgtttggagcctcagtgacttcctatttttcaaaaaatcaagaaaggctaaatttaagtggagaaaactaactagtctagtgtcattgcagaggagggctggatgaagttgagtgcttttgagattctcttccacagctagag

SEQ ID NO: 9122 - DNA, 1668 bp, Homo sapiens
cccatgaacatgggtggggcccccaggcacaggattgtgaagctcgcaagtgcccaccccgctcgctggtgaagctgtgtccgggaagatgagcagagactgtgctctgctaatctctccccgatgagcctgaaaaagtaccaggcaaagacacctgccgcctttctcctttgccttgggggtgaaggtggcctcgccagccctgcagggactcccatcctttcttgcagccaccttctcagtggtgggaaccatgggcagctgaagtcctgcaggcgggcagccccctcgccagggcagcatggtgccatggggcggccggagaccaagcatcccgtttctctttcctgcagccgttgcttcatttataaatgggcgcgttgggacaagatggactggttgtgcctttccgttctgagattctagttcatctgttttctaaaatcctggcaaaagcagatcactctggaaattcttgccatgctttgggcattgacagaaggttccaggggcactgttagtcctgctacaccccttggcagacggttcttccccaagagacaaagtcgcacctagaaatttgagagcacgctgccctgattggtccctcactgtcacattggatttggacttgagacccagccaggctggagggagaggagccagatgggacattctcaagctgcgaaggggttttgtccagtcctgattcagggcgctagagtcccaacatggcacctgagaaaaagtgaattgggtgtcctcagttcagacccctgggcacagcttatggttgtttgatttaaaataatctctcagttgctctgtggcctatgtgtaattgtattactatttctgtggaaaaggaatcacttctttttatacatagtttgaaaaaaaaaaaaaaaccttaaaattttatattttaccactgcagttacaagaattgtcttgttagggtttacagatgtgccattgttctgtataacagagaaaaccttccagtcttcaagggctgagggagaaggtggctgcccacttgcagagctgcctgatagaggaaaaggtggcattttatattcctgttttcttccaagtagagagtaaagcaattctccaataaactacttgaaacatttattaaattgtaagtctgaattaggaaaattattgttatggtttcagtaagcacttgaaatcaaaatgggtgcactttttaaaaatgtgtgataaaatacacataccatgagatttaccattagtaacatttagtatatttataatacataatccaaaatggtgcttttatttttggttggaaactatcatcatatgattgaacagaacaggaatatgttcttaatgaataaataagtgcacacacgacttttttattttccagaaaattttctcactcaaggtgaagccaaatagtatttccagtatatttctgacgtcaggtgacggcagtgttagaaccccgaggtgaaatttcttttactcctgtggttgtcagtcaggcttatggatcatgaaggattggctggtcctgcagcctcgtcctcctgggttgcctagaatctcggtagttttggccaaagggctcatctgctggcctctgtggatggcgccctgaggcctccgtaaccctccccggctgctctttca

SEQ ID NO: 9123 - DNA, 1031 bp, Homo sapiens
aaaatacaaaaaattagccaggcatggtggcgggtgcctatagtcccagctactcgggaggctgaggcaggagaatggcgtgaacctgggaggcggagcttgcagtgagccgagaccccgccactgcactccagcctgggcaacagagcaagactctgtctcaaaaaaaaaaaagcctgcaccaaggacccgggcctcccaggagtcgtgtcgccttccttggctccccagatgggtgtgttaatgtaaggtttccctgcactgaccaggatgtggcctcccccagccctgctctgggaggaagtgaagcgccgcagtgttgttggtgtctaatgctttgtgtttgaaccctgttccagtcagctgtcggccacgaatatcagtcgaaactttccaagcactgctcgcaggtggactcggtccgtggcttcggaggcaagtttggtgtccagatggacagagttgatcaggtgagtgatgtggcactgggactggggcaggttggggcaaggggggcgttccccgtagatctgagccctgttgggccacttgtagtagcaggcaggtgccctccagctctgggggactgcagagaggggcatctgcctcccaggatgctctgagagcctgggctctcagagagaggaagcaggatgcggcgggcttgctgtagcagtccctgcggtcgctcttcactacgtgcctcagtactggatggccctgtgtctgtcccaatgtgccagcagggaccgtttccacccgtgtttctcacatgtgtgttactgtgacagagtgacatcagagcctataccgggggggcaggatgcgctcgtgtccaggacccaggctttgcgtccaggtgttgttgcagtcatcctaggcccgagcctctttgattctcttcggctcgggtctgttggctcttttgtttaatagaggagcgatcaggagcctggagggagcagggagctgatgctggtcgcagattgtggctttgtgacatattagccacggttctgaatttatgtgtc

SEQ ID NO: 9124 - DNA, 1033 bp, Homo sapiens
gcagttatgttgttaccttcaaaatttggacttggttattagaacctgaacacataattggaaaaacagtaattccctaaccttgcagggaagactctaggctttccacctgcagcgttagaaacacacagcagtgttcaggtgtgggcaggtagacacacctggggtggtcccgcagactgcatggagatggcagtggctctccgtggcatcactgctgcatgacagtgtgactttcatgtggatctgtgttgctgcaacggaagtctttggctggtagaatttccacatggattttttttttctcttaaaaagcaagagaacaaactgcgattgagcctctttttagcgctcagtagagcaggcgcacaggaagcagatgagaataagcccgtgctggtgcggaagactgtgctattgaagtggcgcgttgcaaaggcctgtccgtgccctctttcctcgcttagctcctgcctgctgcccgccgcccctcctgcccctcctgcccctcagggaatgctgaagcctctgcccctggcctgtgctctgcttctcactgcctgtgtctcacgaccatgggtggaagcaaaacttgccttgcaagtgaagcctcgcttggccattctcgtttcttcccgctgtggtgcaccttcttgggctgtttctggatctgtctgcatgcacccacggccacccccatgctcgcctccacctcagagtaagtgttgtgttttgccacgtttcagactactccaaaggattcggcgggaagtatggggtgcagaaggatcggatggataaggtaaatattccagccccggagcttagtgtcttctgcctgcaggggctcttggtgggcgtggctcaccgtgctggccaacatccacgcgctggggtggggcacaagtgatttccgtcgtggtggtggtggtggtggcgatgactgactcggacagtcttgtgctcctcatggccgtgctgtgggataggcgctggcaccggcccacctcctaactgggggccccaggccagg

SEQ ID NO: 9125 - DNA, 1603 bp, Homo sapiens
atttcagggaaaaacgctattccatgagaaaacagtcaacttgcagctctcatggttctattcatggtccttgagacacagacagccaccgccacagtcccggacacagcagggaaggctcatgtgtcttcccactttttttttttttttttttttttttttttttgagacagagtctcgctctgtcgcgagactggagtgcagtggcacaatctcggctcactgcaacccctgcctcccaggttcaagcgattctcctgcctcagcctcccgagtagctgggattacaggtgcctgccaccaagcccagctaatttttctatttttagtagagacagggtttcaccatgttggccaggatggtcttgatctcttgacctcgtgatccgcccaccttagcctcccaaagtgctggaattacaggtgtgagccaccatgcccggccatattccccacttttgacttaaatttttatcattttttcttaatagacacggggtctcactgtctttcccaggctggtctcaaactcctgatctcagtcttcccgtctcaacctcccaaagtgctgggattacaggcatgagccactgccctcttttccatttttgtcacacacaatataaaaaaatgtatactctggttgagatttactatactcagtatacgtcaattacagtatacatcagtaccttaactgctttatcaaggacagatgtctttaagggaaattggctgtttttatttaaaaaggtgagtgtggtggtgaagataccgtcttatttagagatcttcctgatgccaggcttagggggattgccagtcccaccaggtacgcagtgccctgcggcaggtgcccagtgctggctccggaccagtgggctgagctggcagctgcaagaacctttccctccttgggggttagggggatgaccggttcctggggaggtcactctgtgtgggtggggctgttgtccaggagcagtgtttttgctgtgctcaaggcacacgtcctccctccttcctctatagtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggtgagtggcaaggagtgggccgcagcgcaccctccctgggacctgtgccgaggggattgggagctctggggcctgggcggggcttattctctcctggccaggttttccttggaaggcatgtttaactctcctttaaggctctccattaaggcacttgtcacttgcagccacacataggctgagtctctggccacaatgctccaggcagccggctagcgctatcctggtcttgccggtccagccccaggacccgccaacctgccctgccctctgtccctgagctgacggcagagtcttgtcggcttccacctccacggggctcctgtccaaatgtcagcctgagtctcttctcacccctccccctctggaagcccctcctttcccaggtggaagtttggggtttggaggggactctgtgcaga

SEQ ID NO: 9126 - DNA, 1194 bp, Homo sapiens
cgtggattctcatcaccgtggcttttgccctccattcccatttcagccatcacctcgggcttctctccgggtgtcccctggctgtccttccactgcggcctccgcagcccatctccccaccccctccacagacacgtctgccagagagaggggaagggagggcaggcggggctggagttatgtggtggaaacctgctcctgaggaaggggtccgggtggggttggtgcttgtgtgaagggctctgtgcctctttgtactctctcggttcatgttcacaaatcctggccttggtggcatgggagaggcagcaggagcctccgcggtggtccgcatctctgcagggggcatctctgagcaggctgcctgggagcttgctctgggttgtgctttttttctggcagaccaggaaacgcttgcacttcagcatctttctctgtgttctcttccccagcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctgg

SEQ ID NO: 9127 - DNA, 1062 bp, Homo sapiens
ttagctaacgggagccccttcaaattggcttcttttttcatatgacatgtatctaccatcctttgagtacttacttattttctgggacaaccagatgttcaaggatcctccccttctctgcccaggcctggcatcagccattgttggcaggagataatttgagcagatcgtgtggatttcagaagcatgaaaactactgtgaggattaaataagttagcatgtataacattctggtgcttttgtggagtttccaaattgtcatgaacaagcactactttatagacaggaaaaaaagtgattcaaaatgtgaaaacgggtatatgtacataaggtaaaaataaaatcctaagccccccattgaccaaagggaccttctcctgaccaaggggacaccagaaaaacctcaacactgaattcccagacatgatgggatgggaggtcagatgcgcctggtaatagccccctgtttcagagtttggacaccacaactggccggcattcatgttaaaacagagatcgtaagactgacagaacggactctgtggcaataagataccaaattataaacaggacccaaagccatgctaggcgagggtaagtcaggcaacccacacttagagaataaactatattctaagagccacaaggctttctgtttctctattagccaaacacacactagccttgggatagggaatattaaaacaattgcagctccactaggtgccaactaactgactctgtttcaccagccatagcagctgtgattggacaagagactgatttcagtgactttctcctaataagagaccaccgaccagctgaccatgccgaccagctgacccgttaatagagagagatgatgcacctgcatgcctttgtgtcctgaaaagacgttttgccataaaggccctaattgtaagatgtgtaaatgttaagtctccaccccaaagtgaacatgggtcatatattacatgctttgctcaataagagggcatgtgtcaggaccaccttcatgaatattcatagctcctcctgttacctgttgaatatgtatgttt

SEQ ID NO: 9128 - DNA, 1004 bp, Homo sapiens
gcaaggaaggagcagggacagtcctgagagctgtggacacgccacacccactgttgggcctggttaatgccattgaacacctgagcaagggcaggcccagggaggctgaataagtctagattcccatgttgagtaattaaaagaactgacttttaccagatgaaggccagtttcaaagttgggctgcttctgtgttaccactgcccttttgctgtggtctgaatgtttgcgtccccacaaaattcatatgttgaaacctaacccccagatgatggaattaagagatgaggcctttggcaggtgattgggtcatgagggcatgagagtggagcctgcatgaatgggattagtgctcttacaagagaggcccaaaggagcttgttggccccttctaccatgtgaggacacagagaaggagacaaccagtccttaccagataccaaatctgccagcaccttgatcgtgggcttcccagcctccagaactgtgagcaatacatttctgctgtttattaattacccagtccaaggtgttttgttatagcaggctgaaggaccaagacatattcccaggttttcattccgtgatctcagaatctttccacaagcaagcataggttatcgtttcttatatgcctttttgtaaaaatcaggaaaactgattgcttatttcccttcttgtcccttcaaaaacaaaaacaaaaatgaaaacaaaacaatgagtagccacgttgtaagtctcttgtaagcgatagtcctttctcattttggatgtcagctgccatctgtgctctgctagtttcccgttggtctttaggcctctgacccgttgtgggatctggaagttcctcttcagtctttgtcccctgccttagtgtgtgttcttgcttctggacttagagtaagcaggaactgtcttctcttaggaggttttgtgtgagtccagaggcatctttctctaagtccttccaagtttctttccttcattagattgatttctctcct

SEQ ID NO: 9129 - DNA, 1068 bp, Homo sapiens
aatggtgcaggcagtaaaggaatttaccaagacagttgtaggtaaagagaggcagatttattagagaaggtatgaaagtatgttacaatatcgcaacaggcagcacagcagagaaggggctgtctgcagagaggcaggggctggagggaagttttatagcattgtgctggagggggctacattggggatgaggtagaactgcgggggccactgcggaaggaggtcattgtgcctgtgtaggacattgtgccctcagaacaactgttcattgttctccacatctggggccccatactcattgcttccttatctgatcaggcctctgcaagtagaagatgcacagaaacatggactagggtctccatcccctggtgccagtcccttatatgcctgatttgatgctgctgattaaattgtagccatgttcagcgcagatcacatggaactctcagtcatcaatcagggatatcagtcatgttaggtgaagtgccacttccatcttgaatgatactgaatttccatcttcacccggttgacatttgggtcattctttgtcatggggcgtcggccatgtgcatcctcaggcatttactggcatagctggtctccccacagatgctcccagttgtgacaaccaaaaatgtccccagacattaccagatgtcccctggggggtaaaatgccccggttgagaaattctactctccatttttattacagttatttctgttttttattgttgttattgtaaatggactctttaatattatatttttaagtggttaattttttatataggaaaacttgatttttatgttgcttttgtaattgactacctcattaaattctcctattgtgtctgttggttagtctgttgatttttgtagtttttcttttaagttgaacttatataatatacaatgaattttccttttcctttccagtatttgcacctcttggttcattttcttaacttttgttggccagcatttctagaacaatgttctagatcatttctggagcaaaattctttgctaatgggcaatttcgtctttttcctgactttcc

SEQ ID NO: 9130 - DNA, 1049 bp, Homo sapiens
tggcctctgtagtgggaggtgggggcttggctcccaccaagatgtactcaggggcgggctcccccagatcaggaagggggttcagacactatgcagccaaaagagtgacgcatgtgggagcatcagagacagctgcaggtaaaggtggagacgctgctgtcatctgcagtgacagctatgcgtgatctggacccgcccctccaggcttttccagcacacacgcccagcatctggtggggactctggtaatttactttttcacctctgggacttgtgacccgcttttggtgcgtgccagtgtttcaacagccccacagtccgtctttgcggggctgtggtgtcacaggcctctctttccaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaggctggaatccaatgcacatgattttgacctcccgccagcgtgcgcttccccgcgaagtctggcattctccgaaggaagccgcctgggtaggagggttccaaccgccgccccgtgtggcatctttgctgcaggaacaagaacagtagctcccgggaagggaggggtgtcatgagcagaaaatgaaggagagaagaccttctctcccacccacacacaccttcctgtcctgggttccagaaggttctggggagatggtccctgcagagctttcttcctgggagtctggggaccagtcggccttactcctgtcctgtgggagaaccaccccatctaggcatggggccaggtgtggggcaggggcgtggcactgtgggtcccccttcctgctgatcttcatgccattctgggcacctttgtctctttatggaatggggtgaggagcggctttt

SEQ ID NO: 9131 - DNA, 1033 bp, Homo sapiens
aatttattgtaaggacaaattcaaaagttggaaatcagagatgaaccaatgtggatcttccagtgttgactcaatatggggcaaacattttcccaagaaagagatagaggggagaaagccagagtggaaggattaccccgagggctctaggcacaggggtgtcctggggattgtgagaattaaaatgtaaactcctcacctaggtgacaacggcacgtgggtgcgaaatttcaggcatgattttttttcccatccagctcccagactgagagagactcattttaatgccctctgctgttaccaacatacggaacctctcgaggcaactctttcatggagtgggaagccgttcgatgtctcagctttatgctgagattcaattgatttagtcttcaccatgaagttcttaaatccaaggccccgaagttcctagaactaccagatccctcagagtattcaccctggcttcatgcttcctaatctcgtggaatttctctaatgctacaggaaacacagccatgcacttaaacagatgtctgtttttaccaagaattttcaatcatagccagaaacataccgggttcactgtttttccagaagtggatgtctaccttagagttttcaggaggcttcaaaacatggcaacctgaagtccctagcctccagtagaaaaattctttccttacatttatgacagttttgccttatgtgttgtgaggagcagtcaagttccggagacagaaatccggaagcacacactgtcagggtccctgttccttcccctaggtcgtatccatgaaccatcccttcactgctgccttgggagaggggaaggtgttcgggctgaggatgagatcaaaccaaagtttaaccacacctcagcattctatgacttcacatcgctgagtccataagagaaccaggaccctccagacccagaaaatacttgggtggatccaagatggcctggttcagccaagatggctgaataggaacagctccggtctacagctcccagcatgagtgatgcaga

SEQ ID NO: 9132 - DNA, 1031 bp, Homo sapiens
gatgtatcacatgcattgattttgtgtatgttgagccatctttgcattcctggtataaatcccacttgatcatggtatattatctttttcattcatcattagatttggcttggtagtattatgctgagaatttttccatctgtgttcattaggaatattggcctgtagttttctctttctgttgtgtccttgtcttgattggatatcagggtaatgctggccttatacaatgagttaggaagaattccctcctcttcaatttttgggaatagtttgagaagaattggtgtttgtttttctttataaactgggtagaaatcagcataaaaccctagtctagggcttttctctttggggagacattttgttactgattcaaacctgctattcattttgagtcagttcaggttttctgtttcttcctagttcaatcttggtaggctgtgtatgtctgggaatttatccctttcctctaagttttccaatttgttaggatatggttgttcatagtagcctctaatcatcctttttatttctttggtaacagttgtaatgtctcctttttcatttctgcttgtatttatttgggtctcctttctttctttcttttttttttttttttggttagcctcactagtggtttatcaattttgtttaacttttcaaaaaaacaacttttgtcttgttgattctttgcatttcttttttgtctctgttgcatttggttctgctgttattttttttttctttctactaattgtgtgtttggtttgttcttgctttttgagttccttgaggtgcatcattagattgtttatttgagatctttctacttttttggtgtaggcatttattgctataaaccttcctcctagtactgcttttgctgtatcccataggttttgcatgatgtgtttccattttctgtttaaaaattttttttgatttccatcttaatttcttcattgacccaatgatcattcaatagcacatttaatgtccatgtatttgtacagtttccaaatttcttc

SEQ ID NO: 9133 - DNA, 1088 bp, Homo sapiens
tgctcaccataacctccgcctcctgggttcaagcgattcttctgcctcagcctcctgagtagctgggattataggcatgtgcccccacgcctggctaattttgcatttttagtagagacgtggtttctccatgttggtcaggctggtctcgaactcccgatctcaggtgatccgcctgcttcggcctcccaaagtgctgggattacaggcgtaagtcactgctcccggccttaattcttctaagaaaccttttatttgaatttattttatcctaaatttattctcctaccataagcttttgtttcatccatttcttctgggatctttttcttctgtgcaaccacctcttctggttaaggaacaattttttcctttttggtaggatcatctcagtgtggcaggggagctcatgtataggttaatttggttttgagctctgtaaatatggcagtgcatcttgggtgcttcatgcacctggatatgtttgatgaccagataatctattaatacatctaaactcttttttttttctttgagacggagtctcgctctgtcgcccaggctggagtgcaatggtgtgatctcggctcactgcaacctttgcctcccgagttcaagcgattctcccacctcagcctccccagtagctgggattacaggcacccgccatcatgcccggctaattgttgtatttttgtagagatggagtttcaccatattagccaggctgatctcgaactcctgatctcaggtgatctgcccaccttggactcccaaagtgctgggattacaggtgtgagccactgtccctggctcatctaaactgttaagttcagcattactctgcatttttaagcatgtgcagcaaaaattcagtctttttggtccactaaccctgtgcccagcctcactgtttggcttaggcacacttactgactccacagttggaacaatggaatggcttacatggcttctataaagtgacatctttcagatactttgtggctttttggatttgcaccgccccccgcaacttccctccacccctatggcctgggcagtttcttgactcttaaagtgaatatgaa

SEQ ID NO: 9134 - DNA, 1641 bp, Homo sapiens
taaacttccttgagcctttgaggaggctgtttacctgtggatactgagggtaaagtcactgttggattagtataaagttgaagcagtccagactttttaggctttaactagtcttaaggatttctgactctggcagagagggtggaatgaataaagcaagactttaatcctggaatcagcacacatttgcagcgttactcctttactgctgtcataaatattggtgactaagcgtatgagactttatgtctataacctctttgggttactttctcgttccagcatcaggttgaaatagacttgaaatgggcaatgatgcaggtttctcctgggacctccttcatgctacaggaaaggtgtcagctgtttcttccatgggggcaggcagcaggccacttagctctaattccaatatctaggcttggttgctggggggtccgtagagcctgtattctatctcgacatgcctgtctgttagggtgtgtgtcctagcccctaatttgtgtggtaccctgcagctatgaagcagggaatgtgttctgagctatgtactggtgggatatccctggaaagcactgtccctttatcactacagcatccctgacttgattcaccccatgtgtttggctttcagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatgtaagccactttgcctcttacttctttgtctgtcagtcatcaagagacccttcctaagtattctaggtcccagcctaacccaggccacatggaggtggagaaagacaataacaatgaactttatgtatgaatgatgaatagtgtattggcgagtgtgtgtctaagggtcaggtgattcagagggtgaaaaggatagaacataagactatgttcataggcagaaaagataggttttcccttcgaaacattgtgggacaggttcatgaaggagataatcatcaggaactattcaattggagagagcaaagatgaattgactgggaaaactaagcatctcatgaatcttacaggatctagattacactaatctaaatttttttaaagaaggatcgggtgtggtggctcatgtttgtaatcctagtactttgggagattgaggtgggcagatggcttcagctcaggagttcaagactagcctgggcaacatggcaaaaccctatatctacaaaaaatagagaaattagccaggcgtggtggcatgcgcctatagtctcagctactggggaggctgagaggtgggaagattccttgagcctgggaggtcaaggctgcagtgagtcgtgatcgtgccattgcactccagcctggagacagagcaagactctgtctcaaaaaaaagaaaaagaaaaaacagtaatggttgaaattaggtggggaaaatgacacacagaaaacaaatagcaaaatggcagaagttaattcttccttaccagtaatcactttaaatataaatggattaaattcttccattagaagacagaaattggcagattggttttaaaaatcccctcatttatcgatatgc

SEQ ID NO: 9135 - DNA, 1098 bp, Homo sapiens
gctcaagcctgtaattccagcactttgggaggctgaggtgggcggatcacaaggtcaggagtttgagaccagcctggccaacatggtgaaaccccgtctctaataaaaatacaaaaatagctgggcgtggtggcacgtgcctgtaatcccagctactcggaaggctgaggcaggagaatcgcttgaatcagggagttggaggttgcaatgagccaagatcgcaccactgcaccccagcctgataacagagcaagactccttcccaaaaaaaaaagagttttatagtcttagctcttacatttggagttttggtccattttgagtttttgtaaatggtgtgagataagaatctaagttcattcttttgcatgtggatagccagttgtcccagcatcatttattgaagagacttctttctccattggatggtcgtggcatgtcacgaccttgtcagaaatcaattgatcaaagatatgttggcttatttttgtactctcagttttattccgttgatctatatgtctgttcttttgcaggtaccacattgttatgattactgtagcactgtagtaagttctgaaattggaaagtatgttcctcaactttgttattatttttcaagattgtttcagctattctgagtcctttgcaattccttattaattttaatatcaacgtttccattttacaaacaaaatcagttggaattttgataaagattggtttgattctctagattgtttggggaaatgtttccatcttaacaatattaatcttccagtacctgaacacaggatatcttttcatttatttgggtctttaatctctttcatcaatgttttgtagttttcaatgtacaagtcttgcacctcctttgttaaacttattcctaagtatgttattctttttgatgccattgttaatggaatttttaaaaatttcctttttgaattattcattgctaatatatagaatttcaactgatcgttttgtgttagtcttccaactttgctgaatttattagctctaatagtttttaaagttttttttaggattttttatatataagattggtcatctgagagtagagtttcactt

SEQ ID NO: 9136 - DNA, 1022 bp, Homo sapiens
accattaaattggagagttggacctaaaatgaaaatctgattcttggttaagtgttctttctgtaggttcctctcaaaggcttcaggaaatttttgtcaatttctgccatagtcagaagtttttaatcctcttgagtttccttatttaacgacttttgcccaagtcctttccttggatctcaggtactttctcaacctcctcttaagtctcttcatcatcttgcctccccagcctctccagatttccccacaaactcagtgaatgatgattggtaggcagcttaagagacagaaaatctggattggaaacctagcccaaaccagacttgccttttggcttctgcgtagctcagttttcatcatctattcagagtctaacattactctttagctccttcagggatgttaggggaagggataagtttatgcctggaaaagtatccatcctatttttgaagttctccagggagaagctttcatcatctgtgtctactaccaaatatagtatctcttcacatctctacctcctgaactgctttccctcctggaaccggtgagtggcaaaatctcctacctggaaatctttaaagtactgtagatttttcttagaccaagatattaggattactagaatgtggaattagagaattctgactaaggtggtaaggggttgtaattcactttctatgagaaggaaaaacttctatcttcagaatataacaaaaacttgtagctgtggtatctttatcagcctcctttgagtctcatctacctctttaggctcatttctcacaccttcctcaaatactagttgtcttttctcaagtataccatgtcccctcatcctggaacacccatcatgatgcctttttctatctggacctattggccatcaagacagagatcaaaggatgcttccttcaggcagccttccttggaggggggtgggttctccactttgagtggagtgcctctcctctgtattttcttggtcaccagcccttactccattaaagcactta

SEQ ID NO: 9137 - DNA, 1110 bp, Homo sapiens
agaagggagcaggggagaggatgtgcattccacgttgtgtgcagtcccgtttggatagggactgagtggtgagcaggagagggagtcggggcagagggactgacggggtgtgtggggatgcctggcagcttccttagggcccctttcggtgctttggggttctgcctggccgtgtatgggtggtgggggcggtgatgggtggtgtagagaggaaggcttggggaagcagaggctgaggctgtatgggaccttgccattatttctgaaccaatgagtgagtgtttgagccctggctctgggcttgagccctggttacctggctgccctagccctgagctatgagtgctgagtgagagcagagccagacttggtgcttctctgagtgggccaggtcctgtggctgtgcctttcagcccagtgtggttggtagtggtgctggggtgagttagcactcttggttttgcagccttctagcggctttgtacctcctgccctgcagtctgacattgagttggcttctgtgggcccagtgagtgggaatctgtgggggctgctttatttagatcagttatttagatctttatttagatctttcttagctctgtgaaccccctcccaaactcctgtcccactgtaccttccttacccctttgttctcctgacatctttggtcggggcgcacattagcctagaccaggggagacctttttttttttttttttttttgagaaagagtctcgctctgttgcccaggctggagtgcagtagtgcaatctcggctcactgcaacctccgcctcctggattcaagtgattcttctgcctctgcctcgccagtagctgggattacaggcgctcgccaccaagcccagctaatttttgtatttttagtagagatggggtttcaccatattggccaggctggtcttgaactcctgacctcaagtgatccacctgccccggcctctcaaagtgctaggattacaggtggagccacctcgcccagctggggagacatttttaattgtcacaactgggatggtgctattgacatctagtgggtagaagccggggatactgctaaacattctacagtgcacaagagagtccc

SEQ ID NO: 9138 - DNA, 1055 bp, Homo sapiens
agctgcatcgtgcctcctactccactgagtgtgggaggcccaaacggctgcccactgacccctgcccacagatggggaggatgagaagcccccgctgcccccgcgctctggctccaccagcatttctgcccccactgggcccagcagtcccctgccagctcctgagactcccacagctccagctgctgagaggtgagacccccatcccatccactgaacaggagaccctttctcctctgagaactatttccctaccaaaggtggggaggccttctaagaccccaccagggacccccaccccacctcagcccagaggcagataacctgatccatcccgccctggttgccacaggtactatctcctctagggatggggcagaggtgctgggacaggtcagcaggacctccactgacttcttaacccctccccaaagtgctcccaatgggctgagcaccgtctcgcacgactacctgaaaggcagctatgggctggacctggaagctgtgaggggtggagccagccacctgccccacctcacccgtaccctcgctacctcatgccggaggctgcacaggtatctgggacatccagccccatgtattacacccttacctctgacctgtcctcacctgcttcccggctgcacaggtgccctgatctctgatcctgaacagtgaactagccattgcctcttgactttcctcactggtagcctttatccttgtggtgaggttgaggctacacccagcgcccccttccctatacttaggtcggggtgggagttcttttgatctgatgtcttccctagtgaggtggacaaggtcctgtcaggcctggagatcctgtccaaggtgtttgaccagcagagctcgcccatggtgacccgccttttgcagcagcaggtagattgtagggagacctctgggaggtgcgttcgtgttctggagctgggtgggaggctctgcttaggtgactcatgtacaagcctggttcttcctccccccagaacctgccacagacaggggagcaggaactagagagcctggtgctgaag

SEQ ID NO: 9139 - DNA, 1046 bp, Homo sapiens
tcctttcccaggacagggcactggaggttaaggagcagatgtggaagggaaggggtggatagatggggagggacgccttcccccaataaaggtcccgatagctccatctttcttagctgcctgaatcactgaggtctcactctgggtttcttggtatcccccgcctttccctgtctccctgggatggggcctggtgatgagatgtccaacttctgggcaggccagaagggcaggaggaggaagaaaagggccagggcctttaatgccagaactgtctacctggaaagactcttagaaaccagccatgttttctagccttcctcacccctgcatcattcagatggggaagctgaggcccagcaaggggccttgcccaaggccacacagtagtggactagagccagaaatcccccccatgcatctcaccattgctccagcctcacactgtaaggggtcactgagagttcttgagaagtgcagtgacgtggttcacctggcattttagggaacttgtctgagccagggcaggaaagggaagcccctgtatgtgtctgaggccaagaggggcagggaggtctcagtttgaccagagcacctggggagaggctctgtgtgggcaggaaccaggttgaaagcctcaagtgccgagttaaatggcctgagcagaggggctcccctctgccagctcccctctccctttctgggagaggaagggctgggagcactgccagctttgcacatcacagtatcctctggttgtgaggtgatgatctgacatgagggtgcgggaacatgagtagcctgagcttaggtagcagaggatgtggagctggcgaggggagaactgactgggaagacaatttggaggcagaatctgggaattcgaatttaggttcaggggttatatcagaaacagggttgggggagcgggactcacttcttgtctcggcagaaatttcctctgcattctgaaagagtgaggtggctgtgagccctgcctctgtgcccagcaagcctcctgtctgacctcaaaccctctgctccag

SEQ ID NO: 9140 - DNA, 1025 bp, Homo sapiens
ctccctagtctaggagagggtggcacttgctgtagaatctggaagttctgtcttctgctgtcgtcctctgaaaatgctgattacattctaggggtgggggacagggtgggggacagtgtcaggcactgttctgaacacttcatggtgttctgtcttgttgaatcttcgcagtgattctgagatgtagtgactgtgtttcagagaaaggaactgaggatcagagaagcaaagtgacttggccaaggtcatacagagtcaggacagtgccaggactggaattcaggtcttctgaccccagagaccagtgagatgctgggagagaggatcacccaccttcctaataactgctcatggctttcctggacttctgtctctcaaacttgggctagtaggcgtggcctagccagggcattacattgtgagttctaagtatgatgtgtgtgtgtgcacacatgtctggaacactggggatgggtgggttacatggtcttcctgttcctccccagacttcactcccaaccagacatcaccagaaagtcctgtcccctgccttctagagcctggacctggctttgggggtgtccccatggctttgaagagtgtatggagttagcagcacagcctaggggtagcagggaaaattgagagtcccaggtgaccttcatcatacttgagaggccccctcccctttgcagttgctctagaggcatttccccaaatccacctgcatgttatggtggggagcagacagggagtgaccttgagctggtccctactctctctgggcctcggtctccctgttcttcccagagaccccttttggctctgaccactgttgccacttggccaagaactggaactggggatcagggtgtccctcggtcctctctgcaatgactggagctgtgcttcttggggctgatgaaaatagctgtcgtggtctctaggggctgagccggagttatttccatcctcaacaaagaggtggaaatagcttagggcctgggagggggagcaagaggaga

SEQ ID NO: 9141 - DNA, 1127 bp, Homo sapiens
gagatttgcacccaggtctctggtgctcaccatgacctgaggcagaatgtgtgctggcgggtgggggcaaagactcacggccactcctgtgggtagggggcaagtgtagtgcttgtcatggtcctcgacatcttgagccagtagaggcaactgtccctgctcaggccctgtagtgtgccaggctctgggcccagcatttcctcacaacagcactcacccgggccctctcctttccaagttggtatgggggaacctcgactcagagagcagccctaggctgagtcacgcagccacttgtgttgtagtcaggtactccagatcctacccagcccccagcctggtctccaggcaggaggtgagggtcgaggggtttgtctgacaattctaacattagtttctcaagaagggccaggctggtcagcacccagtctggctgggcgggacctgactacttctgttatggggccagcccttctgccaggtcagcaggagagaggaccagagaggaaggggttttgcctgaggttactcagcagggtgtgtttggcgccattccccactcaggatcgatgggggagcagggatgtggtctctggacagggagaatacccactgtgtgctgaacccgtgtctttctgggcctaggcttggtgctgctgagtggggctggagtggcagagaggacaagagccaatgctgcatccctactctgcccatccgtgggattatggcccgggaggctgtcacatcctcagccttatactcctgggggtcatcattccctccaagcacaggcagggaaaccaaggcctagagagaggaggcacttgccaggccccagtgtcactgggatccaaacccaggtctgctggccttgaagaccagagttctttcctaggccactctgggaaagatgagagctctataaataagctgcccatgtggctgtgagcaagtgccctggctagttgtcacagacagagggggacagcgggacctctacagccagttagagtcagggtctgagtgtgcaggtagagagaggagtgggggcttccagaggggggacctgcgcttagcccagtgcatgcactgtgaggaggagcagtgagaggggaggaccttgg

SEQ ID NO: 9142 - DNA, 1111 bp, Homo sapiens
tctggaggccagagggaggtccacaggctcaggagccactatctgggaagcagagtagctgcctccctacctgccctcctccaggtgggcaccagcccccacctccatctcccccagtgcggcctctcttagcaggcagcctggggagcctgctgagaccgaactgttcattcttctccatcccttgcttaacccttcctggctcccataggccctagggggaagtgcaggctttttggcaggcagctgagccttggtgtgacctgagcactgcccaccaaccttcccagactcctccagactcctcccgtcttctccgccctcccaccctccagattcccaccagggcgaacccagcaccgcctgtataccagactctgtgccaggcactgaacgtaaataaaaggtttgtgcccttctcctccacattccacacgtagggaaactgagtcacagtgaagtgtggggaatgcttactctgtgccaggcctgtgctgagtacttaatgtgattctcttctttcagccttaccacagccctctgcaggcaggccacagagccagtgcaagacagagcagagcaggactgcaccccatactttgtatccccaggttagcccaggggttcagatctgggttctgacccaccccagcctctgggctccttccccctcagcctgctcactggctcttctagctcggcatagctgggctctctaccaagagtgccttttctgccttctcccccaaatcagcccatacccgcccaggtcggcactgggcatggagcaggcagctcgtggtggggaaagggctgggtaataggatctgcatggcaccatgaatgctgagggggaggtgggggagagggtacttccaggaggaagtgacttcgagctgagctctaaggaagagtgggtgctggccaagcgatgaggggagagcagaaagcaggtgcagcgtgtgtgagggtggaaagcactcagcgtggcaggcgtgtgggtgggggaggttggtgggggcgcgtcacgacgccatcctgagggtggtgggagctggcccagggccagggccagaactgggtgtcagggcacctaggctgcagggcggga

SEQ ID NO: 9143 - DNA, 1029 bp, Homo sapiens
gctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggtgagatgggcacagatgcagcaggggcaggtaaagacgtgacagcctgggggccgggagggggaggcagggccccagcttgggccctgagcaccctgctcaatgggagccctgcccttattgggcctctctgggcagtggaggcggccagagagatcaggactttccggttatgttgtgtctcacatggagcccttgcatccctagggcagcatcttggcccccatggcacccgggcctctcaggctaaggctctggtccatgaacttgctgtgtgaccccgggcacgtgctgccttctctgtgccccgggatccccgctaacggggatgattgccccactctcctcacaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggtgagagtcaaggagaaaggcatctgttggcacctgggccaaccctgaccgaagacggggcaggggtggaagtgcagcgggccctaggcaggggccactttcctggagccagaagccagcccctgactcagctctgacccctcacccctgcccaccaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcaga

SEQ ID NO: 9144 - DNA, 1052 bp, Homo sapiens
tcctatcagctttacttgataaaaacaaatattgacagagaaactcagttatgtttttgtttttttaattattatttttttcagagacagggtcttgctctgttgcccaggttggagtgcagtggtgcaatcatagcacactgtaccctcaacctctcaggctcaagtgatcttctcaccccagcctccagagtagctggaactacaggtgtgtacgactacgccttgctaatatttttattttttaaattgattaattaattttttgagatgggctcactctgtcatctaggctggagtgctgtggcatgattatggctcactgcagccttgacctctctggctcaggtaatcctcccacctcagcctcctaagtaattgggattataggtgcgccccaccacacctggctaattttttgtaaagatggggtttcaccatgttgctcaggctggtctcgaactcctggactcaagtgatatgcctgccttgggctcctaaagtgttgggattacaggtgtgagccaccacagctggcctagaattcatttcagttcaactcaacatttaataatttggggctctaggaatagaaagattaatgagacatagtaccttcctacatgaattgtggtagtagtttagctaccataatagagagacctacaataccaggggcttaagtaaaatagaaatttctttctttctgacataaaagtataagtagatattccagctttttgttttgccatacttatcatattacttctatctcatggtttgagatggctgctccctctttagccactatgttcacatttcaggcagcaggaagcggaaaggggaagcagtggtcatcatgtttcttttctctttgttttttgtttttgttgttcttgttttattttgtttttgctggtttttttttttgtttttttttttgagacggagtctcgctctgtcacccaggctggagtgcagcggcgcgatctcggctcactgcaacctccgcctcccgggttcaagtgattctcctgcctcagcctcccgag

SEQ ID NO: 9145 - DNA, 1028 bp, Homo sapiens
ttcttgatatgctcctccttgacttggagttttcttttccctattttcttcctagccagctcctatctttctttgaggctcctatactctctagaaagccctcccggcctggtcgtggtggctcacacctgtaatcccagcacttcgggaggttgaggtgggtggatcacctgaggggaggagctcaagaccagcctggccaatatggtgaaaccccgtctctactaaaaatacaaaaattagccaggtgtggtggcacgtgcctttaatcccaggtacttgggaggctgagtcatgagaactgcttgaacccaggaggtggaggttgcagtgagctgagatcacgccattgtactccagcctgggcgacaagagtgaaactccatctcaaaaaaaaaaaaaaaaaaatccctcccactcttgtgtgaatccatgatgatttctgcttctctcctgtaacttcagtttggctcaacatttatttactgaataataaatgaatgtagcaccctgctagacttaaggacttcacagtctgttgggcaagtcagacatgtaaacagtgtgttatgggctgttatagacatgaatatataaggtgtagaagaagaatggaaacagtttttaacttcattctatcatctgcgtgtgtttatgtgtaggatagtatcttacttagcccatatctctgcaaaatcagtattctacttaggcaaattttacaggttactgaagcttaattctttactatgtattatgtgtatatactgtagataaatacatgtatgcatactgatcttcacctttcatcctggaagaattacatttcacagccagttacatcaggttgagatcactctaaaagccctctctacaaatgctgtatcaaatctctaaatctttgttcttagcttttagtcttgaaaatgtattttagtcaggccaggcgcggtggctcacgcctgtaatcccagcactgtgggaggctgaggcgagtggatcacgaggtcaggagatcgagtccattc

SEQ ID NO: 9146 - DNA, 1046 bp, Homo sapiens
ctagcactttgggaggccaaggcagaaggatagcttgagcccaggagttcaagaccaccctgggcaacatagggggaccccatctctccaaaaaaaagttaaaaaattagctggacatgccagcccatgtttgtaatctcagctattgggaagctcaggcaggaggatcacttgttcctgagaggctaaggctgtagtgagttgtaatcatgcccctgcacttcagcctgagcaacagagtgagaccctgtctttaaaaaaaacacaaaaactataaaagtgagtttggaaaacaaaaagtgaatctgaaatttctctattctttattctgaaagatctatatctgtatattttctatagctatacctatatataggtatatgtggaaatatctgaactctttttttttttttttacgatgtttctttttttctttttttcttttttatttatttttttttttattgatcattcttgggtgtttctcgcagagggggatttggcagggtcacaggacaatagtggagagaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacggaacaaaatgaaaagtctcccatgtctacctctttctacacagacacggcaaccatccgattctcaatcttttccccacctttcccccctttctattctacaaaaccgccattgtcctcatggcccgttctcaatgagctgttgggtacacctcccagacggggtggtggccgggcagaggggctcctcacttcccagtaggcgcggccaggcagaggcgcccctcacctcccg

SEQ ID NO: 9147 - DNA, 1055 bp, Homo sapiens
aaaggaaaactatctagattgcagctctttggtgagtattacttgaaatttatacacaattaataatatagtcagctttctagccacagctatagcatccctgccttgaatacatacttttcagaattttttttttccaaaagcatgtatcacttccgtggaactcagtagcattttgaaatagtggttggaacttccagtagagacataaggagatctttgattgcttaataagagctgaaagaccttccttatggtgattccttaggattcttaaaagctctaagatactttctaattagatttttgctgaatgtattatggagttgaaatagaaatgtagattttccaaactcaaaatactttagtgaccaattgcaaaataagaaacaagatggcagcaaaccatatgggcttgatagatctgtttttgaaaggaagactgaaaaatcttttctctagtggcctatatccagtgggtatatagctgtgagaattacatttacctaacaaccgttgccagctgtataaattgaatttcgtttagttttgtttgtttgtttgtttttttgagattccctctgttacccaggctggagtgtagtggtgcaatctccgctcacttcaacctctgcctctcgggttcaagtgattcttgtgcctcagcctcccaagtagctgggattacaggcacctgccaccacacctggctaatttttgtattttagtagagacgggtttcgctacgttggccaggctggtcttgaactcctggcctcgagtgatctgcccgcctcagactcccaaagtgctgggattacagttgtgaggcactgtacctggcctggatttagtttttattttaaattggatctatttgaaaagttacactatagtgattaggtcccacctgagttgcttttaatgatattttctcacacagaccctaaattggctactttttaaagctgtggcattttcttaaactcatctttttctaaacaaagtgaaatttccagtaagacttgagagacatgtggttaatcacattggat

SEQ ID NO: 9148 - DNA, 1026 bp, Homo sapiens
aaataaaaagaagcgggggccaaagtcctttcctagctaagcttgtcttttaattttttcccagaaatgcaagctccccaacagatttttcccttaagtcttattgtccagaactgttcacatacccatcctaaaaccaatcactggcagtagggaatgggattaactatgactggtttagaccaattttgattcattcccttggactggaggagagacaacaagagatctccactagctgctcaaacaaaagtattacaattctgttagggaagagagagtgggaagtgggcaggtaatgtctggaatagagaataaacagcatctggcccaaatcctgaggttaacaagtggagaagcctaatcttctgatttcaacttccctactgttttcattgcagtgtaagtataggaagtaataatcccacccccaactcccctgccccttattgccagatttcagccccttgacattcatttcagaacttctgagtaaaagtccgtttttccattgttgcttattgccagcaaatctatttcttcttagtatctccaaaattgggtaatttgctcttttgttttattttaaacctaatgagccttccatgttatgctacttgatgtcagatttcagaaaacatctctagttgtttgggaaagactgtttccttcaaactacaaaatagtttttttttttttaagagaagaaacttttaattaatagttctattaagagggtggccacacttagatattcttcaaatacaatattgattacaagttacaggtatattctaccaatatattttgaagattgaataagagattatattgaaaattccaatcatttcaaaccacaccggaagaccgaagttgtttacttatcagtccttttcctatatgcttctgtgtgtgtttttggccatagactttttccaggtttaagtagacatcctctctctgccactaacaagttgtatgactctggtcagtttctcttcctgggcctcgttatcatggaaagaa

SEQ ID NO: 9149 - DNA, 1105 bp, Homo sapiens
aattgaccataaatgtatgtgtttgtttttgaaccctcaattctatatcattgatttatatatcgatcagtatactggtactacactgtcttttgattactgtagctttttgtagtaagtttcgaaatcaggaagtataatgtttccaactttgttcttttttaaaaaacttattttgggtcccttgaatttccatatgaattttagggtgagtttgtcaacgtctgcaaagaaaccaggtgtaattttgataggcattgctttgaatctatagatcaatttgagaagtattgccaacttaataatactcagtgttctaatccatgaacactggatgtctttctttttatgtcttttttaatttcttcaacagtattacatagttttcagtgtttaaatcttgcatttatttggctatatttattcctgcatattttattcttatcagtggtattgtaaatagaattgtcctcttgattttatttttggattgttaattgcaaattacagaaatacaattgatttttatatattggtcttattttctgaaaccctactgaaattgttcctgtggtttttttagtggattccttaggattttgccctacacattttaacatgtataggtaatatacaagtccaagtttaatcaatatctctgctgttcttctgaaataatacaatgactttagcaacctgtggcaggtggaataacaacatccccaggatgctgaggtctgaatccctggaacctgtgaatatgttattttacatggcagagaggaattaaggttgcaaatggaattaaggttgctaatcagctgaccttaaaataaagagaatatcatggattatttgggtaagcccagtgtaatcactggtgtcttttaaagagaaggaaacagaagaccaagtcagagcctgagagatttgaagatgctgtgttgcttgccggctttaaagtggaggaagaacctgtaagccaagaaatacaggctgcctccagaagctggaaatggtatttagacctctcaatctgggcactagactaactcattgctactattctggttattgcttataggcctttgtagtagacatatct

SEQ ID NO: 9150 - DNA, 1019 bp, Homo sapiens
attccatgacttctgctactttcagcaaatttcatgatttgattgtcatgtttctgtgatgtcctgagccaagatataaactgactcaccgtccttatctaagggattctctctccagagtaaggaaaagatatccaaggaatatagatgaaaaccagagctcagagggtcattgtctaaaggctcttaactgtgtgtgtcaagaaaggataggaagaattaagattgaaagagggatttaggtagagaaagccatattttgaagttgggacagaaccacaatatatggcaaaactagtagaaaatcatcattctttcattttgcttaaaactagaaagtcttttgattctcttgggtcctttgaattttgatggcagttcattttacaaagttatcattgggaattgggtgaaatttgttatcctagatgtgtcttaactacttttcctttttctcctaggcagcgattattagtagagttcagtgtaggattgtagctttggatctgcgaagtcatggtgagtaaagttcttaattagccattaactggattatagtcatcaagcccctttgaatagttgtaactattagaaatttcaacgtggccataaaataacctggtctattccatttgagctttttgttgttgtcgttggagatggagtctcattctgtcgcccaggctggggtgcagtggcacaatctcagctcactgcaacctctgcctcctgggttcaagcaattatcctgcctcagtctccccagtagctgggattacaggtatgcgccaccatgcccagctaatttttgtatttttagtagagaccgggtttcaccatgttggccaggctgatatcaaactcttgacctcaagtgatccatccacctcagcctcccagagtgctagcatcacaggtgtgagccactgcgcccagctcgatttgggcattttgaaggaagtcctagcttctagtctttacaaatgtatgtgtgtgtatatatattaaagttttatgta

SEQ ID NO: 9151 - DNA, 1044 bp, Homo sapiens
tttggaacctgacagaattctgccctctagggtatagggaaagctattcgtggggaggatctcaccagaggcacttggctacaaaaacactgggttggggagggctagagtactggagaagccacttgtgctggaggaattgtgcaggaattggcaggagttggatactgggggaagttctgtgtttctctagcaccctccattaacatagcttaatatcatgcctactggcaagggtaaaatatttacaggcctcacatctatttttgtagagtaggcaatgaaggatgaattggagttgaggtagtaagttgataactggcaccaaaaaaattttttaatggtaaaaatcatccacagtagatgatgaccaagaatcaaaagggcgaacaaattggattcttgctgaaattatccaagcagtaaaacatttgtgtgatttctgaattcagttactgtggaaaaaaaaaaacctcaaaatgggcatacttattatcaactgcagaacctaaatactacctaagaaagtatgtgaaaaagccagaatttgagcttgggtcattctgatattccaatttctgtgatacacagtaatgcttctcagaaaattaacctagcattaaaatatgacagaatccctttaaaaagcatccaccaaaattgtaatacatccagttacagtctagatttgtaggtaacccttgctacttcatctttattgtatttctctggattttcaggacttatctcaagtaaggtacttgttgactgaatgctctgcttgattttaataacaataaatttctcttggtggtagatgatcaagtgattgatcgtaactaccttctacctgggtaaatatgcctttcttaagctcagacacgatgttcagttggtgtgtttcagacctctctacctttgtgcatgaggcagatactgcagaaccccttcaattcagttaatgtgtattttaaggtgacttggacttagataatcgtccatagcatccttttattttactcattatttgtctgttaccaaccg

SEQ ID NO: 9152 - DNA, 1068 bp, Homo sapiens
ttcaaagctttaaaattagactttgttaaataggtccattaataattgaagattagaaccaaagccaataaaatgagctctgaacacctttctagtttctcagagcactgtacttacatttatgttcatccttcaaacaaatgagaaattgtaaataataattaacatttgtgaagcattttactctttcgaggtgttttcttgttcccttctcagttaatcctcaaagcaatccagagcagtcagtgatatttttatctttttttatagatgtcgaaactcagtttctgagagattaagtaactaacccaagatcacatagtgaaaaataaactgaggctagggctcatcttgtgattctgaggtttactacattataatgcttaataaatttttgttcttgttttatagatgggaaaattgaaacagagcagttaaatgatttttccagtttcaatcttaggttcaaaataaaggtatatgtttatgtaattgtactacatatgtggaacagtgaaagtgtgatgtaaaggaaaattcagtaatttgggttcttagtcctttacctgccatttatcaggagagctaggtgtgtggctacacatattgatgctggggacatgttagaaggtttacataggtatgtttgtaagatggcccaatagacttttacagtttcccagcactgttacacaccaaagaaaggaactgggaaagaaaaccatttttacagtgttgtcagaaagcattcttagatctttttctcttctctttgcagagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtgagttttcttagcactgaccaaatcaggatttcacttataagagacatccttggtagattattaccttgtcttagtttattgttgatttcattcatcttgaaatatgtccctctgtctttatatcttttttaa

SEQ ID NO: 9153 - DNA, 1050 bp, Homo sapiens
ttggggaaactctccagaacattgaagtgggcaaagatttcttgagtaataccccacaagcacaggcaaccaaagcaaaaatgaacaaatgggatcacatcaagttaaaaagcttctccacaacaaaggaaacaatcaacaaagagacaatcccattgaatgaaccccattctgtgggttgtctctttgcaaactatctgtctgacaaaggactaataactagaatatataagaagctcaaataactctataggaaaaagtctaataatctgatttaaaatgggcaaaagatctggatagatatttataaaggaaagacatataaatggcaaacaggtttatgaagaggtgctcaacataattgatcatcagataaatgcagatcaaaactacaatgagatattatctcaccccagttaaagtggattttatccaaaagacaggcaataacaaatgcttttgaggatgtgaagaaaagggaacccttgtacactgttggtaggaatgtaaattagtacaactactatggagaacagtttggcgtttcctcagaaaactaaaaatagagctattatacaatccagcaatcacgctcctaagtatgttatctaaaagaaaggaaatatataatgaagcgatatctgcactctcatgtttatcgaagcactacccactatagccaagatttggaagcaacccaggtgtccgtcaacacataaatggataaagaaaacgtggtacatatacacaatggagtactattcagccataaaaaagaatgagatcctgtcatttgcaacaacatggatggaacttaaggtcattatgttaggtgaaataagccaggcacagaaagacaaatatcacatgttctcacttatatgtggaatctaaaaattcaaacaattgaacttacggagatagcaaatagaagggtggttactagaggctaggaagggtagttgggggtagaggggagggaactggggatggttaatgggtataaaaaacagaaagaatgagtaaggcctagtatttgctagcacaaca

SEQ ID NO: 9154 - DNA, 1025 bp, Homo sapiens
ttcagatcagttccccagacatacattgagcacctactactttgacaggtactgagcaaaatcatttgaattcattcagcaaataactcatgagtacctatgacataccatacagtatagagtgaatgtgcccgcgtaccttttcatgtaactgatgggagacaggcagttatggtacagtgtaagagtactgtaataggaggaatattgggggaagatgttggcaggggcacttatctcccacttttggatggatagagtgaggggacaagactgttatgacttatgacacagaaggttatgatatctcagttgaggcctgaaggcccagtagaaatagccaggcaaaggaaaaatgagagactaaggacagagctaagagagaaaacatgcttgtgcagaaccatgatcgttttctatgggtgcaacttagagtgaaaggtaggaaataattagatagaagactaaagaggccaagcaggaattacattatgctttgactactaggataaaaatttagactctattctgagagcgctggggagccactgaaaatatttaagcagatggagtgaaattatcaaaattgcattttagaaagattgctctggttgcagtattgaagataaatcagaagagaataatctggaggcaaggccatcagggaggagaaatgtggcagtaatccaggtggatatgacagttttctaatgtgaagttgtgctgttggggatggagaagtatgaaggttaatgagtcatgaccatcaaaaaacctcagtttggccgggcacagtggctcacgcctgtaatcccagcactttgggaggccgaggcaggtggatcacgaggtcaggagattgagaccatcctggctaacacggtgaaaccccgtctctactaaaaatacaaaaaattagctgggcacggtggcaggcacctatagtcccagctgctcaggaggctgaagcaggagaatggcgtgaacacggaaggcagagcttgcagcgagcagagatcgctcca

SEQ ID NO: 9155 - DNA, 1058 bp, Homo sapiens
aatgtctttatcaagttgctgtgtcaaaattgtgctaacttcataagattactcatgcgctgcataacgatgtttgggtcaacaatgggctgcatatatgacagtggtctcgtaagattataatggagctgaaaaattcccattgcctagtgacatcatagctgtcatgacatggtagcgcaacacattcctcacgtgtttgtgatgatgctggtataaatatacctactgtgctgccagtcatgtgaaagtatatcatatatattaatagttatatatacataatacttgataataaaaatgactatgctactataattactgcactatactttttatcattttagagggtagtctttctacttataaaaaaagttgactgtaaaatagcctcaggcagcccttaggagatatttcaaaagaaggcattgttatcataagagatgacagcttcatgtgtgttactgcccctgaagaagaccttccagtgggacaaaatgtggaggtggaagacaatgatcattgatgatcctgaccctgtgtaggccgaggctaatgtgtgtttgggtcttagctttcaacaaaaaaagtttaaaaagtaaataaaaaatttttaaaatagaaaaaggcctatagaatagggatataaagaagaaaatatttttgtacagctgtacaattttttgtgttttaagctgtgttattacaaaagagccaaaaagttataaaattgaaaatacagttaaagtaagctgtttattattgaagaaagaaaaacattttaaaataaatttagtgttgcctgagtatccagtgttgataaagtctacagtagtgtacagtaacatcctagggccttcacatttcactcaccgctcactcactgactcagccagagcaactttcagtactgaaagccccattcgtggtaagtgccctatacatgtgtaccatttttaatcttttttatacagtatttttactgtatcttttctctttttagatgtttaaatacacaaataccgttgtgttacagttgcctacagtattgagtacag

SEQ ID NO: 9156 - DNA, 1122 bp, Homo sapiens
acccaaaaccaagtggtcaactgaagaagttaaaaaaagtaacagcagattaaccccaaaagaagtagaagataggaaagaataaagagcagaaattaatggaatagaaaacaaaagaattagcaaggccaaaatctaattcattgaaaagattaagatctataaccctaacctctggcaagattgatcaaagaaaaggcataaatattaggaatgaaaaaatacaactatagatataatgaagatttaaaaaaacctataaatatagaatatggaaaactttctgcccatgaatttgaaaaattggataaaatagttttgtggaaaagtgtaacatggcagctgactcaagaataaatagaaagtatgactagaaatgtaactaattagcaaagagtaaaatctccccacaaagcaataccaccgcgtggacacaatgagcaaaatgcagaatatgggaaaactgtgggacaaatggcctactttcttccacaaataaattaggaaaaaagcaacagaggggtgattcatggattaaaagatacaatcagtttaagtgtatgaacttacttggatcctgatttgaaaaaactgtatgaaaacatttgatgagaatttgaatgccggctggatatttgttggtattaaagacttatatttttagtgtgacaatagttttctggttatatattttaaaataatccttctcttagatgttaaaaatatttatagctaagatgatatgatgcctgggatttgcttcaaaataacttcaaatttgttccaggagatagggagcaggtattgattaggggaggatagaaaataagattgctaatgattgattgctgaagctggatgatctgtggtagttcattatactggtttctctaataatatatttgaaacttttccataaaaaaagcaagaagaaattctgtccattgaagaagtaccaggcacagatggttttatgggttacccaaatattgaaggatggatggttccagggaataaataaaacgtttccagacttgttttgggggcttttacaacttgataacaaaatcacacaagttaacaaaatcacacaagaactgtatgagaaaggaaaagtacagg

SEQ ID NO: 9157 - DNA, 1022 bp, Homo sapiens
tctggtaaacatctagaatgatacgcaacagcattagcaatcagggaaatgcaaattaaaccagtgatatgccatcagactgctataatttgtaattgattaattataaataatgagcacctatatactgctggaggagtataagttgccatacaaccacgttggagagcagtttggccatatctagtaaggttgaagagatagattccttgctatgcagagattccattaataggtgtgtgccatagtgaaactcttgtgtacatatgcacacacacaatgatgctcacattacagcactgtagtactagaaaatgtagtaacagttgtctttgataggagaagggataaattagtttctacagctgttagaatgaatgaactgggtatatatcaacatggataaatctggaaaaaatacttgcaaaaggaaaagttgcaaaagaatatgtatcctttgatgccatttatataagtaaaagtacggaagataggagtcatttcaatagcttgagtgagaaatgaagaaacaatcagccaatgtagactctactctccttgtaccccccaacaaggtctccctctgacatccaggctggagttcagtgatgaaatcatggcacattacagcctctacttttcaggctgaagcgatcctcccacctccaaagtaactgggactacaggcatgtgccaccgtgcccaactaattttttgtatttttagtactatacagggtctcaccatgttgcccaggttggtcttgaactcctgggttcaagcaatcctcctgcctcagtctctcaaagtgctgggattacaggtgtgagccaccatacctggctttagactactgtttcacagtttgataatgaaaggaaggaaatagagtgcatgaaaaagggaaagtacaattgtaagaaccaagagcagaacagattttactcagaatttgagttcagggtactcttggagagcccattcctgggccttgggcagaacttgagagtctaagcgatagc

SEQ ID NO: 9158 - DNA, 1083 bp, Homo sapiens
accatttgtttcagttttacatgtgtttgatcatgaactggggagtgatgtaaaatgtatttcttactgtggattgtactaaaagttccaaagctattggctaggtactaatagtccatagtatgtcatcaataaatgttagtgacaatagaaatatttaatccgtaatggagatgtactgtcaaaatagatatatattggtttaggaatccagtcatacaaatattttatcacatttgctagtgaaaaagtacttgtattttgtactttctaagaacttaaactgagcttttggtgactaggagatttgtcctgaaatgccgagacctggggtagcatttggggaggattacgatttgctgagacctggggtaggattggcctggatttccatggtgctgcaatatctggcatatagtaggttcataaatatttgtgcgataaatgactttattgtagcctcaattcagaatttctcaactagtcaatctttaacaccaatctgatcaattcatggactgagatttactgttctgttgcatttctttctctaatacctctttaaagcctcttatatgtgtttatcagcttagatgacttgattatagcatttaggataatataaaataagatgataattgtataagctaaatacgaatgaaaggagggagaaagatggtcatttgtgcaaatgtaccaccaggccagttttctttttgagcttgcctggatgtttcacctactgaatcccaggcacaacaatattcttacatgtttatttttctgatgaggtcagaagggttgtaaaatgcctgcaggatagatgaaatttttcactaaatacttcagtgtgaaaacattttgcatcataaatagtattctggaaaggagacaggattggaagttagtggatctgagtttgcatactggtattctactacttagtagctgtgtggctttgggcaagcatcttaaactctgtgcctaaatttcttcttttttagtatgaggataataggagctattttgcagagttgtgaggattaaatgaaatgatatgtgtaaactgcttatagaaagtaa

SEQ ID NO: 9159 - DNA, 1038 bp, Homo sapiens
cctttctagccagaggcttttgagttggtatgcttactgaggtcactatgagtttctaaattttatcattctgtgaataagcttatatttctaaatatatttagatttttttctttctgcatgtgttgtagttagttgtctttttttaacataagaaaaataacgcaaaaatgattagagcaaaatatgaaagtccctttttacctttcttcccactgtccttcccagaagtacctagaatcaatagtttagtgtttatcttagaccccttatatgcttacttatgcatgcagacacatacataaacactttagtcttctgtataaatgagatcatgatatatatatattcattggttaatgaaatatttattgtgcccctagtatgtgctaggcactggggatatcacagactcctctagctactagggaggctggaaagcatagtgttttagctaggaacattaactttctaagtaaaatcagggttctcttagtaaggaaggagaaaatggatattggattggcaactagctgcctctgtctcctgggacaacaatggcaataagactagttaggacactttgagagtaagcaatatgttgggtttaattgggcttgggattttgtcagaagtgtgatggagagatgcagtagatgcacttggaggtgtatacaaggaagttgttacagttttggatgatggatctaggttaaggggaaaattgaggacatgaaggatgtgatagtgaaagagttagttgtagggtcaatggatcggaaactttgatggtgaaaattgtaaaagtaggattgctagcatatataaataaagctggaaagctaggaagtggtggtctcaatataaaaggcttaaatgtgagccttgggagatagtttagttatggatatcacaaagtttagggtatgaccatggagtagatagctgaaataggatggagaaaaagatgtatttaaggaggaggtgaaggaactgagagagtatgccaatattgagaccttcaggaatgatcactgg

SEQ ID NO: 9160 - DNA, 1090 bp, Homo sapiens
ggaaacgagtgaataaatgagtacaaatttttgtaaaataacaatttgtgaagtgtatgatactcatacaaatggagaacgataaactatgcagtacgaaagtgcttggtgagcctgtcatatctgtcatgtttttgcactgcatggtggtaggaggtgctctttagagtttttctttgcaaacatgtattctttgatttaacccaccgccactgcaaccactatcactcactgattcaccaaaaattgggtaattaccttgcttgtttttatctttcttaaatgtatgtgtagctctcatttatctcagtgtttaatattagaagtagttgggtctttatttagaagtttggtgtttttttgtgaatagaaatatgctgtaggaacttaactcttttataccagttagcctgtggtaaaactgttttattatacgttgtttgcttgaagtttcagtttctgagaacctatggacgacgttaagaaatgtgtatctaacaatggacttatatccagaatatataaagaactcttgctaatctaactagtaaggtttaaaaaaaaggacaaaaggtttgaacaaattccacaaaataagatacactttcatgcagtagtagtaggagtataaaatataaccaccattggaaaccttttggctgttgttctataaatttaaacatacacttaactgtgtgatgcagcaattccacttgtagctatttagccaaccaaaacaaaaacacctgtccacaaaatgacatgaatgtccatagtagatttattcaaaatagcccagaactaaataacaacccaaatgtcccacacttgtggataagcaaattgtggtttattcatagaatgggttatatcttatccgtataaaggagtgtcttattagtaaactcagtagcatggatgaattagtctcaaaagtatcatgcagagtgaatgaaacttgacacaaagaaatacatcctgtatatttttataataggcaaaactaatatagtaatcagattagtggtagcctggggctaagtggtttgagagattgattgctaataggttcaaaaggactttctgggga

SEQ ID NO: 9161 - DNA, 1023 bp, Homo sapiens
actcttactttgataatcatttgatcattagataattggttaatcatcagctgagcagacagttcttatttatctactatgtaacagtattggaaattttttaaaaagatggtcacttgctctcacagggctcattgcataaagcagaacagatccctaaataagaagctacagttcagtgtgattagttgctatccattaaaagaaaaagactctcatgtttaataatgaggcaaaacttcattacattatatgttaaagacatacctctaagatgtttctaatgtaattggaaagactctaaaaagggactccaaagtaaaacaacgataaatgaatggatataaacaagatggaaaaactaactctaggataatttggaagcctttgcagaaaaagtgatattttagatgactctgaaaggccaattagtattttataggcagagagcagagacggaattttaggcaaagggtgtagcatatccaaatgggtagatagaggttttgaaagactgtggtacgtgtggagagtaaaaagtagtttggttgtactagagctcagggagttccatgtgtgggaactggtaggggaaaagctgtgaaacaaggttaagtctagtttgtgaaggttgtagtatcaggctgaggcatttagaccttaccctgaagtcaccagccgttaagcaggggagtgattgctggaaagataattcttgatggtgtggagggtattattagagagaagaaagcctgaagagaatgagaccagtaagtagattgttgcagtagtccaggcaaaagatgataagaatctaaggtaaggcaatgaccatgaatataaatgggaagagttagatctgagagactttctagaagtagaatagaatagagtggaaatagcatggagacaatttggagactaatgctcttaatttaagaactagttttatccatgtattaaccctgtaattctaggaaaattaactactctgagcctcagtttgctatctgtaaaagacag

SEQ ID NO: 9162 - DNA, 1033 bp, Homo sapiens
cttgagcccaggagatagaggcttcagttagccatgatcacttcattgcactccagcctaggcgatagagtgagaccctgtctcagaaaaaaaaaaaaaaaaaaaagaggaaaagaacactggaatcttggcatctaaggaactctgtcagatcactaactgaccactaagctaacagaacagagaattcattggccacatatgacaaaaaatagactttataaaatcagttcaaaaaagtcactgaacaaataacagctataacagacagcaacaacaaacccaggggtggggagagaatctgattttcatagttgccaccttataatattcaaaatgcaaaaaatatgaggcataagaaacaagaaacaatgacccatacacaggaaaaaagaaactgatagaaactgtcccaaaggaagccaagacatttgacatttttaatggggactttaaatcatatcctcaagagctaaaggaactatgggcaaagaactaaaggaaaccatgaaaaacagtgtcctaagtagacagtatcagtaaagagataaaattataaaaaaggaatcaaatagaaattctggagctgaaaagtacagtgacagaacagatttgaacaggcagaataattagctaatttgaatataggtcaattgagattatccaatctgagaaacagaaaaaagaataaagaaaaataaacagagcctaagaaatctgtgaaacaccattaagtgtaccaatatacacaaaatggtagtcccagaatgagagagaaaggggcagaaagaatatttgaagtaataatgagcaaacactaatcaaatttaatgaaagacataagtctacacatccaagaagttctgtgactccaaagtaggataaagacatctacaccaagacatgttataatcaaactgttgaaagccaaacagaatactggaaatagcaaagatcacaaatcactataccagatataataatcatgaaaaagtttgaaatattgtgagaattaccaaaacgtgacacaaga

SEQ ID NO: 9163 - DNA, 1087 bp, Homo sapiens
aaaagagcttgacgttactgatcattagagaaatgcaaatcaaaaccataatgagataccatctcacaccagtcagaatggctattattaaaaagtcaaaaaacaacagatgctggcaaggttgtggagaaaaaggaacacttctacattgttggtgggagtgcaaattagttcaaccattgtggaagacagtgtggtgattcctcaaaaacctagaagcagaaataccatttgacccagcaatctcattactaggtatatacacaaaggaatatatatcattcccttataaaaatacacgcacatgtgtgttcattgcagcactgttcacaatagcaaagacatggaaccaatctaaatgccattcagtgatagaccgaataaagaaaatgtggtacgtatacccccatggaatactatgcagtcattaaaaggaacaagattatgtcctttgcaggggcatggatggagctggaagccatcattctcagcaaactaatgcaggaacagaaaaccaaacatcacatattctcatttataaagtgggagccgaatgatgagaactcatggacacatgtggggaaactggggaaacaacacacactggggcctgcaggagaatgggggtgggaggagggagaccatcaggaaaaatagctaatggatgctgggcttaatacctaggtgatgggatgatctgtgcagcaaaccaccatgacacaggtttagctatgtaacctgcacatcctgcgcatgtacccctgaacttaaaagttagaaaaaggtaaaaattaaagaaaacctgtacatcaaaacttactgaatgtaatgaaagcagcgctcagagggaaatttatagctgtaaaagcctacattataaaagatctaagactaaacacacagagtagactaaacacagaaaacaaaaggaaagaaataataaagattacatttaagattaacagagaataggaaaacagtagaatgaatgaaacccaaaagttgggtcctttggtaagatcaacaaaattgacaaatttttaacgactggtcaagaaaaaaagagaagactcaaattaccaaaatt

SEQ ID NO: 9164 - DNA, 1023 bp, Homo sapiens
ctaaaggtttcccaaatagatcacaacctaagggtgtgccaggggagcctaggggaagctaggctgggcattgaacactgatagtgcagaatccacatgcaaacaagatcgacagggtggataaacatatatgtgcattatccccatcccccacagtttagagccttctgcttttctgggggtttcagcctatgagacaaactataatcaggcttcattattacttttcaaatggccaagggttatctgcaatgttgatctaaaatcctaaaaaatcaccctgaagtcaggcaaggaacaatacttaaactccatactatggaaacaaggtatctagctggatgcagctggtaaattcagtcccatggacctttgggggtttattttccttagcagctgacaccatgtgtcttttgcatccctggtggtgcttggtgcttctgcccatctgggctcattgagaatagggatgaagatatgattttagggaatttctgatgggctggcatgccccatgtagtatgagttactatataaagtcatgtgactggcattttaacagaccttccagagcttatatatcccaatatatgttgtttcctttgagtagccccagcaggatactgcttagtttttccagtgccattggtgaaagcatttctggaactgtcttcaaagactagaaacactgactcccaaaatgctagaactggaagggaccttaatggttatctattccagcctcctcctaaggtcctcctcagcttctagacctagaagccaaagtccagaacagtgacccattgatcaaggcagatagtataactccttttaagtgttctcagatttgccttttctcagggcaaatcttcagtgttttgtggttatttgtggttgagagagagagagaatgtaatgtctgagactagccagcagctatttgaagcctctgggaaagaaggtggcttatcaagtgggtttgtagtaatgagtgctgctgtaaagcagagccattttcttgtg

SEQ ID NO: 9165 - DNA, 1030 bp, Homo sapiens
tgaataaataatcattaaagtttgacacacgcagacacacgcaccaatgatggggatacccccaaatgatttaggaggttattttattttaatagttttttcttcctgatttttttcagttagttagagttaaatgtacctatagcccctgaatacatgctcaggtagagaaagtctccatagtataagtaagtaatatgaatgtggaatcttggaaagtgatatattttgattggaataattttaattaaatttaatgattttaattaagaattaaaagccagctagccaaattttctttaaaaattggaaactcattatggtcttaaattgtcctcaggcagccttttcctcatcaacccatagagtggtcttttgaactggtatctaaacatacctggttatgaattctcaaaagagaaagcaggtctggggcggggtggtcaggagacagattctagggaaagtgctgaagagattttcttctgaagatgatctaggaaatgcatctttatacatgattgttagctgctgtagctttctgaagaagattgtagaaaagagactaagatatatgcaagggtcaccagtttagagatcagtcaaattggaaaaagtgccaagactggatgtgcagattgttctatgtattatcagtatttttttcctcttaagaaaaaaatttactctctctcctttgtgagtaaatgcctccttaatgccttttaagtaaggtggcaacttttaactgtcatcttgtgagaggcaacctcaaactctaagcagactccctctctccctttctggtgtcttaaatcaagaactagtttgaagccaaggcaaagcaaggtttgttcatcttcctttcctgtcatttaaggtaaaacaggcaatgaactcgctcttcaaataccatagttcaagagtagctgttggccctggttccagattaatatagcagcaggcagattgccccttcttggggccaccaccctccaaagctgtgccaccaatgagagcattgggttca

SEQ ID NO: 9166 - DNA, 1049 bp, Homo sapiens
tgttcttgcctcagggcctttgcacttgctgttcctttttcctggaacattctttttccagatagcttattctcttacctttcttgtctctgctcagacatctgcttagtgaaggcttttctgcccatctatttaagagaacatcttctttttttatactgtctgttccctcacacacactaaaatgaaagtcccaaaaggcagacatttatattatgttcactgccgtatatccttaccatctaaaactgcctgtcacatataggtaggctcagtaaatatctgaattaatgaacatttctaaaatgtatcaggtcacaactcatcagatcatggactgccaccaaagccatgtaactgccaataaaactgggcacagaagtctaaaaattactgtgatatcaattagcagttggtcagaacttgagaaaatattttgaggtgttgaaaatagttaaaggaacttcactactagctctccaagttgggagttactgcctagaccaacaattattgaggagctgtgaccttttgagcactagttaatgatagacactgttttagtcatgacagtaatcctgaaagcaggtggaagttctcccattttaaacatgcagaaatagagcctcaagaaactgcttcatttaaagataatactagcttgacaatccactgaatatgtcctaataaatggaaacagggtgggggatgtcagcctaccagtaattggtgtcattaaaccctcttgaatgaatggacatagtaatggccttcagggtaccttgaagtatagctaaaggaatctctggagttcatttagtaaagcagttggcatccctggcctgggatcagagtaaaacctggagctagattgattacagagtgcaaggactaggcaccccgggattggagagcatccttgaaagcaagggttcttcatttatttataaaaatttgattgcctactagaagcccagctaagagtatgaagcaattaagacaacaatctttgctcaagaatctcctagacaatcctgattcaagcacca

SEQ ID NO: 9167 - DNA, 1109 bp, Homo sapiens
ttcgataaaataaggacacatctggatcataagggaaaaggacactggcagagtctggaggaatccatttgcaggcttccttatgctcttcctcccatgagggattgcaaagagcccactttgccccaacaacaaaaatgcagcaacacgtgtgtaatgtttctgtccagggagcccattagagagtacccacagtttattgaggtttggtcatgtgggcaccatctgcctagcacataataaagactcctagaaagcaagcaggtatccaccataaatcatactgcaatcaaacagtctacatagtcaactacccttttcagttaactggtgactgggaacactttgagagccaagtttccagacacctgtcaaaaaacaccaaccttgcaagcaggccttcctaaggataacctgttaggcctgctatggtaaatctgcacaagtaccattctctctgtattgtgcaacttgcttttttgttcaatattttgtttgtgaagataatttagattgatacctgtagctacaatttattctatttcactgctgtatactgttaaacatgacagtttatttaccctattaatggacatttaggtcttttataatttttcactattaaacatttgctgctatgagcattcttgtatggacacatctaatacaggtagtgggattccttggtgggagaggatatacatttttacttttctaggtattgctaaattttcctctaaagcgactgtaccaatttacattccttctattaatgaaggaaatacaagattggaataattgggatagttgtgttatctttgtgaatagattttaaaatactgatttagatttttaaatagttgtaagacttcacattttccatatcttagtttggtaactttttctaaaactgtattaactttatctagattttcaaacttaaggaataaagtttgtttaatatttatttctcatctctgttgtatccctgcatatagtctccttttcattaatatcatttataacttttaaaaatgagtcttgccagagggtttgtccggtttattagatatgtcaagactaatatttgcttttgtcagtcccctcta

SEQ ID NO: 9168 - DNA, 1019 bp, Homo sapiens
cctgggtgacaaagggagactctgtttcaaaaaaaaaaaagaactttttctttgcatttacagcttggctgtttggcacaagaggcctagctatcggcctgtcttggctttcaacatgccttcctcgtaagtttaatcatttctagctttgatttaaagtgaaagatgggggactcttcctttcacttgaacacttagaggccattgtagggttactaattggcctaatttcaatgttgttgcatttcagggaataggctgaaggaaaggaagagagatgagggaacagttggttggtgaagcagtcaggacacatatagcatttatcaagttcaccatgtaatatgggcacagttgtcatactccaaaacaattacagtaataacatcaaagatcactgatgaaagatcaccataacagatttaataataatgacaatgtttgagatattgtgagaattaaccgaaacatgacaaagacatgaagtgagcacatgctcagttcagggttgccacaaaccttcagttttgtggcaatatctgacaaatgcagtagagcaaagtgcaataaaatcacataggcctatatttcttattgttgctttcctctctcccagggctagcttaagtgagacaaatgagacaatggttttgagagtcttttgtaaaaaaaatatatagttgtgtcatctctctatatctacatagtaggcactttaatactcctaacctaccctgcttttttacctacagatgtctcaaatctgaccattaaatcttcatatccacagcagataaccttcttctgctgttaaagtacacagtgcaaatgctattctgctgaacatgggccttgccatcaatccctgtctttgcttttgataacattggctcacatttctcttggtgaagttttttactttgtgggattttcagttcctgctctttcaccttatcttctcatgagtctttctcatggcctcccaggaccagacttctgcatgtataactagcctccac

SEQ ID NO: 9169 - DNA, 1103 bp, Homo sapiens
tttttatcaagagtaaaaaacgagcaaagataaatactgaatactttggtataacttaattagtgatgacacctcagttgagccttctctatgcagctggagttttgcttttctgctcaaatgccctctaatattatatccagccaaggtatcattcaagtataaagacaacagctaaagtgtccttaaaggcaacagaccaatacctgcgctgttctgttttgcttcgtccacacagtttttattcttcttcactcatttaacatttcagccatggtgggctatgaattctttcttggtaactaaaattgtttgtaaacggtattaaaataagtctcctttttaccttcttggtggtttctcagttgtcatacccccatctctcctctgtttccctttctaatactggtacttcccttacttggctaaggatttctgggagaggttggataggagttactagtgtcccagtaatgctggtcaaaactttccccatgcccagagcccagagataattcaggaccacaggtagagtgtgtataggtcccactgtttgttaacactgtgtccatgaagactaccttgccaaggtttccaatgactgctgcatggagctcttctgccccactgctgcttgctgatctctaaacccaggtgaagtttttcgctttcaccttacggactactgggcagcatcagggaccatttactccttgaccttcctgaagcaatttcatattgcaccactctactttctcatctgccctcttaagctcatcctctaaggtctggagttctccaagatcccagccttgattttccattcaccatacacactctctttaatgacctaaaccactcacacaactgtgagtactcatttgtcagcaatttccaaatctctatttccaggcaggtcctggctccacacccaaatattcaattgccctccagttcaactggccaaaaccaaatgcatctgtttctcccaagcctgctcctccttttgtgctctctctctctctgtccacccagtctccctgcccagaagcttgcacatcatttttaaacactcttttgctttccatttccaaagattcaca

SEQ ID NO: 9170 - DNA, 1319 bp, Homo sapiens
ggtacagtccgctggccccaggacctcaacttgaagggttgctgacggttgcttgctccgtctggggaccccgggaggaagctgcctcggatttaacgccttgtcattacatgggatagaactgtgtaaaaatcattagctttaaaaatagacagtttgtcatttcgtatatacacttcgatgtcaaaattaaatccacaacttctcgagagttaggatttgccagctctgttggtaccgtaaagccaaataacatggctgggattctttagacggtgcaggttgtgtctacaagtgagagagcttatatgttaagtctactatctattccttaacagtgacaagtacagtgtctttgctgtgctgaatgaagtgtaaataggccattagagcagtttcttgttttgcatgtggaactgttttaaacccttcgatgaagagatgatgacgagtctgacttggggatgttctctttgcccaggtggcctactctgtgctgcgttctgtggcacagtttaaagagccctggttgaagtaatttcctaaagatgacttagaggcatttgtctgagaagggttgctgcactcctgttggaacaagggtttggaaccattggttggaggtatttagttttggtgagggatgcattgactaataagactagactggctcaggcgaaagtgagcctacaccgatctcctaattttgaactttgctttgtttggattagtttgtcgctgatggcatcttcaaagctgaactgaatgagtttcttactcgggagctggctgaagatggctactctggagttgaggtgcgagttacaccaaccaggacagaaatcattatcttagccaccaggtaaaactcatttgactggccatcacctataattgttataaatgctaagttggtttatttatttatttatttttttgagacggagtcttgctctgtccccaaagctggagtgcagtggcgcgatctcggctcactgcaagctccgcctcccgggttcacgccattctcctgcgtcagcctcccgagtagctgggactataggcgcccgccaccataccttgctaattttttgtgtttttagtagagttggggtttcaccgtgttagccaggacggtctggatctcctgacctcgtgatccgcctgcctcagcctcccaaagtgctgggattacaggcgtgagccaccgcgcccggcaggtttatcctttatgaacttaaggggacagacggaacagtgaatctgggcttagtgaatgtaattgcttcttaaaagctagattttaaggccaggcgtag

SEQ ID NO: 9171 - DNA, 2590 bp, Homo sapiens
cagagtatttcaagggaccacaaagtgggtaattgtggagtgtaaatgtggttctcagttttggttatacatgagaatcacccagggagcatttttaaatagatattcctggactttgcacatttaattggcctagagtagggcctagatgtcagggtttcttttgttttttattttagccttctgaggtgattccagtatgcagccagggttggaaagtacatatttaggagcttgacatacttgatgaatattaccctaaggttcggaatgataggtgtggaagagaattggtattcttggggccggactctggtcaaattattctccattaaaggaacattgaaaaccaagtctttgttttgttttttaaacttggtggaggtccttggcaataacacagtggctctcttctgttcttttaaagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgagcagctgagagtgcttggcaaagggcatttgtggacagatttggttttccacagacatcttaagtatttgggggagtttatcatggaagtagctgggcatgttcatattccttggtgtatcgattgccacgttgatctgtaagaatcgatttgctgagatctgtcagatccaagagttggtttgtccttgttttagccatctgtgtacccttcagtgatgacacgatgacgagtcagaaaggtcacgtcctgctcttggtccttgtcagtgccatgttctgtggtgctgtgcacgagttcctttggcagaagtgtcctatttattgatcgatttagaggcatttgtctgagaagggtccagacccaggggtgcttgagtaaactgcttgctctctttggtcttgtgtgatgggggcctttgagaccccagctgtgtgctaacaactgtggtgtcctctaggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgtgggagaatacaagttgaaacctggggtctatttaacccttggttccaatgggacaggtgttgcctttattctttccagaaagaagttcctgcttttactcgtgtatatgaaatagttttcccttatcctcccttatttgctcaaaatttttggctcagtgcaacctctgcctcccatgttcaagcaattctcctgtctcagcctcccgagtagctgggattataggcacctgccaccaagcccagctaatttttgtgtttttagtagagacggggtttcaccttgttggccaggctggtctcagactcctgacctcaggtgagccactgtgcttggctgctcaagattttctaggcacttttgctattctgtcctttagcagcccctgtaaaacactaacaagcctcctgtggtcaacacttggggtttttttgtttataggtgttgtctctccaggtgccttgtattttttttttttatatgaaaaaggacaaacccttatgtatgcattttattaatgttgctgcaaaccctaagtgggagtgtgtatccatttggtaaatcaggaacttaataactctggtaaagtttcttacttttgtgctttatttggtttcagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattcgttgtcctgtagttcaggattgtaggtttagaagagggatatgtttgagtttttcctatgcataaggcgatccacgttgcacatagaaagtgaatataaatggccattatattttgtgtcatgctgtgctctaagtgttctttacatatgtactcgttaatcaacctctctaaagtgtaaaggaaatttgcttgcaccactgaaggcacataaggctcagaagtaaatttgcctaagcagtataaagctatcattagaatccacattcctaagttgtgttctcttaggggatcatgga

SEQ ID NO: 9172 - DNA, 1021 bp, Homo sapiens
ccaattagtgctagctgttactattaccactacttaagcatatcctcttggattttaatacctaaattcatgatattggattctccccatcccaactgtacgtgcactgactacaggtgccatgctttctgtttctgttcaaaaggtgggcatagctgggcagataatcaatattcccattttacaatggtgaatttggccttttactgtgccttgttccattttccatcttgattatttctattttttttttttttttttgagacaaagtctcactgtcacttaggctggagtacagtggcatgatctcagctcactgcaacctccgcctcctgggttcaagtgattctcatgcctcagcctcctgagtagctgggattacaggcatgcactagcacacctggctaatttttaatttttagtagagacggggtttcaccatgttggccaggctggtcttgaactcccaacgtgtggtgatccgcccacctcagcctcccaaagtgctgggattacaggcatccatctagtgattatttctgagatctgatgttgctatgtataaatgcagctgttgtatttcaaagtagggcctgccagcatcagagctggaaaacattgaagtatcatagagagtgaatattttcaacctcagagattgtttttcttactgttctcctcagggacattagattttgatattattttatcaaccaaaccattctctttttttccttataacacccagactggtatgactctctgttattagccaaagctacatttatagcgtaagcatgaccatggtgagaagataattgttatatgccctgagcttgctgtaaacatttaatcttcctgacatcccttataatggacagatttcattactaacctcattttacaagtttaatccatacagtacatcttaggcagaactggtgatttttcttaggctttaagaaatattggcagggtatggtggctcacatctgttatcccagcactttgggaggccgaa

SEQ ID NO: 9173 - DNA, 1067 bp, Homo sapiens
ttccaatttgagaacacgtaacgtgagtctctggattgggaatgacttatgtgatcccaaaccctcattttcacaaagaaggtggagccctagtagctctgaaattcaaatgaagccatgcctctgctgcctggtccagtgctgtgctaacccctcagcctgcccaggtacagctgggtctttgtccaccgagcagggagttccactgtgatatatgcatcccaccctcactggcaggccattgactacacctgcaaccagcctattctcacagccctttttgtggtgagcaggagagctggactctgagccccccagttgcctagagagagggtagagctggcctttaattaaggacttttttgctttttagagcgagcttccggggaagcatagcacagcaatagggccactttcctgccagagggggtgggtgccaaaggatgtgggtcttttgctcactggtttaccctcagcataccaggaaaaatagtcatcctgattcactgtttggtccaagtttttatcacacagtattgtgtgatgaaatcctttctgtagaatgatttaactggatgaaaataaccatgtttcttttttgtctttagaaatatgttactctggctgggcttggtggctcatgcctgtaatcccagcactttgggaggctgaggcgggtggatcacctgaggtcaggagtttgagactagcctgaccaacatggtgaaaccctgtctctactaaaaatacaaaaattagctgggcatggtggcacacacctgtaatcccagctacgagggaggccgaggcagaagaatctcttgaacccaagaggcggaggttgcagtgagctgaaattgtgccactgcactccagcctgggcaacagagtgagactccttctcaaacaaaaaaaaaaagaaagaaaaaaagaaaatctaatatatccatatggtaatgaatgtttcattttattttgtttttatttttattttttatttttgagatggagtctccctctctagcccaggttggagtatagtgacacaacctaggctcactgcaact

SEQ ID NO: 9174 - DNA, 1050 bp, Homo sapiens
cggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggtcctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatccattctgcctcagtagtgagctagagaaagaactcaaatcctttttttaaaattatttttattttgagatggagtctcactctgtcacccaggctggagtgcaatggcacgatctcagctcactgcagccttggcctccgggcttcaagcaattctcctgcctcagcc

SEQ ID NO: 9175 - DNA, 1044 bp, Homo sapiens
gggtgaatgggagccatttccttgtctttggttatcagcctctctgaatcactctctaatgcttgatgcagaacaagattaagggcacatcagttctctttggtcattaatatacctcagaagccagagaattttagatgcatgcaagggaaaggtaaaatatttcactactgaaaatggctttgagttctgtcagttctggtgtgtgatctgaccgggttttttaagacttgctttccgctgtattaaggttcaaaactgtatcaacaaatatagattgaccctacagaaatgatcattttctaaaatacgggtatgtttaataaagtgaaacatttcttttatcttgccactaagttagaatgttactcttcatctactaacctgccatgggataaatccttaataaaccttacagtataagttctttccctagttgtaatctttgacagttttaaagggatgggctgatgtttgtcatcatagtactcattttaagtatagtttgatccaggcttggactgtgtcagcaggatctgaatcccacatctcttgactctgctctcttccttgttggtttcattccctggtttcactgtgatagaaagatggctgacaggatctctagccctatgtccttctaggttcagggccagtaggggcaaaaaagaactcatggccggctcagtggctcatgcctgtaatcccagcactttgggaggccgaggtgggtggatcatttgaggtcaggagtacgagaccagcctggccaaaatggcaaaaccccgtctatacaaaagatacaaaaattacctgggtgtggtggcaggcgcctgtagttccagcaactcaggaggctgaggcaggagaatctcttgagcccaggaggcagaggttgcagtgagctgagattgcgccactgcactccagcctgggtgacagagcaagacgccatctaaaaaaaaaaaaaaaaaaagaactctcaacagtttaatttctgggtctttcgttagccctaattggatcatatgttatgatcgggag

SEQ ID NO: 9176 - DNA, 1047 bp, Homo sapiens
tctgtcacccaggctggagtgcagtggcgcgatctcggctcactgcaagctccgcctcctgggttcaagcaattctctctctcagcctcccgagtggctgggattacaggggcctgccaccacgcccggctaatttttttgtgtttttagtagagatggggtttcagcatcttgtccaggctggtcttgaactcctgacctcgtgatccacccgcctcggcctcccaaagtgctgggattacaggcgtgagccactgcgcctggcccatagctctttaatctttagagttttgtctgtaattcatttattccagccttataacaaccttagaggaaggtagggccaatttatcattatttgcttaaaagaaattgagtcacagaggggcaaagtgacttcctttcattccgtgacttaatcatttctgtacaatgaattgcccctttctctttgctcctgaagcccttttgacatacctctgttagtagctcttgagtttattgtagttttttgaattgtctatctctctctctttctagaaggtacaaactgtattttaactttgtaataccaggctcagtagcaggcatctaataggtatatagtaagtacttatggaataaaaatgaatggccaagatgttaggatgagttgtggcagaacctggatcagaacacatctctccctctttatagacgtgcactttcttcgttatactacgtcacctgtgaagaggtgatgtgatagaagattttcatcatttaatttttgtttgaggtttcttccatcatttaatttcactgtgattatatactgttagcgacatctcctttaacttatagcgtcttaggggggcaagtagtagtattttcattttcaggatgaagatgctgaaacccagagaagttaagagatttccatgtagttaactttgtagaactgagaaattaaataggtggttatttcctcttgctagtcatactaatggatactaacttgtttccaaagcacgtcccaaacagtacgcaagcagaacatcattcaga

SEQ ID NO: 9177 - DNA, 1032 bp, Homo sapiens
gtagtcccagctacttgggaggctgaggcaggagaatgacgtgaacccgggaagcagagcttgcagtgagctgagatcatgccactgcactccagcctgggcgacagagcgagactgtctcaaaaaaaaaaaaaaaaaaaaaaaaagaattgaaagctgaatttagcaacttggagctcactggtgacatatataagagcagttttgatgtgtggtgaaagtggtacaaagaagaatggaagtgttttccaacattttaaatgattgaacaattataattatgtgactgtgagaatgtgtataaaaatagtaacaataaagaattttaccatatagtatccatatgaatcgtggagattgctgtgtgataaactttgcagttgagaattttatgacaaattaggtgcagagtttagtgatccagtaatcaagaaaaagaatgcttgttaattatttgaaataaaatgtcattagtgagaaatctttattgagaatctgttgttagtagaccttgtgttactctgtcagtcacccccctccattctgtcagtttgaatggggagctatgcacagaataaacagtagcggaatgaaaatcagagagttgttttatgagtaggtgcccaaaggaagggtgcagtcgctgaaactccctggaaaaggactgggttaaaatagggggatttaggcccaagggaacctcctacattacccctaaatctaaatcttggcctcagcgtgctcagtcatatttttattttggggtgtatgttggtgagggagagaaatgaagcccgttgtcatcttctattataaaattttacatggcgatataattctgtgtttaattattctgtatccctccatagatttgtgggggacagggactctagtttatcttgctcacggtaacagccactggtgcttagcttgttccctgtcatggggcaggtgttaaatttataaggaataattgagagtttatcaggcagtataaggaacagaagataacacctgggtaccagcatgtgg

SEQ ID NO: 9178 - DNA, 1067 bp, Homo sapiens
attgcaacccctgcttttttgtgttttccatttgcttggtagatgttcctccatccctttattttgagcctatgtgtgtctctgcacgtgagatgggtttcctgaatacagcacacttatgggtcttgactccatcctatttgccagtctgtgtcttttaattggagcatttagcccatttacacttaaggttaatattgttacgtgtgaatttgatcctgtcattatgatgttagctgattattttgctcgttagttgatgcagtttcttcctagcatcgatgatctttacaatttggcatgtttttgcagtggctggtaccggttgttctttccatgtttagcgcttccttcaggagctcttgtagggcaggcctggtggtgacaaaatctctcagcatttgcttgtctgtaaaggattttatttctccttcacttatgaagcttagtttggctggatatgaaattccgggtcgaaaattcttttctttcagaatgttgaatattgcctccactcttttgtggcttgtagagtttctgccaagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggtgttctctgtatttcctgaatttgaatgctggcctgccttgctaggttagggaagttctcctggataatatcctgcagagtgttttccaacttggttccatcctccccatcactttcaggtacaccaatcagacatagatttggtcttttcacatagtcccatatttgttggaggctttgttcatttctttttactcttttttctctaaacttctcttctagcttcatttcattcatttgatcttctatcactgataccctttcttccagttgatcgaatcggctactgaagcttgtgcatgcatcacatagttcttatgtcatggtttacagctccatcaggtcatttaaggtcttctctacgctgtttatt

SEQ ID NO: 9179 - DNA, 1039 bp, Homo sapiens
tgatgctcccttttatatcacatttggaagcatattatgtctagttatcttttttgtgtgtgtaatgttaaaattgattagtacccctggccactcttagtctaatctgccctcagtaatctttctgaggaaggattttagattgagtgacctgcagtggtctctctaagggtgattctgatcaaaggctagaatgacaggaaagtgtcagctctgggaagatttaaggagcaaacacttaaaaaacagagaatagcaagttcaaaagtcccaaagtaggaaacaatcttggcatgttcagggaacagaaggaaaaccagcatgacttgagcatagtgagtgccaaggagaatgacatgaggtagcagtggctttagccacgtaaggccctgtgggctaccctgtgtggtttaaattttatttcaagtgcagtggaaaatcttttgatggttctaagtaggagactgggtgccacaatcagatttgattttttaggatcagttggctatgggaaagagggggaaaatgtccattgttaatcatgcttttcatagattataactttagcccgaaccaatggatatctgttactttctgtgttactttaaattgattatgatgtttaaaatgagatatcacttatgggggaaggttaaatggcccttagtgtaaagttattaatccaaagaagaatggaaacttaaaaaatagatttgaatacagttaaaatattaaatgataaatggaaacagaaatattattttaaaatggcttattttttaaagagtacattttggactggttaataaatgtaactttttaacatggaaacagatgctgaaatattttcagtccccagtgtaaccccccacagccagccatttccatctcacgtgcctatggcctgccttatgctttcacagcattaccatcaacagttaaaacttcagtgacactatacaatgtagcagaaaaatgcaagatgtttttttttttccccctctttagtcttggcagggtaaaacatggtcctttttac

SEQ ID NO: 9180 - DNA, 1049 bp, Homo sapiens
ctcaggagttcgagaccagcctgggcagcacaacaagacctcatctctacaaaaaattaaaaaaattatccggacatagtggcttgtgcctgtagtcccaactactcaggaggctgaggcaggaggattgtttgagcctaggtgttaaaggctttagtgagctatgattgtgccactgcactccagccagggcgacagtgaaaccctgtctcaaaaaaaagaaaaaaaaaaagattaagatgaaatgtacaaatagtatgcttatatattggtgattttgtttttagaaaatattcagagatttatggagtaccatactaggcttatgtaagtccaatacaatatggacttataaaactaatgataatactatcttacatttatgtagtgccttacagttttcaaagcattctcataagaagctcatatacttaccctcacaattttttctctgaagtagaattagtaagaatttctgcctttgatttagtagttcatcttgggaactctagcataaggaaataattctaacttcctgaaaacagttaaatatgtttatcataactgaaaatagttatctgggaataggttaaataaatgaaggagcattgccttcattcgttttctgctgctataacagaatatcatggactaggtaattaataaagaaaagagatttgtttggctcatggttcgggaagctgggacgtctgagagcatggcaccaacatcaagcaagcatcaacccatggcagatgtgagatggagagaggaaaattggactgaattcacccctttattaggagcccactcttgtagtaatggcattaatccattcatgagggtggagccttcatgacctaatcacctcttaaaggttccaccccttaatactgtgacagtggcaaccaaatttcaacatgaggtttggaggggacatttaaaacatagcaagcattcactgtgattaaaatttttgtgaagattaggtagcatagaaatacctttgttattagtgtagaaaagagagcatggggttgaaggcacac

SEQ ID NO: 9181 - DNA, 1015 bp, Homo sapiens
gggttgaggctccctgtaagtttttcatcacaatataaataatgtactaattgcatatgatgagtaaattgtcaacagcctttaaaaattggtcatataattagtaaatctatgagtttcaacctcttcatctagatgaaatagtcatgaagccagactgtaatcaaagaatcttgaaacctcctgaatattctgttttgaactattatttgccttttcaattcctccctttctctctttaggcaagagtagagataaaaatactcttttatttctttaccttatactaaaatatgaatgaagggtctttctgaaaaccttccattaaatataaaatcaaaattattttattaaaaatctatgcattatgtttttatacgagatgctcacagcagtttgttttttaatagcaaaggttcagaaacatcctaaatctacaaaagtaagggaataattaagtaaattatgatagtccattcagtgaagcaaccatttagaattctgcttaccaggaggttttaatagcatccaacagcaggatgtagcattctgtatataccagaaacacagctttagtgtttctttcttgtttcctttttttttttttttttgagacagggtcttgctctgtcgtccaggctaaagtgcagtggtatgatcacagctcactgcaacccaggctcacgcaatcctcccacctcagcccacagttgctgggactacaagcgctcaccaccatacccagctaattttttaattttttatagagacagggtctccctatgtggcccaggctggtcccaaactcctgggttcaagcagtcctcccaccttggcctcccaaagtgctgggatcacaggtgttagccgccacacctggcccatagggtttctttaaaaattaaacacatatatttaaaatcaaagtctgaaaggaaaatacccaaaattaatagcagttatttgatgggtaatagacttgtgagtttttatttttttatatagttaacatagt

SEQ ID NO: 9182 - DNA, 1075 bp, Homo sapiens
ttctatacacattgagaatgtgtactagggctgaaactagtcttttgaaaacctgagctctgcaggtgcagtggcttatgcctgtaatcccagcactttgggaggcaaaggcgggtggatcacttgaggtcaggagttcgagaccggcctggccaacatggtgaaaccccgtctccactaaaaatacaaaaatcagccaggcgtggtggtgcgcacctgtaatcccagctactccagaggctgaagcaggagaatcacttgaacttgggagggggaggttgcagtgagccgagatcacgcttctgcactccagcctgggcgacagagcgagactctgtctcaaaaaaaagaaaaaaagaagaaaatccaggctctaaacaaatgggaagtatttcaaagtgctttagtggtagatggcaccaacgaggtgtagagacatggcctctcagccttaatttccagtttctagcccctggcagatgagctgccttaggcccactctcgctcgtgaatgttctctaacacggcttctggcggcctcagtgaatgagttggtgcccagagctcttgattctgcttgaagtagatagctctctttttctttttttccccccttagcacatctaattatagttttgtaggtagacagctcagccttgtggattttaaatgaataaaaaaagacaagtctttaaaacaattccacactttttaaaggccagcactgtcagcaatccagaacaagaacgagtatgagtctagatatgaaagagacagccagttggtgaaatagctgtagccaagcccaggcacagaactacaagggggagagtggcaggcgcaggtcattttggctgtgtgtacaaaacacagttctagggcgcctcagatgagaaagtctcggagggtgagggggcaggactaatggaccgcctgaagctaaggagaggacaggagcacttgggaaggaagcggtctggggggcctaactgagcagcaccctgcctcacaggagagcaagtcacagacgtttcagccccaacgctgccgctcactggctatgtgaccccggcga

SEQ ID NO: 9183 - DNA, 1110 bp, Homo sapiens
tagttattgctttctaagctggccctatattaggtggcatcagtctgctgtgccctgaatttttaagtctacttactataacgcttttaactgcctttgttgctggatcttattttctcagtaattcttctctcttccctgcttcttgtctagtcttttaatttagtatttgagaaatagtaaagcaaagctgtagctaaaagcgtacctacctcccatccatatccttctattcctgtactctgttttattgttattcattatacttacaactagttgatattatattgcaaagttgtttatcttctatttctcccagggactataagctgctaagggtagagactttgtcttattcttcaatgtattccctagtatttagaatagtacctggcatgtagtaagtgctaattaatatttgttgaatgagtaaattaattaatgaatgaatagaagtatctggttccaatactggcttagctacctcccttgagcctgtttctttgtaaaataaagatgatcataggccgggtgtggtggctcacacctgtaatcccaacactttgggaggctgaggcaggcggatcacctgagggtaggagttctgagaccagcctgatcaacatggagaaacgctgtccctactaaaaatacaaaattagccgggcgtggtggcacatgctactcggtaggctgaggcaggagaatcgcttgaacccgggagacagaggttgcagtgagccaagattgtgccattgcactccagcctgggcagcaggagctaaactccatctcaaaaaaaaaaaacaaaaaaaaaaacttaacgtagtacatacagtgagtgctcagtaaatgtcacctaacactattaacttttcagtcttcttcggtggacttagctaaaaatacgtgtagtagatgaggactcagtgaagtttgtgaactttttttaagttcattgactttaccatatatttatttttattttttttcttctgaattttcaattgagaatggatagttgaggttttcagacttgggatgtttgaaagagggcatatttatctcccaagttatatatgagccataccatgagagttcaggttcaga

SEQ ID NO: 9184 - DNA, 1050 bp, Homo sapiens
actcgactaaaaatacaaaaattagccatgcatggtggtgcgtgcctctaatcccagctgatcgggagtctgaggcaggagaatcgcttgaaccgggaggcagaggttgcagtgagttgagatcacgccactgcactccagcctgggccacagagcgagactccatctcataaataaataaataaatacaattctctgattacaaaaataaatacaagcatcctgaatgctttcacatcagatacttttcctgtacaaaagtatgtggaaatcacagtgatggcagcggtggcccatctggtagctgctgcagagatgctgcagtgggggaggcatcgccagggctgcccattccacagagcccgcagggagccaggaacagataggaaccctactctcttctgagttggcagggcaggagccccgccctcctgggtgcagctccagtgggtgcagtggactccaggtgaagtcctcagacttagaacctaagtgtgggataaagtgggcttccatgagtgtgagctacctagcacacactcaggtggagtgagaagttaacagggctttttctggcccgcctgtggccacccatgaaccaatcagcatgcacttcctccctgctgagcccatgaaaaccctggacttagccagactccaacagactggggaaaacctgcctgtggaaaggagctacccgctgtgggtctcctccccacgcagacctgggcatccgtgtgctctcaggggccagggaagcccccccttcccttgcagtctccgaagtgcctgctcctgctgcctggcctctccccgctcctgctgtctgctccggtttcagagcaaagttgaggcctagcctgggtgctgttgccacccagctgggtgcacaccacttggggtggcactgacgtgccagccccctgccgcctgaaccgcccccacccccagactttgggtgccaatgagcacgggaaggaggccaaagggggtcgagggtgggttgataagggcctgcaggcgccccttccccgaacagcctgggctctg

SEQ ID NO: 9185 - DNA, 1023 bp, Homo sapiens
gttgttccccttgccccaacatttttcaacaactttgtggctttaaaaaatataaggttcatagagggttaaacgtttattatgtttattcttgttttgggggctacttgaattcttttcattcttctgtgatgctttcactgaccatcccaattcaaagcagcctcttactttctgtttgtcttgtttgccctaatcatttgatatttgccctaagctacaaagccatatatctttatttgatgtttcccccattataatctgaatatagaggaaggaatcatgcctttatgtcctccacaatttcctctatggtgtcttggacaaaggagtttaggaagtttgtaatagtctagtccaacttgcttattttataggtggaaaactaaaagaataacttgttgcttgatttgatgcacatttagtatttatatgtgtacctgtatagcatgaatataataagccttggattagggctgtaatttattttgaaactaacaaagggtcttagaattcagaacttccaagctacaatagcaacaataataacatttctattggccttcatagtttataaagctcatttccatgtatcatttcattgcatactcagaaattctatgaggaagagagataattttattcccattttagaggtagtgaaactaagacccaaagaatcaacttgctaataattgatgtagttggggctataatccaagactttgagctccagatgttacacttgtcctgttatatcatgctggttctagatcatctgtcttttcttgctggcagtgaacaggatttccttcagtaattcagccatccaataagtgttgacagaatgctcaggctgtaatacaacacatattttcaggtgcattggagaaaataagactcctacagcattttgttcttactatacacaaacatgcactcacctacacatatgcgtatctatttataatagcaattatcacattgagttgtgatttgtctttttacatgtccgtctcccca

SEQ ID NO: 9186 - DNA, 1033 bp, Homo sapiens
actgttattatttattattactattatttattattattattgctattatttgagcacatttcccccctctggacttgtctataatcattggtacagtctggtttacttgttagttcagtaagatgtgcacaggaatattgaagtacagatggactatctgtagaaaagagaaaaaaaattgacagctctgtcttgtctcttgcttaaaatggacagtcctattgttccttagcactagaaaggagtagttctatcacttctaagcacaaggctagatacagtacagttgccagttgcattgaagaatagcaggaggcagattgaagggccttgccatcctccttgatattggtggagcacaaaacacctttagtggcccttgctaacattctgatttgttttaattttatcttcagacttatttctttgaatagtataggttagccacttgagctgtcatgcaaagttgtcctcatataactagatcctataagtatttctaattactaaatatctttgataaactctagaacaaacctgtggaagttatactgacttttcctttataataggtcaaagattttcagagtatttaaatgaccttagcaattatgtcatccaaacctttcattttatggataagtaaactgagatctagagaggttatccagttgattagtggcagagtgagactcatcttttggttcctagttcaatgtcctctctacttgtagggtgacttttgtatttttgttgttgttgttgttttacttattttgtttaattgttttgatttttgtcaggttatgtactcagtgggtatgaacattcagtggacttagttactggttaccgtttattgtaacttccaccttgtttgatccaaagattactagcatttaatgtaagtctttggttaatccttctgtcggtgttatttttgaccttagggatttcttcggttctttgtcgttgacatgctgagccatttctcttaatgccttatagaggtggggactttgaacgcatagat

SEQ ID NO: 9187 - DNA, 1017 bp, Homo sapiens
tagagtcccttgaatggcagtagcgtcagcattcttatggttagctatttcttctataattctgtttatgtttgattggaatttcacttccaacattatacatttttgtttctctgctacccttacatcattcttggccaattctctccttctgttactcaattttgtaacatggcacataagtttatcaccaggagacaaggaggcaactcaactacatgctttgctttctgtacatgaactgaataactggtaccaggttcactgtgactgatcatcaacagacagtgaaagaagtgacctggttggtcactgatggtgatgtacttctgttatttgtatactgatttgtggacttaagatgtagcagtgaagtttgtactatattcagctactcacaattagtatacagtggtaactgaaatttgaattgtgtcattgggtaattggtgttatttaactaaactatgataactgaaatttgaggatattggaaccctgcaaagtgaagactgtatttctaatcctcagaacattcctatcaaggaacgttagatgttgttaccccattgtaaagagaaggacactgagtcttggagaagttagttaaataagcagctcagcatcatacagctattaagaggcagaaatggtattcaaatttaggtctcacaactctttctaccaagacatactatctatacgaagtggagtttcaggtgctgttggtttaatggaagaaatactacataaagggaaatggaggggaataagatttacctacagcttcatgatgtgagccatcatgcccaggccatattttctttattcatttttctgacagcgtaaacttgggttacttctacctcttggctattgtgaataatgctgctgtgaatatgggtgttcagaaaagaattacccggttaaaagtcattcaaaatgttttatttattcagcagatatttactgagtacctattttgtcactgactaaggctataaaaccatttgaaga

SEQ ID NO: 9188 - DNA, 1048 bp, Homo sapiens
tctttattttgttaattcagccttatttctttttccttctaaatttacttttttgtatgtttaattattctatttttcatttctaggggtattgtttctttttttcaaatctgcctggccatttttgttattttttctttcttggttattttttcttgctatcttatatttctttaaatattttaaaaacacttaacaatatttcgtattcaataatttcagtatatttcatttttgcttgtctaattctgttgcttattgttttgctgattttcttttatggctgcatgtttcctcatgtattcttgtgattttttaccattaattcattgttttggagatttgagaaatctttgagaccatcttggattgtaaagtctatgaggggagggcccctgtggttttgttcattgctgtatcccagggcttattacagtgtctagtacatgagactctcaataaatatttattggatgaataaattacatgcccacaccttacagacataactataattatttatatatatgttcattttctctactgtattgataatacctcaagttagagaactttttggctttaacgctgtatccccagcatttagcgcagagtctaatatagattaagttctcagtaaatatttgttgaatgaatgaggaattgcttggcatattctgcccaatgaaatcttcagaataagtaagacttattttgcctgtttttcattataaagtcattttaatgaaatggaggatactagagaaatgatgaatcagctcacataactagtgcgcatattgttcatgatagattaaagcagaaccattttccagactgaactccaaaatcttcagtgtcactgaaggctaatcacattaactattcctgtacttacagatttcaaggcatagtgagtatacaaaatgttaatccagtaaatatgtaccaaacatctactatatgtatattagtttgcaagttatgtgatatatttttttcccagtatgttatatgctaactaaggtataagcttaaaaatgtgaaa

SEQ ID NO: 9189 - DNA, 1022 bp, Homo sapiens
tcttgtaagaattcactcagtctcaagaacagcatgggggaaccacccacataatccaatcacctcccaccagatccctcaacacctggggattacaattcaagatgagatttgggtggggacccaaaacctaaccatatcaaatatagaaggtatcttttgtgagattttaacagtaataaatcatctgcatttttaataattaaggttaatttagtctaaatttaaaatgcattttaaaggtcttatgcattcatgatttttgactgatgcattttaattctaagtaaatgaagagtgaatgaaaaattatactgaaattagtttggggtgaaggatgaatctgttaaattaattttggggaaaagaataactttattacatcataactgaaccacatctgaaataatatctattaggttttaaatacctgtactcttgaaaatttggaactagtttaatttgcatgagggcagtctgtctggttttcttttgtattcctttatagagccttttgtagtagatgatcagtgggtatttgctattgaatgaatataaggccactgccctcaagaaatgtaactgaggagataagtcataaatatcagttgatcagatttagtgaaaagagatctgtctatgcaaggcaatctatgctaagtgccaggtgagaggttaaaacggttaagtgctgtaacaagagtggtcattttgagtaggatgattaacaaaaattcaccaaatgtaggtaggatttgatttgggcccttaaagaagtttcggtaaaagtggagaggaagaagggattatcaaaataaccattttcagattatgtcatttcaataatgcctcttcattactgaacatagtttggaaactttccctttttgacctttgaataaatcaaaaatgttcatttcaccaactatttctctagggatttcaagaccctgttacttaccttgttcttctctggctcatgacttcatcatggttatctgttttaaatctttctcagtgtg

SEQ ID NO: 9190 - DNA, 1090 bp, Homo sapiens
gccacgcccatatgacctcatccaaacctaattaactcccaaaggtctcacctccagataccatcacattaggggctagagcttcaacatatgaactggggagttggggaggcaggcatagaaacattcagtacatagcaatgtccatcacctgatgaatggataagtaaaatatggtatgttcatataatggaatattattattcgtccataaaaaggatgaatcactgatgcatgtgatgacataaatgaaccttggaaacattatgcttaaggaagagaagctagacataaaagactacatgatgtatgattccacttagatgtaatgtccccagcaggcaaatctgtacagacaaagtagactaatgattgcccagggctggaggggttgagagaaaatggaaaatgactgctaatgggtataggctttcttttaggggtgatgaaaatgttctaaaattaggttgaggtgatgtttgcacacctctgaatatactgaaaacaattgaattgtatactttggattgattttatgtgaattatatctcaagaaacctgataaacagcaaaacttggtggtttgctttaaaggggcaaaatacaaaatattgcatagagaatgctgttctattacatgtttttggactctaaatgtctagaaatgtcagttgcaggagagcactttttaaaagaaaggaaaataacaaagaaaaaagaggagtaaacctagtgctaccctctcctgaaaggaatttgaaacctctgagtagccaccagaatagattttcatcagaatacttttttatgtgttacccagattgttgaaaggaaataaactgtagagatctctaaaaagtcagatgtttaatggctctgtgagcaaaagcagggaaaaaaatcagacttttaatgctatataatttaacagtatcaagagaacactttgaaaaggttttgataaaaacagtccttgagtaaggcatgataaagtggccattctaccaagatgaacaatcatcccatctcactttttttttttttttacttcatagtatattgttattgtgtgactttaaataacttaaag

SEQ ID NO: 9191 - DNA, 1050 bp, Homo sapiens
aggggcttaaggggctgggcagccctgggaagtggggtctgctctgggttggctgacatcactgacttttcttctagagtctgtgggggtggattttgtcttccagagtagaactgccacccatcctggtattagacatctctctcttttaaaatgaaacaaacacaatctttatagtctatggccacctatctaccttatggcttacttaaaagatcaaagtttcagctttgattcagtgaaaataagctttgattctggcttatcgtatgtcctcaagtcagtttcttttctctgagcgtcaggttcagtgggaggagattggagctgatctccaagtctttctaaggtgctgctggtgcacgttcttctcaaaacgcctagtgaaggactagttttgtttttcttttctaattccagtctgctgcagaatattacttttgtaaaatataacaaaacgacttactagaaaaacggtcacgtgcttgtatggtggttgtgatgttaaaatgctgtgtatgtttctaagtgctcgctcagcttctgaacttaccttgttctgagacccagagctgcttgtgagaacaggagataagctggggcctgggaattggcttgctccagagaatgttcgtgtagggaggggagctatctcctataggatcagacccttcccactaggagccagtctacccatccctaaagggtcctcttcgtttagcgtattcctcacattgacctctgcctccctcattggaaggcaggggaacagcttgagattgctctaggggcaggggccagggccctgacaggggctgtaggagtcgattggagggcccaggtcagagcagagtctgctgctctggaggtggatgaatgcctttccccagggaagcagctaataagggtgtgcgaggggctgctgcggctgggatgatattggcatggatcctgtggcatgtcctaaccctagaatcctgggaccacaggaccttaggacgtttgaatctttaagtcctgaacgtaggtctcagagctggaaggggctac

SEQ ID NO: 9192 - DNA, 1098 bp, Homo sapiens
cccaggagtttgaggctgcagtgagctatgtactccagcctaggtgccagactgagaccctgtctcttaaaaaaaaaaaaaagtcgaagaaatattggtagaaagtttgctaaactagattaaaaaaaaaaaagcaacacatagaactggaaaactaagtcaacccacaagaacaaagttcttggacctttaccttaaaacagataaaaaaactaactcaaaatggatcaaagacctaaatgtaagagctacaactataaacctcttagaagaaaacatagaagaaaagcttcataacattggatttgacagtgatttcctgaatatgacaccaaaagcacaggcaacaaaagtaaaaatgcagaaattgaacatcagaattaaaatatctgtgtttcaaagaacatatcagcagagtaaaaaaccaatctatgggagaaacatttgcaagtcatgtatctgctaagggtttaatataggtaaactccaacagctcaacaacaacaacaaaaatcaaacaacctgactgaaaaatggacaaaagacttgaaatagatatttctccaaagaagatatacaaatggccaacgcacgcatgaaaagttgctcaacaccactaatcattagggaaatacaaatcaaaagcacaatgagataccacattgcacccatttctattaagaaaaaaaaaaaaggaagtaatgctagcaaaatggccaagaagaaacccctactgcttgtccccctcacaaagacaggcagaacaatgaataaacaactacattttaaattttaatttaatttaattttatgtatttttttgagatagagtcttgctctgttgcccaggctggagtacaatggcgtgatctaagttcactgcaacctccacctcctgggttcaagcgattctcctgcctcagcctcccgagtagctgggattacaggcgcatgtcaccacaccctgctaatttttgtatttttagtagagacagggttttaccatgttggtcaggctggtcttgaactcctgacctcgtgatccacctgcctcggcctcccaaattactgggattacaggcgtgagccaccacacct

SEQ ID NO: 9193 - DNA, 1048 bp, Homo sapiens
gtttgggtccagaagtcttgtgaattttggatttttgaatatttgcacataattaatgagatgcaggaatgggacccaagtctaaacataaaatttgtttatgttttatatacatcttatacacatagtctgaaggtaattttatacaatacttttttttttcttttttagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcaggtgatccgcctgcctcggcctcccaaagtgctgggattacaggcatgagccaccacgcccggccacaatacttttaataatttagtgcatgaaacaaagtttgtgttaagtacttatgtgtggaattttgatttgtgccatcatggtggcactcaaaacatttcagattttgggttttggactttcagattcaagatgctcaaccggtagtttcctttgtattgatggcagacacaagttgtgtatcttcttgtaaaggtgtgaagaagctaaatgacatctttcctgaattactgggatagagcatttattaagaaacaggatacaagaattttcttaaactactctgttttaaatgtgattttcttcctattaatattttaaggagaaaaagaattaattttccaatacattgataccaccttcactttgaaagtgaaacaaatgacatctattagctttgcagtagaggttaagtggttttcctaagaaaagaatatgcactgcaatgaaagatttgccagtcatcccaatggctattttgttttgcagaccacggtgtgaacacatgaacagaagacgaaaatttcttctagcctcagtacttgctctccagaattcaagttttatatatccatcatgtcagaagtgcttctctaggat

SEQ ID NO: 9194 - DNA, 1035 bp, Homo sapiens
gactaccgaaaagcaagtcctacccagagtgtgcaggaaaataaataataatccattttttggtcctatttaccatttgtactaaatattgcttcccaaccatgcagtcttttgaacattttaggctgcaattactgcactcctatactgtgatctctttcaatgttggctgcaccctggaaggataggcaagagcctatccttgctctgtggttggagcaacaagagcggttccatttgtgcaaagaatatctattcctccatcagcatggcttaacgcctaatctggaaatcacagtgtcactatcaactggaaatgagaggacattgattggaagtgcccactggcattgtggaccaacagtcttaaaaggcctcagagaagataggcatggcctgcagaagggggaagggtgaccttcctggtgtcagtggctggaggcagacagggtaaataacagctgccactaccctcacagaccagggagagccaatgcacaggcctacacacagaactcaatcccaaggaccagtggtgacctttggtagccacaaccctgaacttgtgagagtcacctaaatgaatttgagagtcacctaaaaatatgtcagcaccattctggcagcccaatcttgtactattttatgaaagcactattgcctcagccaatgggaatgacccaggtttgatttcataggcgcaagtcccaagctcctcaggacatttggtacacaccaaacatgatgtagagggttggagaatacctcaaatgggataaatggcactgtcacaagcacaaaagtgagacttagaaaatttcgagggaggcacttctggcaactagctcccacgtgggaccaggtccaggctcagggtggacttctaccaggcgctagaggagaatttagaaggaaacttgaggaaggcattccaaagccttagtctccctgaagcgtagagggctgtgacaggatcccctctcacccaggcctcagaggtactttcttatcatccctccttattgtccttttgtg

SEQ ID NO: 9195 - DNA, 1460 bp, Homo sapiens
ggggtgcgcaggagtcaagtggtggttcagtggggacggtgaggtggaggacgatctggtcggatagccgcgggcacgaacctgggaaccagagggtggaggccatgctggggactgatgtagggcgggaccgactggaagcggcatccagaggcccagtgagcctcggtctcagctcctgaaggggttgcatggggccctacgcttccttctccattttttagctaagagattgagagagtcggtttacttttgggcttggagtatcatttagatctgttaacagtacagttgagagagttggtgtcttttgttgaggtgcgaggacccgaggcggcgaccctcgcctttattcggagaagcccacttccacccacagagttggggtagtcctccgaaatgcatttttgttttgccgtttgttttccaaccccctttcactctccccaaagcttcagattcactgatttttcatacaggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccaggtgcggtcgctcacgcctttaatcccagcactttgggggcagacgcggggagatagcgtgattctaggagttcaaccccagcctgggcaacatgcggagaccccgtaccgtctctacaaaaacattaaacaaaaaaattagctgggcatggtggtgtacccctgtagttgcagctacactagaggctgaggtgggaggatcgcttgagcccgggatgttgaggctgcagtgagcctcgatcctaccactgtgctccagcctgggcgacagcaagcccgtgtctcagaaaaggcgggaggggtgggatattattgatgataggccttctgacgtctggcaatagattccagagtaacatcggtcatggataaattttttttttaactaagtgactgaaaccaaagttaattgtcttttgagtgattttgcacagtatctcaaaatgaactgtactttttttcttgtgtcactgaaacagtgctgtgtgttctttttcagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaa

SEQ ID NO: 9196 - DNA, 1034 bp, Homo sapiens
tttttttgagacagagccttgctctgtcgcccaggctggagtgcagtggcgcgatctctactcactgtaacctccgcctcccaggttcaagcaattcttctgcctcggcctcccaagtagctgggactacaggcaggcactaccacacccggctaatttttgtatgtttagtagagacggggtttcaccatgttggccaggctggtctggaactcttgacctcaagtgatccgtctgcctctgcctcccaaagtgctgggattataggagtgagccactatgcctgtcctctagggaaaatctttaattcattctggacaatgagaaaacttttatttttacttttagttaacaatactcaggaaaataaaaagtgtgctttttaatcttagtaacccaatttgagtttgaaacaaatttacataattttagctgcttaatatgctgctgaagataaatgcagtaaatatcccaaggtcaagatttgaaatccaaatgtccatagtaatgattaacaggaaaagagagtcctctgttaactttatttctcaattttttacaggtttggataattaagggagcactagaaaacttttttttttttttttgagatggagtctgttgcccaggctggagtacagtggtacggtctcgactcactgcaatctccgctcctgggttcaagtgatttctcttgcctcagtctcctgactagctgggatttacaggcgcatgccaccatgcccagctaatttttgtatttttattagagacgggtttcatcatgttggtcaggctggtctcaaactcctgacctcgtgatccacccgcctcggcctcccaaagtgctgggattacaggtgtgagccaccgtgcccagccgaaaatgtttctttgcaaggataaatatatgaagataaacttgccgagcgtaaatatgttcatgaatatagccacttaaggaaattcaaacatgcagagatgttcagctgtatgcagttatgtattcatgaagtattcatgtattcatgaag

SEQ ID NO: 9197 - DNA, 1051 bp, Homo sapiens
gtctccatttcagctctttactctgcatatctttaatgttgggcattatgcctctttcttgagtttcagtcctatgactgttccattttcagtattcatgtttatgtgtctttctaaaattgttttgcttctgtttcttgctgctcttgagacaatttatgggcaaattttgttacttttcaactggccgtgtatttccctgtgaagagttgctggattgtctcattttccagataaactgaattaatgtagtagtgaggagaagccagatttcagaggtttgacaagtgaacaaatgggaatgagaaaagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaattccaaaaacacatggcaatgataatgtctctgcttcttttgagaaattaacttggttctgaaagatggtgtttgcttttcacacctgtatcattaatacttccttgccaaacctaactaggatcctcaccaccactgttagagaaaactgatgctcagttgaaccagaatgttaaatgtgaacaggatttgtctgtgttgttgcccagctatgtttatccatacacattacctggaggaagagaaatctgagataattgagttgattagattacttacatgaagatggtttaattgtatcaatacagaaaaatgcacaaggaaagaaactgacaccttaaggcaacaaagccctcc

SEQ ID NO: 9198 - DNA, 1039 bp, Homo sapiens
caaaatacctgtcttagtaaatgatactatatataccaaatattgcatatgtgtatataaacttcaactgtctacttctatcactgacagtttaaaaattgagataaagtaagtattatctgagtaatataaccattttctatttatttatttatttagaaacagtctcactctgtcacccaggctggagtgcaatggctcggtctcagctcactgcaacctccgcctcctggattcaggcagttcccccaccccaccctcccgagtagcagagacggggtttcactgtgttggccaggctggtctcgaactcctgaccttgtggtctgcccgcctcggccccccaaagtgctgggattacaggcgtgagccaccgcacccagccaatctaaccattttcaagatttgatctgcaaatacctgaagtaagtacaagcactgtggcccagttaaagagtgttagaactgtaagaagtccaaaggcatagctaagaattgctttagagtcagttgtgggttctgaattcttgctctgatagttagcaactatgtctactttggcaaatttaggttttgaagccttccatatctttaaaaggaggtaacatttaacagagcaccaaatacaaggttttctgtaatattagttccatagcatggtctgcaaacttccaacatcagaatctcctgggatatatgctaaatgcagattctggtttcccaaccagaatatactgcttaaaaatctgagggttagttctaggaatctgcatttttttctatacaatgtatgtattagggttccctggagggacagaactaataggagatacatatatatacacacatatatttattaagtttattgagaacttacacgatcacaaggtcccacagtaggctggctgcaagcttgaggaaaagagagagccagagtctgagtctgaaaactgaagaacttgggggtccagtgtctgagggcaggaagcatccagcgtgggagaaggatggaagctgggaggctaggccagtctctcct

SEQ ID NO: 9199 - DNA, 1032 bp, Homo sapiens
aagtattgttaatttttaaatttacatattttggtatacaattctatgagttttgacaaatgcaaagaatcatataaccaccgccataattgagatactaaacaattctatcacctcaaaaaaaatcctcttgagctgtctcatttataatttttgtgattaaaaatggttatttttcaaaaagtaacgtttgggccagtgcgcctggagtgcaccagtagtcccagctactagggaggctgaggcaggagaattgcttgaacccgggaggtggcgattgcaatcagctgagatcacaccactgcactccaccctgtgagtgggctacagagtgacactctgtctaaaaacaaaaacaaaaaaacactttaaatgtttcatatagttattccttattcaaaaagtatgcctttttgggttaagacagtgccatttcaaatagccttgtagaaatataagcaaggaaatgctaaattataccattattgatcattagtaccttagcttgtagtttaaactgttgaagagaattaggactccacctggcattgtggcataagccagtagtcccagctacccaggaggctgaggcctgagctcaggagttcaagactagactgagcacatagcgagatcttgtctcaaaaaatgaaagaaaaagaattaggactcagaaaaggtaaagggtgtgtgtgtttgattagatagaggatgggattgaaggcttaaggaggagattagggcctgagatggaacaatgcgcatggaaggatagatatgggtagtgtgttctgagtaatataagagacctagattctcaaagatagagggcaccaaagagatgagtcctgtagaggggtgaccttcatgtaaaaaatgatctatcttaattgggagctacagacctgggattctgtactgaacttatacagaataagtaatttactcttcaaaagtcgcttccccagctgggcgcagtggctcatggctgtaatcccaacactttggaaggctgaggcaggtggatcacct

SEQ ID NO: 9200 - DNA, 1056 bp, Homo sapiens
cctcttgaccattaacaaatggtcatgttcagtcttcctttttatgagtggaaattccatccaatttgcttttaggttcattaatatgtactacaaccaaaagatcagcagcattatatactttatcttttttagtcttttgaagtacaaattatgcgattttacagataaattatctcatgggtagcatatgtctggctttctaggtggaatgattcctatttctttttgtacctctccccattcagaactcactttgaggccaagcgtggttgctcaggcctgtaatcccagcactttgggaggccgaggcaggtggatcacctgaggtcaggagttggagaccagcctggccaacacgacaaaccccgtctctactaaaaatacaaaaattagcctggcatggtggcacacacctgtaattccagctgctcgggaggctgaagcatgagaatcacttgaacctgggaggcagaggttgcagtgagccaaggttgcagtggatcaagatcacaccactgcactccagcctgggcaatagagtgagactctgtctcaagaagaagaaaaagaaaaaaaactcactttaaactctgctagaccattgcccttgtatgtgaaattttatctggatagaagaagatgaggaaaaaaattttcttgtcttttagtggaggagaatgacatgtaaaacaagtattctttaaaaattccaaatatgatatgagaactaccccataaagttgtgaaggtcacattggtgaaaggaaaactaagtgctgtgtaaattacaaagttgtctaagtatccacctggtccttaccttgctatagaatcttttttttttttagacggagtctagctctgtcgcccaggctggagtgcagtggcgcaagctccgcttactgcaagctccgcctcctgggttcatgccattctcctgcctcaaccgcccgagtagctgggattacaggtgcccaccaccacgcccagctaattttttttttttttttgtatttttagtagagacggggttttcccatgttagccaggatg

SEQ ID NO: 9201 - DNA, 1035 bp, Homo sapiens
aatacaaattttaaaatatagtataacaactacttacatagcttttacattgtattaggtattataagtaatgtagagatggtttaaagtatacaagagagtctggacacagtggcttatgcctgtaatcccagctttttgggaggccaaggtgggtggatcccttgagcccaggagtttgagaccagcctgagcaacaagatgaaaccctgtctctacaaaaaatacaaaaattagccagatgtgttggtgcatgcctgtggtcccagctactcgggagagtgaggtgggagaatcacttgagcctcagagatcgaggctgcagtaagctgtaatcacgccactgcactccagcctgggtgacagagtaagaccctgtctcaaaagtaataataataataaagtatacaagaggatgtcatatgttatatgcaaatattatacctttttttttttttttttttgagacagtctcttgctctgttgcccaggctggagtagagtggtgctatcatagctgactgtaacctcgaactctttcctgaacttgagtgatcttcctgcttcagcctcccaagtagctgagactacaggcatgtgccatcacatccagctaatttttaatttttaattttttttgtagagatggggtctcactgtggtgcccaggctgttatgccattttatataagggacttgaacatctgcagatttcaaggggaaagagtttgaggttacagtcagctatgatagcaccactctactccagcctgggcaacagagccagagactgtctcaaaaaaaaaaaaaaaaagaggagagtcctggaaccaactccccacagttatggaggaaggactgtacctacagtcaaagtgctgtcgttgagttttacactaggtgcttgggagaacagaatggaataggtgaactctgggcatgaagtgaaggtagtccccttcacaggaataaatgctaataatggggcttcaggtgagaatgaggaaggaagcctttgctggtggaggagttaag

SEQ ID NO: 9202 - DNA, 1050 bp, Homo sapiens
gaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtttttatacaccccgcagcctcctattacttctaatactccctgattttagtgtcagcctcatcccaggtctcgcttccatcccaagggggacagtgttccttctctccaacccccccacccccctccaactcaggctcggtctttggcccaggcttcgagcatgggcctctgggggggagggagtggggaggataaagggtggagtcccacttccgctttccaactccctttttaggccaccgcattgtatatcccgacacacacacgctttgaatagagccctttggggtgggggagacttaaaggcagtttgtggtttggggaagtaagagttaacataagccattttaattccctgggaagtgggagagtgggtctcccattttccccaagcaccctttttggtaattgtgttctgtgggttggaaggaggtgaagggggacctgggagcgagctgttggtgggtgggaatagggatttggccccgagtggagcagccgcctgttaggagcccaacatggcgcctgaaaagcacatgatgcgaaagggaagagaggagaatccattccctgccagccaggcagctgctcactcccgtcagccccattttggggtgggggcggctagataaaacttttattctcctattggagggtctaatttgtcccaaaataggggcaagtggggttgagggtggggtttgggtggggggaggagatcttatccaacctgtaggtggagaactggcccagagggtaacaagtacttgcagtttctctgaaa

SEQ ID NO: 9203 - DNA, 1011 bp, Homo sapiens
tcagagttaaaactattatggtgtgtcttaatgctcctcaacaagtctgtgaacctgctgatgctttctggaagcttgctgtgccttctaaaagccagtggtgggtaggcattgcagttgaactggggcaacatttctttactttggaaagggccacctgtatcagcatcaccacactggctctgcacaaatttataacccctggtttgtgcatgtcagaggaaaatatctcggcggagagtccaggctgtgaagaaaatcttcaggacaaatcctggtttccagagtcaagttcaacctgatttacatgattcagcggctgctccatccagtttttcttgtctgagtaacaaacttgcaacttcctgcatgttcgtgtgcaagtttcagtgttttgccattgacttcctaggtgaagtgtttttaatttttgttcatttggattatagagaagtaatcctaatgattttacaggtaacaaaagcttcatagacttgaacatataaaatatgcccatggaaattagtttctacaagaggtctaaaaactgctttgagtgtaggcacaccgttgtaagttaatatgggtcacaaaactgacacttggattatataaagtaattttccctcgcctcctccttatttttgtcacttaaaacacaggtctttttaccacatgaacttgaaatttcattgagtgttaaatgagtatattagggattacagctgttgttcatcctggtaattctgagcttttttgtgctcaactaaggattgtgagagttgagagcttgattgaacacttaagtttcataaagattacttcaaaaatatttagtatcaacaaaaatagaggtctgtattgtaggtttaaaaactcatttttaaataattatttggtggtaattcattatactaaacttctcagtttctttttattcaggctccttcctcagagaagcttcctgttatgtaccttatggattctattgtgaaaaacgttggaagagag

SEQ ID NO: 9204 - DNA, 1025 bp, Homo sapiens
caggatctagggaaatatctcaatcaaacccccacctccagctctgttttttctttttcctttttttttgctttaaagcttttgagatattatacaattgtgtgtcatagacctctacattgcagaactgttgagccctgacgtgctttaaggtagccatagaattgattgaactgttctttgaccaagaatttccttaacctgagttaaataagaagatcaaattgtgtccctgctttcacagtctacaattctttttttttggtccttttttcctactttttaccacctttccagtcacttcagttaaacacaattgtttgatattaatgacaacatagcgaatagccttccaaatacactctggttacgaaacatgcactgttacctgttggtattctttcacacttgttctgtatacattttaaaatgcatactgagacaactttaaggcagtatgtttacaatttgtgattaattcggttggttttgaatgactacttttgcttgcgtgctgaaattctcctaggctgagttttacttcttttccaggtgcagacattttcttactatgacagatttattttatagtagtaagattgcatggaagaaaatacaaaataagaaagattttaaaagtacattaggaacattattgatagaaagtagtccttctgttcatctctaatggtacgaaaaaacagttggcttgcctagatttactctactgtatatccttgaaagaaatgatactcttattgacagatactctagaatggtacttacttagtcttgtttctacattacacagaatcggtggggtttttattatgtgtactcactaccaaaagtccacatgtatactgaacaaggattataaatggatatttattcacataccagcaatatgtagaagtcctgcctccctctggactgcaaatgctgtatttgtatgccagtatagttcttgctccatgactattctgttttttaacattccctttgacatcttttacaagaccttt

SEQ ID NO: 9205 - DNA, 1050 bp, Homo sapiens
tcttactacgtgcagggatttctgctaggatacgcaaggattgcaaagatttctgctctccagtaatttgtaatatattaataactgagagaatagaacaagcattttaatagccttcaacacagagctttaataggttagtgtcatgtaaatgttaagaaaataataaatcctataattcagttgaaggttaaatgctttttgataatggttatcaagaagagataggatttgaaccttaggggttttagttagtagaggttgtaaggcaaggggtccaggagagaggattggagtgagcaagtacaatttactcatcgctttgctccttcctactcagggactttgcatatggtaaagcatcactactcaacttggagctctttctcctctttatctggccaattcctttatatctttcagattccagtttaaatggtgactttttagagtaactctttaagaagtcattcccactcaaacaacatgcagatttggtacttttgttatggactcatacagcaacccagccttcccatgtctctgcacttaatatttgttttctccattatggtagagaccatatgtgtcatggtgtctccagtgcttatcatgcctgggccataacaagcttttggtaagtgtgtgttgaatgaatgagtgaatgttcaaaatatggtcatagtttggtgaggaaacttcgtagactggggcataggaattatatgaagactgggtggaattggggtgaacaaaatgaaaaaggtagaataaaaaagactaaggaaattgaatttcatacagtggacttgcaggagattttgaaattttttgagctaaaatagataaaaatcagtttgaatttctttctagaaaataactatttgccatttgctagtgtaggcaaatgaatcctttcctcttccaatgtctgatgagatggcctggacatgagaaatgctcccctgctgaaagcagcctagtttatctaaatctcaaaggccaacagggtagcagggaagtgggtcctggtttttttcattgcaaata

SEQ ID NO: 9206 - DNA, 1026 bp, Homo sapiens
agaaaattcatagaaaaactggccaactgcagttacttttgattcacaaagccatggatggtctttgttgaagggaagctacgggttggaagccgttctataaataagcatacgacttccaaaaacctgaggggctgaggagtcacagtgtggtgcctacaaagtcagcctcagccaccttcacccagggagtatgagtgaatgtgacaagttggtggcctggatgttggcggaaatgacatggctacttccagaaagaaaactaccttaaccaccaagagtcacggggagtccagctttcagaattctactcatggctcattgctggaacagaactgacagcactagctagcagctgctaaaacccatcattgtcttctttggccctgaaatcaacctacaaaacagcctttcacagggagtacattaagtactgatgttcatagtccttgcatgctgggattccaagtcttataattgcttagatagtatgattctgggagcaatagctcccacaaagatagaattcatgactatctaaatccagtaccaccaatagatctgagcacccaaaggtccggtctgggctgcatgatttagagggccccactctagttctccagtgtccaagctcctccccacagggtaaacagccttctagatcctgtttgagaaacctcagactcctgcattccctgtcttactgccttcagggtctgcacaggcctgttcccaggcccattctctggaggactgcacaatcagtgtgtgctgccctagtcctgaggagtggctaagggatggctgttttcagggaggagagaatggtagagcttggacgtgcagtagggatgtccatactcatgtgtgagaagcccctcaaagtgctgaatggagccaagggtgagaaagacaaggaggactggcttggtgagggaatggggggaagaggaatggatagatatccattgcttatccattcatcagttgatggatttttggctgtttctacctttggctattata

SEQ ID NO: 9207 - DNA, 1001 bp, Homo sapiens
attaataagtaacgcaaaaacaactaaaagcataaaactcaatggtaaaagaaagcagacaatcaaatccagaatactctaactgcaatggtgatatgtaaatcacttataactttagtatgaaggttaaaagacaatctattaagaataataggccaggcgtggtggctcacacctataatcccagaactttgggatgccaaggcaggtagatcacttgaggtcaggagttcaagaccagcctggccaacatggtgaaaccctgtctctactaaaaatacaaaaattagccaggcatggtggagggcacctgtaatcccagctactcaggaggctgaggcaggagaatcacttgaacccaggatgcagaggttgcagtgagccaaaaaaaaaaaaaaaagaataataatagctacaatactttattaaggtatatacaatataaaaagatgcaaattggcccgggtcttccaggagtcgggttgcttgggaatgcagcccaaagcgggtggtaaactccatttaaggctaaataccggcacgagaccgatagtcaacaagtaccgtaagggaaagttgaaaagaactttgaagagagagtacaagagggcgtgaaaccgttaagaggtaaatgggtcaggtccgcgcagtccgcccggaggattcaacccggtggcggatctttcccgccccccgttcctcccgacccctccacccgccctccctctcccaccgcccctcctcctcctccctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatattcgcaacctactcatctgacaaagggctaatatccagaatctacaatgaactcaaacaaatttacaagaaaa

SEQ ID NO: 9208 - DNA, 1036 bp, Homo sapiens
cacatatagtaagtgctcaagaaatatttgatattgatatgcaataacaacttttcaggagaggctgtatccattaagttcaatggtatagtgaactgaatttttctttttttctattaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatctctgagcctccgttgtcttatctataagttaggactaatagtacttacctcacaggattgttgtgagaattaaaagatactgtaggttaaatgactaccacaatatctgtcatattatgggcttttaatgttatttcctgcccctcaccttaccttgagtttcacaactagtaattgatagagcatctatcccttgttcattcttcaggttcctgcttaagtatcttttccccagggagacctctgattgcctcattgtacactaggtgtctggatacattctctatatagtttatcttcaaagtattgtgtacactgataattatctatttaaatatttatctcgtgtctttcatctctgtaaactggccagaaggtc

SEQ ID NO: 9209 - DNA, 1035 bp, Homo sapiens
tcattttctggtttgtaagatacattaatcttttcttatttcatgattattttataggaagatcataaccaaccattgtttggagttcagtttaactggcacagtaaagaaggagatccattagtgtttgcaactgtaggaagcaacagagtgagtgttaaggggtctatttagtatttggcttgatttccagatctggtgttaatgtaatattgaaatagaataatttcaaagtgcattttgtgaagctggtttagcaatatgattctttcatgtaagagtgaaggtttctagaaattaattaaaactagtatgcatggctgaaaatacatctatatttaatatattacccctaattatttatgaaacaggttttatacttgtatttgtcttcataaatacttggttgaaagaattggcgtcctttttttttttttttaattggcgttctttttaaagtgattttggtatttatcattcaaatagcgtaagaactggctgtgatttttttaaaattaaggtaatgaatggctctataaatgaagcataaatccagtggatttaaataagttattgagatgttttaattacttgcagtaaacatttgagtttgctgggtttttttgttttgagacaggtagtgtttggtggtgattgttgttgttgttgttgttgtttgtttttgagagagagagagtcttactccttcctccaggatggagtgcagtggttaatcaaggcttactgcagcctcaacttctggggctcaggtgatcctcccatgtcagccttctgagtagctacaggcatgcactaccatccctggctaattttttttgtagggataggttttcaccgtgttgcccatgctggtcttgaactcttgggctcaagcaatctacctgccttggcctcccaaagagctggggttgcagtcatgagccaccatgtccagccttttaaggaaattttataatgacatgtaaggctctaggccttttactatttgacaaggtcaattcattgaaactctaa

SEQ ID NO: 9210 - DNA, 1057 bp, Homo sapiens
aaacaaaattgagtggagagactgtaattttgtttgatcatttgttatggattttagacctcaaatcaccattgtatatatttggttgtataaggaaaattgagaactttggtgtcaaaaactttagcagttctttataagtttctattataattattgacatgtttctttttcaaaaacattatgtttcttaactgtggaatttcttaggctgatgaaaacttttacacttgtgcatggacctatgatagcaatacgagccatcctctgctggctgtagctggatctagaggcataattaggataataaatcctataacaatgcagtgtataaaggtgggtttttctggttaaattgtagatctgcttcttttgaatccacaactgtaaaaacttgtaatgttaaatttaaaactaatggtatgaatgtaacatttctcatttgatttgtacttttcttactgctctctttggatgagtcttttgagacgtttgtcacatttgggtaatgtaaattaaggaataagtgggaaaatgttaatatttgtagtgctttctttttaaatcatttccctctttcacccttgtcatggtttactttgagaggctctaaatgaacaataagagggagtccattttccaagacacctaaactggaggggtgttatcaaagggaccttgtaacgaacataaaggtgaagcctaggaagttgataagaagacgggtttttcaaatcactttcatcacctgtttttaactgttgggctacatcacactctcctgaggatgcttaaaaccctacgcatattggagcctccgctaatccgatcagaatatctgcaggtggagttttgagcatctttttttttttttgttctgagacagattctgactcctttgcccgggctggaatgtagtagcatgattatagctcactgcagcccgtctcctgggctcaagcgatcctcctgcctcagcctctcaagtagctggggccaatttttaatttgtgtgtgtgtgtgtgtgtgtgtgtgtgtgtgtatgaagatagggtct

SEQ ID NO: 9211 - DNA, 1047 bp, Homo sapiens
ctttttggtgatgtcttttcatatcttttgctcattttctaattggattggttttttgttgtgttttttttttttttttaactgttgagttttgagagtttgaatatattctaaatatgaatcctgtatcagatacatagtttgcaaatattttctttcagtctgtagcttgtcatttcatcctctttaatagggtctttcacagagcaaatgtttgtagtttttattaaatccagtatattgattttttaaaattattttatggattatgcttttgatgttttgcctgagaactccttaccaagctatagaccttaaagattttctcctgtgttctcttgtaaaagttttatactgctatgttttacattaaatgtgtaatccattttgagttgatttccttatgaaggtgcgaggtttaggtggaagttcatttttctcttatagatactcagttgttccatcagcatttgttggaagactattcttccgccattgaattgcttttgcacctctctcagaaattgtttggctgtacttacgtggggctgtttttgattttcctgttctgtttcatctgtatatctgtccctccaccagtactacatacacagtcctcattattgtagctctataattattcttggaatctgatagatttttcccgcttttatttttttcataattgttttgagctattctaattcctttgtctttctgtgtgtaaattttagaataatcttttctacatttctaaaaatcttgctgggagttgttttgaggagaaggagtttttaactggatttgtattaaacctgtatatataatttcaaggagaattaatattgtgctgagtcttctaatccatgattgtggtatgtctcttcatttatttacaacttctttgacttttgtcatcagcattttatagtttttagcatataagtcccatttttgctctgttagatttatacctaagtattttttaagcaattataaactgttttatatttttattttccatttttatgtgttcataactaatat

SEQ ID NO: 9212 - DNA, 1013 bp, Homo sapiens
tctttgatgagagacttggtgtattaacagttgtaatatttcctctttcatttctgatttgagtcctttttttcttattaagtgttgctataagggtttgtcaattttgtttagctttttgttttttcatttttttattttctatttcatttatttctgctctgatctttgttatttccttccactaacttgaggtttagtttgttctttttctagttccttgaggtgttgaggtttaggttgttggtttgcgatcttttttaatgcaggcatttaatgctataaacttccctcttaaaactgtttttgctgcatcccataagttttgacatgtgtttccattttcatttgtctcaaggtatctttatatatgtttctagagtcggggtcttgctatgttgttcaggcttagagttcagtggctattcgcaggtgcagttatagctgtcactgcaccctcgaactcctgggtccaagtgatccattcctgccccagcttcccaagtagctacgactgtaggcatgcatcactgtgccaggctttcaagacatctttcattttctcttgtagtttcttttttgacccaataattgtccagtatatttcttacacagtgtcttaggaaagataaaaccagctttgatatgttgagtattatgtttccgaaaagacaagacagggttgtttttcttaactttatacttgaaagtttcaaacatatagaagagtgaagagagtagtgaatactatgaaccaagtcaagcttcaacaattatcaatacatagccaatcttgatttatctatacatctacaccagattgtttcgaagcacatcccagactttattttaactgtaaaaatttactctatatttccaagaaagactttaaacaaaatatcaataccatgctcaccctttaaaaagtaatttctaaattatatatgcagtttatttagaagtataaagaaaaaagtaaaaactacctttaatttttgtacacagaaataatt

SEQ ID NO: 9213 - DNA, 1046 bp, Homo sapiens
agactcataaataataatttcccatgctttttaggttatatgcatgccaaagactggtgaaattgaatttaatactaatacaggccatttggtttgtgttattcctttgttttattctttatactaaagctggaggattttaaagtgggtcagaatacttctgaagagggaatcagaatttgactttaggaacactgcctttgtatcttgagacttaatttagggcagccagttgatactactttataactaatagatagttgaaattacatagcagtatatttttcctaagtttatttgtatcggtagataggatattatagagggaaaacttacctaacacacatattttctctgtaaggcatgtcatagccttcttgcacttaggaagactagccagcacttgaacttggtcattttaaacagcacgatcaccaacaaaaatcacaaaaatgctttaaatagatgagactgtgaaaaggacactttttcatattacgaggactgaaacaagatggcatgttctacctcagctgccagtgtgtgagttgcacaactcacttttttttttttttttttttttgagacggagtcttactctgtcagccaggctggagtgcaatggtgtgatctctgctcatcgcaacctccgcctccaggttcaagcaattctcatgcctcagcctcctgagtagctgagactacaggcatgtgcccccatgcccagctaatttttatatttttagtagatactacgtttcgccatgttggccaggctgatctggaactcctgacctcaggtgatcaacccgccttggcctcccaaagtgctgggattacaggcatgagccactgtgccaggcctacaactcacattttttactactgttcatatgagtatgtccatgaatgactgcagaaatgcagcaagcattgatttgggattacaagtgagttttagtgagtaggtgaattcagatacaggatttgtgaataaggaggattgcctaattacttctggattgcttacctgttttaattacctg

SEQ ID NO: 9214 - DNA, 1024 bp, Homo sapiens
ttgttgatttttctgtctggtcaactttttagttgttaggatggagtggtgacttccttacatacagcaccaagaaatggaagtcaaatgagaacatttaatagagagtaaggatgggggtgtgtgccaagaatggctaaagaagggataatttgagctgagttgtgaagaatgagttggaattaagtagatgaaatggatcagagaggtagagagtggaagtgagttgaaaatgattttggcaaagggaatgacaggggcaaaaacttatggtgagagtatgatgtgatggagcaactgaaagacagttgactggctgctctgtagatgtggggaggcagtgtattctaaagtaggctagagagaaaggaaggggtcaagtaatacagggccttgtaagtcatattaaggatgttgacctttatgttaagcctgatgggaagccattaagtgttttgagctggaggtcaaggagaagttgaattatatgatcagtttatatttggaaaagattactctggttgccatgtggggaatgaataggagggtcaagaatacctatagcaatagtcttggtgagaacaaatggtagcttggtctaaaactggtaatagtagaaatgcagaggaatgcaatgaatgaggggcaacttggaggtaaaatctacagattatggtgatggactggatgttaggggtgagggataagagaagtctcaaggatgacttctgagttcctggctcatataactgaatagatagtggtgccattcactgagaccgaaatcctggataaaagacaagatttaagagaagaaagattgcggttttgggcaagttgaagggcctttttgtgatatataagcaggcagttggataaacgggtccagaatctcaaagagggggtggcaaggagtctgggtctgtaaataaacatttgggaatcatcctgagtgtgggtgtgactgctgaagtggagagtatagagtgaaaagagaagcaacctaggactgtaccttgaaaaa

SEQ ID NO: 9215 - DNA, 1045 bp, Homo sapiens
gacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacagga

SEQ ID NO: 9216 - DNA, 1026 bp, Homo sapiens
tgagtaggggctgggtaaaataaggctgagacctactgggctgcattcccagacggttaggcattctaagtcacaggatgagataggaggtcagccaagatacaggtcatcaagaccttgctgataaaataggttgcagtaaagaagccagctgaagcccaccaaaaccaagatggccatgagagtgacctctggttgtcctcactgctacactcccaccagcaccatgacagtttacagatgccatggcaatgtcaggaagttaccctatatggtctaaaaggggaggcatgaataatccaccccttgtttagcatataatcaagaaataaccataaaaataggcaaccagaagccttctgtcagtggagtagccattcttttattcctttactttcttaataaacttgctttcactttatggactcgcctttaattctttcttgcgtgagatccagtaaccctcttttggggtctggatccggacccctttctggtaacagaatcttccagtgttagaactagacacaaacttagagatgatttttgtgaaagcaccttattcctagtggtgtgaaagctgaggtcatttgggataataaatggttctgcacattttcaaagagctaaccctcattgtcaacactaccttgaactagttgccccactcctaatttgctcctgtcaaaacactgcagccaaatgcaacaatccagtgccacaaatggctgctgccaggatgtcagtgaacatttgtcgagcacccgaaccagcattgggcgcaagaacagctcttgcccttgagaagctcaaacacatctagaggagaaacaaacaagaacaatataatgtaatataacacatgcaattacagatgtttgaactaggttcagaggtgccctaaaggaaggtgctacaggctctgcttgattggatcatgcgaggctcccagaagaggaaacgtgtatgcagggacttgaagaagaagaggaaacacttactcagggacttgaagaatgagcagaa

SEQ ID NO: 9217 - DNA, 1058 bp, Homo sapiens
ttagctccaagttttattttactttattatttatttatttgtttattttttgaggtggagtcttgctctgtctcacactcactggagtgcagtggcatgatctttgctcactgcaacctccacctgcctggttcaagcaattcttctgcctcagcctcccaggtagctggaactacaggtgcatgccaccacacccagccaatttttgtatttctagtattgatggggtttcaccatgctggccaggctggtcttgaactcccgacctcaggtgatccacctgcctcggccccgcaaagtgctggaattacagatgtgagccactgcgcctggccatgttttcttttaaaagttgtatagttttagttcttacatttaagtctttcatccattttgaattaattttcgtcggtagtgtgaagtagagagtattaagttttaaatttcattttccacatttgttaatatgacatataaatatagtagatttttttgtgttttatcttgacttctgtgaccttgctgaatttattagttttaagagtttttggtacattccttgagattttctatacagacaattatgttacctgcaaatagggatggttttctttcttttccaatctgtatgtccttttttctgcttgtatcttgtatctgctcttagcgggaggcattcagtttttcatcattaagtgtattgttagctgtggggtggtttttcagatgctctttgttagggttaggacgtttacattcatttctagtttgctgtgaacctttatcatgaatggatgtaatattttgttatatggcttttctgcatctattgataagatcatatgatcttttttctttttttcttttcttttcttttttttttttttttgagacggagcctcactctgtcgcccaggctggagtgcagtggcgtgatctcggctcactgcaacctctgcctcgtgggttcaagcgattctcctgcctcagcctctcaagtagctgggactacaggtgcgtgccacctcgcctggctaatttttgtatttttagtggag

SEQ ID NO: 9218 - DNA, 1060 bp, Homo sapiens
atgaatatatcatgctaaacccaaactcaatatatcttgctaaactcaactctactagcaagctggattccaaaacctagtgctgttcatcacaaggtgaagtgtgacagagaaatcagaatgtaaaatgatagtaatcttaactatctatggttaaaataccttacttttgccaatgttaccaaagtgactatgtgaacagattttgtagggctcttttcgaggtttgcaagaagcctgtggttatgggggggtctttatgtttctctggcttccttttaccaccactgtctgcttcctcattctccacttcagccacactgccctctctggtgttgagtgagcatgacaagcatgctttctcttcaggactttgatacttgctgttcgctctgttttgagctcttatcgctagatatctgcatggcttgctgtttcatttcactgagactgctgaaatgtcactgttgtgaggccttccacatctatctcacatagtaacagtcacccttcatgtaacttatacccctgcagtcccaaacctctgtatctttttttcatggagttgatcaacatctaacatgtatcttttttgcttattattttattgtctgtcttcccaccttggaatttaagcttcatgaatgtagagtttttgtgtgttttatacattgctgtattaagcctagaacagtacctaaaatgtactttgtgccataatttgttaaatgaatcatagatgaatgtgtttattaacccatctatgctggaggttgcaaattttttttttttttgtgaaaaatcagaccttggcgatgaccttgagcagtaggaaaataataactcctgtaagcttagcgttccaataatggaacactaggcataaatgggttaaagagaaggatttataggagacataccagattaaacctagatgtttattttaaagcttgttttaaatattttaggttggtgcaaaagtaatggtggttttgctgtaatattatttacaagtaaaaccttgctttatttgactgcattaatgttgtattttagatta

SEQ ID NO: 9219 - DNA, 1025 bp, Homo sapiens
gtgtttgcttttaagatttttttctctatctttggttttcagaaatttgagtatgatgtgtccatgtgcgaattgctttgtgtttttcctttttggagttcttttagcttccagatttcctcctcctcctcctccttcctcccttctccctccttcaccccttcctctcctctccctcttgtcctctttttttcccatttccctttctttttcctctttctcctccttttacttttccttctgctccttttttctcttccttctcctttcttcttcttttcttcctctttttttcttcaacattcagaaggtttttgacaatcatttcattttttttttcttcctccttttctatctcctttcctgttgggacctcaattacatgcattgaactatttgatatttcttggtctctgagtctttcatttctcttcagtctttttttcctcgatcttcttcaaattagaaatttctggtatctatcttcaagatcactgattatttttctctgccatctcaactattctgttgagctcatctagcaaatttttatttcagtgattgtacttttttagctcagttatttccatttagttctttgttatactttcctttttctgttgaaattccttatttatccatctattaaataacatattgccaagaattttttgaacatgttttcttataacttttgagcatatttataaaagctattttgacatctttgtttttgaaatgcaatacctggacccatttggattcagtcttcattgacttcttttctttctttctttctttttttttttttaagctgaccatggagcacactttcctgttttgtttgtttgtttgtgtgtctagttgtttttgattggaaattggacattttattctatatatttccaattggtcctccaaccttaagttctgccctctgaaacttcaagccagtaggcttttgctttctttcacctgagctgtgtgcagttgcagaacataacttagtgaaaggtgcagcaaac

SEQ ID NO: 9220 - DNA, 1065 bp, Homo sapiens
agtggcaaatactactttaattcaatcagctttcatttaagataagtatatctttatggatttgtatggataattataaatattggtgttattttaaaatcatgatatttataatacagtgataattatttttgacattaaattttttcatgaagaatattcgtgaattaaataattaaataatatttaaagaatacaatttacatatttgatatttcttatgcacaaagatacttgattattcagatattaagatatatttccaacattactaaaattattacacttaattttaatattatatttaaagaaaccaagcattttcttactgttgaatgtgaattctttatacaaggaaacctagaagtaaactctcaaatatatatttttaatgttgcatctattttttcttatatatttttgttattatttttgtctttactgcttcccttctagcactacctcaggaaaaaatgtaagtctttaataagcaaagtattagttcaagtagttcaagtagtgaaatctctgagactgatgcctagtagaatgccaggaactggtggcttgtaaaatctaatcaaataaacaaatattcattgatagcgtcctaaaggcaaatgtgatgcgtggcactggaatcagatctagtgttccttcttttttctttgttcccctgaataattattatgaggtagattagtagatactgggttttaattgtaaactaaaccaaaatggtttcagctttcaaaaagttttatagtctagtggctgagtcataacctgctacttaggaccttgccagtgttgtcttctgtaaacagaccagcagcaagctcatgcattgcttttgtgagaaataaattagataatgtctgtaaggcagctagcacaatgtctgccacatgtctgccacaaaataagcctattagaattagcctgttctaaatcttaacttatttttattttattacatatgttgtattattttctatattggggtgagtaaatggagatcttatgtttatttataacagtgtgtgaactggtagttgataataa

SEQ ID NO: 9221 - DNA, 1059 bp, Homo sapiens
ctttgttgactgaagtgctgggaaagctgctgtttcttgcacgtattcttaaaatcaacaaaatacctccacaagacaactggcagctgtggttgaacttaaaaagcactcttacttatgctaaagtttgcagtattttagtccagctaactgtatactattctgcaaatgaaaaaatctcaaatcgtttagtgggcaaagacttttgaaattctcttgtactatcctgtgtcagatctttactactatttacttgtacagtatagtttattctacattttatagttccaccttcttaaagaataataatacctgtgtatgtgtgtgtgtgttgtgtatttgtatgtatgtgtatatacagtggaaaacttggttatcataaaatatacaaattaaagcacccataaaaactctggttaaaatttttgccttcttgttcctaatttattatattgaacaagattcctgttgctcttcatattctctgttcatcttccataattctctttgaagtcagtagttgctgtaagtatggaaatagagaagggaaaacctaactaaatccagtgtacttagagctctcgtgaaagtcaatgttgtggcatttttttaaaggaaattataggtatcttgctaatttcttgatactgtgtcatgaggttatcttttacataaactcataaatggatgaattatattttcttactaaaatgatgcatatatgttacttaatgaatgcttgtttctaactttttaaattttaaaaccatatcagcattatacattttactttttagaaacaaagcatgccttttatttaaagtgtgaaacatacattaaaaatttagtcttctttatgtgttatctgaaggaagcttattaaaatctgaattatgtttgttttaccaagaaacatgagtattctttgcaagacatcgaatgcaaatccaaccatccaaatttaggtaatttatttactgtcaaatgtctttctttccttctcccctgtcttctttttctttttttaaaatatgattctgacaagaatgatgaatttta

SEQ ID NO: 9222 - DNA, 1074 bp, Homo sapiens
agtgttttccaagatattcttcatgtattcccagagttttgcagagcctaccaggaactactatgtaacacagtatgagaggcaaatcaggactttagggtaccttatcctacctcaggcagagcatttctgcattcatttgttttactaaaagttttgcaggtctggttttgtttgagcaaagagtttctttgcttaaaaaacaaaactttaaaactactatttagataattggacttgttggctgagttttggatatgtgatgttaattatacagttaaaccataagcactttaaggttttataaaaatatatttgccttaagccatttctaaaatatattttccaattgagggatttaaatgctttgatttgatcaattactttaaaatgatgctttaaaaacacattttagaacacagcaatccaaaatttagagcatcaattacacaagaagtaaaattgtacaaaattaagggcttatttacatctaagtaagtagtgtatgtaataaaatagcataataaaaaggctctgagtatattgatggaggcatatcatttggtccaacaatgagggaataggtctttttaaaaactaacaacttaatctttatcagaaattgcctgtttaaatgaaaggtaaataatttgaaaagaaaaatgtaataaataagagggtatgtttttgagaatataaaagtttaaatattaaagtgtttataaatattgctataaatgcatgtgtgatccagggctgagctcatctggaatcgggaggtagaccaatttctctatatcccatgaatggcttgggcaactccttgaccattgggtatacagaatgttaattgatgttgtttgtgtgtctcttgtagttctcttgacctacaaagaatcaaggtgtagaagttatatatttgaagggctgggtttgtggaaaaatgatcagtgttttataaatctaggaattatgaatataatttagagaaaggcaaatttcagtacaataatgagaactgaccaaaaatggatttcaaatagaactgttctaaaaagggatttggggccgggt

SEQ ID NO: 9223 - DNA, 1036 bp, Homo sapiens
tttgcttttatgagtcactcaaatggtgatgtcagtgttcttttgcaagtaatatattttctctttgttacaggtccttttgttttgcatcacagctgccatgtacatgttctttttcaggtatgttctgttatacttatttactttaataccccaaacagtatctctttgtaatttcatcaaccacgaaactaaagtattctccaaataattatcccttacaagcagcatactccccccgcacccccgcccagagtggacagaggtaaatcattgctcctttgtgagttaagaaaagagaaagagagggaaggaagacttattctccccaccccccattctatttataagttcatcctagaaagttgaatatgtcaattaataggactcaaatcctgataagtgaatttttatcttttatggacctgattgtatgtaaatacctaagtgtttttcactctgcttgtaaaacaatcaacattttacatttggataagaaaaaatgacagtagatctctatctaagccttctgcaaggataacctagcacattaatgatagtctgtaaaatattgtttgttataatgtcaaagttgtacttttcattgacactggtctcaggtttgttgggggctaaggggaagagtgttaggatggcccaagatttaaatgccagtaagagggatttctgccatcttcgtataatcccagcagtgtgcgaatgatttttgattagggagagtcccctcctttataatctttatttctttatttttagtgataccaattaatttccatttattttactcttattgccctcatttggatagatctttttatatatttatggatctagcaaaattcagtcttagcagacaggaccaggcttttcaaattaaaatctgtgcttaattagcaaagacagttgcggatttttagtaggatatatttggtagatatatttctttaagaataaaacaatccaaccataccagaatttttaaaaaaatttttatttttaatttttgtggggacat

SEQ ID NO: 9224 - DNA, 1067 bp, Homo sapiens
tgattgatttatcttttcaaaaaaaccaactttttgtcttgttgatcttttgtattttttgtgtgtatttcatttatttctacattgatgttattttcttctgctaattttgggcttgctttgctcttttctagttctctaagatgcattgttaggttgtttaaaggttttctgtttttttgatgtgcttattgttataacttttctcttagtactgctttcacttagtactgatttgcttatgttgaaacatccttgtatccctgggataaatcccagtttttcatgatgaattatctttttactgtgctgtggaatttggtttgctagtattttgttgaggatttttgtatcagtgttcatcagatatattgacctgtagttttcttttattgctatgtgtttggttttgatatcagggtactattgtcctcatagaatgagtttggaagtattcttttctcctttatttttagaatagtttgagtaggattggtattagttcttatagtaaaattctgcagtgaaactatcaggttctggacttttctttgctgggaggctttttattacagcttcaatctcatcctttgtctttgatctattcaggttttggaattcttcatggttcaattttggtagattgtatgtgtctaggaatgtattcatttcttgaaggtattccaatttattggcatatagttgatcattatagtctcttaggagcatttgcatttctgctgtaattcagttgaattacatgaatcgcactgtctcctttttcatctctgatgtatttgtgcattttgtttagttattctggctaaagttttgtcgatctatttatcttttcaaaaaaccaacttttcatttttttgatcttttgtatttttgtatgtattttattctattttgatattattttcttctgctaattttgggcttggtttgctcttgcttttctagttctttaagatgcattgttatgttgtttgcttaaagtttttctgctttttgatgtaggtgcttattataaacttttctcttagtattgctttcactgtatt

SEQ ID NO: 9225 - DNA, 1052 bp, Homo sapiens
taaaagttgtatttcagagttaggagatgtgccttaaataattagattttattgtaaagggattacttgcagcaatgcagagagtgaatttgggatttggagggagtatatcacaggtaataggggatgctcttgcagttatccagcagagaaatggtgaggacttgaccaaaacttatggcaatgatacggtggagagtaggtttatctgagatatgaggattgctgcttggatgaggaagatgaaaaacgctggaaggtaagcaaattataaaataggaaaaatgtgtgaaaattgaatacaagctttgcaaatactgaggctgaggttcttttatgacattcagctagagaaataatgggtaacagttgggtattcagagctcaggtgataaatctgggtcagggatagaaatttaggagttatcagcatgtagatattagtttaaaccatgcaggttgatagtgttctgtagtgagaatatggagagtaagaaaaagtgttccaagtatggactggagaatcttgatgtttgaagcataggcagtaggaaaggagtcagtaaagcagaggccagagtagtggcaagaggcattataaataccttgttaaatttaggtgctactgttagctgtcacactagctgtctgactttagacgaattacataactttgctacacctcattttcttcattatgaaaagtgtaaattaacatgtgggcctcataggtagggctttgaggattgaatacgacacattgtctttcaaatgtttttgatgtgacaacccaaaataagaacgatattttatatattatgattatgttaccatatatacatgtatatatatgtatataaatttcccagaaaaatactgaaccttcctacatgtgatatatttggatatttcctattctaatttatgtaattaaaaagctgctgtgactcactgatggctaacagccagtagtgagaaaaaacactgaactaaaacgcgtgagcacctagaacagtgactgatcacttagcaaacgcagagttaagagtagt

SEQ ID NO: 9226 - DNA, 1024 bp, Homo sapiens
gttatttttgttttctattcaggtaatgatgatcatttttcaccagaaactgtgcatagaattttataaaaggcacacaatggcaagtgaatattatttattatttctggcaggactgtagaccagcatatgcctttaaaagaggtttgcataaaattggaatacttttgtatttcaaaccaggcagaattacaggaggctatgatggagaacttcaggaaactgattactatgtgttgatttaatatgccaagtatggaaagaaggaagcaaaattcctgagagagattgaagaagattaaggaataataagggataacccttaagtaaaggatattttgtaagagtgaaaatttttggggttctcaaactgaaatgtttttatttgtatattataaaaagaagctatcatgtttcatacaaattttcatttatatttctaggatagatacttaagaaaataaatttaatagtttgaaattagattatcaaccaataaaatcttggtagtgatattttagagagggtggaatgagtaggcaataaagaaagttaggggatcaattatagcaagggtcctgaacctctgggccatggaccagtactggtccgaggcctgttaggaacctggccacacagcaggaggtgagcagcaggccagtgagcattaccgtttgaactctgcctcctgtcacatcagcagtggcattagattctcataggagcacaaaccccattgtgaactgcgcgtacaagggatctaagttgcgtgcttcttatgagcatctaatgcctgatgatgtggggtggaacagtttcatcctaaaccacccccctctccagccacccagtcagtggaaaaattctcttccgtgaaaccggtccctggtgccaaaaaggttggggaccattgaattataggaagctgaggtcctttaataaattagaaaacctatgtttcactcttattttccctctgccagcattgtaactttggacgagagatttaaccattatgcatttc

SEQ ID NO: 9227 - DNA, 1031 bp, Homo sapiens
atcagtcttctctgtaatggctcctagtttgttttagtgggaaatggtatttaaagatttcaatccaggtgctagaggttatttgctcccaggctagttactgattcttggctttcgcagtgaatggagctagagaatctccctccccttgctttttagaaacagaaaatacatttggaacatagtgatatttctaattcaaagttaagagtgtagattttatttaacttaattacttgctttacccaaatatatgtgtgtgtgtgtgtgtgtgagagagagagagagagagacagagaaagagagagagattgagagaatatatacatcatgaaatcaggaggacaggcaggagccagaccatcatgtaggattttaaaagctggggtaaagaatttgtttttttctcagtgcactggaaaccactgaagagttttaagcatggaaatgacagtatttaattcacattttaagaagaacattttggccactattttagagggaggcaggatcaaagctgagagaacagttagtctgtgtcaggaaatggtggcttgcaccaggatgatagcagtagagatggagagaactatacagatttggtgtatgtttaagagtagaattggcaagacttgctaatggagaggaaaagggaactgagagaaagaaaataatccttaggtggcaaaaatatattctttaacacaagaggaaaccaatattgagatctagtttattaaaggtattttacagctaagtggccagagttttttaaggcaaggaatggtatctctctgtttcttgtgtcatcaggccatatctgatcctggcaaaagaaactggcatataaactatggtgatgcagacttttttttttttttaaataggatattagaaatttaagcttgctatgtccttttgtggaattcattgctctggtaatagacaatcatttttctgtgattgaagttaattttatattaaaatgttctattactgtacagtgaaaatgatataaaaatcaactgtat

SEQ ID NO: 9228 - DNA, 1026 bp, Homo sapiens
atgatgtagaagataattgcacagatatggaaggagatgtttctctgtatgtgaagcctttaaatccagaacaattaatttcttctcttcttaaaaccccgtaacatcacttgactctggaatttcctattttcttttactttctccattttttttccatctgtccctcctacgaatatgttttacatgaaataatgtattgggttttatcttttgtcccagcagacctgaaaatcccagtatattaccacagacacacataccatctggtcaccaacagggacatcagggccaagagcagtttatacttctttctttagctcacaaactactatagcttgcctgttcagttttttttttttttaatattcagttttgtgccatactctcccccacccccagcctgctgcctctgcagagcataacattctaatcttgtcagaccgtggataataggatgttccctggtcttggcatagaggccataggcatacaacatgctttatctgccttgcttagactcagcatccctttctgtcttgagagattcaggcttccataaagtagacctgtagacctatgttggctgaggtcaccctgcattactactttcctccatccctgaactaggaccagttaattttcgaagtctagttcttcagtgtctattaaactttttccagtagttaatcgatctcttaaattaattttcttttcagattatttttggtcacctaagaggaccctgaagctatagtgccaaaggtttaaagcatgaagtacattctgtggttggtcattatgggattggatgccaaaaggaatgggagagaagagactataaacatattttaagccttatctcttttctcctattcttttctttacctttcctggcccatgctttcctgccatatctttgctatgtatttcttcatcttgagctctcaagggaaaaaacaggagtccttatttttctatttatttcagggaaaattgaaggtaaataatatctgcaaagcttca

SEQ ID NO: 9229 - DNA, 1059 bp, Homo sapiens
aagtctcctcctccttctccgtctcctcgttcttgtggttaaattaactcttttaagcttcaagcagagtttcctaggtgtaatagattaaaatttccaaattatgttcacccataaacacaatccaattttgtgagcatccttcaccagtttggctgtcaatcatcaccagtctattgccaaatatttcattcctgtcctttccatcacacagaaaaaattggactcccactcactttgatgttaggcatactcatgtgcttcacttttcttcatgaaatctgaatgaaattggcatatggctgctactgagcagaaattttaagagccatgattaatttgctcccatctctttctctgccaaagtaattgttgaagattaaacccttatcagagtgggtgcctgcgttactagtatgagctgtgctgacctgaaatttacaatgaaaaagagaaataaatcaattattttttggatgctgagatttggacgttgtttttaaatgtagtacaacctagcctattgtgataaaatacaattgcattatagatttgcaacttttctctcctcagactaacaatattggtttctaatcatatctttaagtcaaggcaaacatgtgccatctgttgattctaaggtcttcttatactttttactttctttttttttattttggctgagcacaggggactttattgatggttcgtgacaaggaggggctccctaggcatctccctcttcagggggtctgcatggaaactgtgaggaggggagattctcagtgtggtggggaactgagtgcagcaaggactccccagcagtgaaggcctctctcttcctctcatgctctcgctcgggttggcagtccaggggtcttactccttggaggccatgtgtgccatgaggtctaccaccctattgctgtagccaattcattgtcatgccaggaaatgagcttgataaagtggttgttgagggcaatgccagccccagcatcaaaggcggaagagtgggtgtcactgttgaagttggaggagactaccaagtgctcagtg

SEQ ID NO: 9230 - DNA, 1034 bp, Homo sapiens
attgatatgacatattgcatatgcacactttttccaataactgctaagataaatgtagctataatagcaattccagctacccagaatttctcatttgtcttaaagaatttatttcaaaattattttttcctcatccagcaatgtatatcaggttaaaaatgatcttgtaaatcttataaaacctctaagagtaaaaactttcagtacgtataatggatcaatgacatttttaagatctgctattttatgaacctcaagaatggagagattaccaaatctgtagtgtaataaaattgttctaccatgtagaattgatagactaagaaaattagactaatctgatgtatgtatgtatagccattatatatatatgtacattacatatgtatgtattgttaaaacaaaaacattagccaaattatatttaacagactttaattgagcaaagaatgatagactcagagagactccagtgcagccacgtgatggatgaagagttacagacagaaaaaggaaagtgacatacagaaaacggaaatgagtaacagaaacagccagactggttacagcacagaatttaccttatttgaacagtttgaactgacccctttaattggccaaaacttggtgatcggcacaagagtagactcagtctgttgacaactccatttaggttatagttcactatgtacagagaaacctttaggctgaacttaaaatatttaaggaggcagctttaagttaaacttgatttaacagttgagattcagtaatgaataaatcagaaaacattgtacatattttaaaataaaatgttaatgtggaacatataaaacattcttcttaaaattcagaagtataactaaatgtttattgtgaataaaaaacgtgtcttagtccattcctgctgctatatcaaaatacctgagactgggtaatttataaaaaacagaaatttattcctcacagttctaggggctgggaagtacaagatcagtgtcaaccaattcaatgttttatgagcacctgtccca

SEQ ID NO: 9231 - DNA, 1028 bp, Homo sapiens
caatcctctcaaactctgctgctgctttatcaactaagtttatggaacattcccagtgtgttacttacctcaactcttagcttgttggggacggtaaccgggacccagtgtctgctcctgtcaccttcgcctcctaatccctagccactatgcgtgaatgcgtctccatccacgttggccaggctggtgtccagattggcaatgtctgctgggagctctactgcctggaacatggcatccagcccgatggccagatgccaagtgacaagaccattgggggaggagatgactccttcaacaccttcagtgagacgggtgctggcaagcatgtgccccgggctgtgtttgtagacttggaacccatggtcattgatgaagtttgcactggcacctaccgccagctcttccaccctgagcagctcatcacaggcaaggaagatgctgccaataactatgcccgagggcactacaccattggcaaggagatcattgaccttgtgttggaccgaattcgcaagctggctaaccagtgcactggttttcagggcttcttggttttccacagctttggtgggggaactggttctgggttcacctccctgctcatagaacgtctcttagttgattatggcaagaagtccaagctggagttctccaattacccagcgccccaggtttccacagctgtagttgagccctacaactccatcctcaccacccacaccaccctggagcactctgattgtgccttcatggtagacaatgaggccatctgtgacatctgttgtagaaacctcaatatcgagcgcccaacctacactaaccttaaccaccttattagccagattgtgtcctctatcactgcttccctgagatttgatggagccctgaatgttgacctgacagaattccagaccaacctggtaccctactcccacatccacttccctctggcgacatatgcccctgtcatttctgctgagaaagcctaccatgaacagctttctgtagcagagatcaccaatgct

SEQ ID NO: 9232 - DNA, 1034 bp, Homo sapiens
cttttagttggagcatttagcccattaactttaaagttaatattgttatgtgtgaatttgatcctgtctttatgatgttagctggttattttgctcgttagttgatgcagtttcttcctagcctggttggtctttgaaatttggcaattttttgcagtggctggtagcggttgttcctttccatatttagtgcttccttcaggatctcttttagggcaggcctggtggtgacaaaatctctcagcatttccttgtctataaagtattttatttctccttcacttatgaagcttagtttggctggatatgaaattctgggttgaaaattattttctttgagaatgttgaatacggcccccagtctcttgtgtcttgtagagtttctgctgagagatcaactgttagtctgatgggcttccctttgtgggtaacccgacctttcactctggctgcctttaacattttttccttcgtttcaactttggtgaatctgactattatgtgtcttggagttgctcttctcgaggagtatttttgtggtattctctgtatttcctgaatctgaatgttggcctaccttgttagattggggaagttctcctggataatatcctgcagagtgttttccaacttggttccattatccctgtcactttcaggtacaccaatcacatgtagatttggtcttttcacatagtcccatatttcttggaggctttgttcgtttctttttattcttttttctctaaacttctcttctcacttcatttctttcatttgatcttccatcactgataccctttcttccagttgatcaaattgtctactgaggcttgtgcattcatcacgtagttcttgtgctgtggttttcagctccatcaggtcctttaaggacttctctgcattgattattctagttagccattcatctaattttttttcaaggtttttaacttctttgccgtgggttcagacttcctcctttggctcggagtagtttgaccgtctgaagccttcttctctgaactcgtcaa

SEQ ID NO: 9233 - DNA, 1027 bp, Homo sapiens
gccctaaattatttaaataataatagtaatgagaacaaatactatgcatgtgtttaattatgaagggctgtttctgttatcttatttttaccatagagatgataaagtttatgtgggaaacttgagaaaaaaagaatgtggataaagaatcctgaaaaaaacagagtacttctaaacttcctgctggtcagttggtattgaattgatagtagactatcaaaaaagagttcttgacaatattaataacagtaacgtgcattcgtttgtaactttgccatttgcaacttttcattcatttttgcgtttgttaataacaactaacattgctgagagctttacatgtattatctcatttatcccccaacaactctatgaggcaaatactattattatctctaccaaaagaaattggtatttctctactaaagaaattgaggcatagagcttctaagtgacttgcccaaggtaacattgttcaggaggtgtcagaataggatcctaactctacaacctgtgctctttacccctctgcctaaaagagccccctgggccaactgctatttattttcttactggattctgggtttctggcctgtcttcagccttactcatagtgatcctatagtgatcctggagaatcatccagcttctccaggttgtagtaccccttcaaacatctgcacgtgcatggcaaatatggtttgagtttctaaaacttgagtgtgcacctaggaagcagaaagcaaatggagcatctcctgagtcaacagtgcagatgctccctcttgaaaatgacttttcctttccaggctctctgactccacaaaaggaagtggaaaagttaaccagtgcccaataaatgtgggttattgccccctgcctgagtaatttatcacttgctggaactaacttcagaattgctttgagtccatgtcatgttactcctgggaatgggctattataagattctgaatgactgttatgcagttccctatggctgtgcttgcacaggagaggttgaattagg

SEQ ID NO: 9234 - DNA, 1080 bp, Homo sapiens
taccaggtttagggtaaatttgaaagtagctgtgggggagatgactttaacatttccccagggaagtagactggaaaattgctggagagtgaactatagggaacaatcttgaattggtctcttgggtcggacataattacctaatggattttccatctttcaaaattttaggcaggaaaaaattgcctaaaaaaatatcgacaaaatgtgaagcgtacaacctgttccagttctcttcaagactgtaaactcctggccttctctggaacctttgaaaaatggcagtgtagtggagtaaagacaggcaaggggaagacatgtggaagagaagaaatcagactgatgcatgattggaaactcagaattacataactcgatttgtcccttttaagtcattactgactgctgattcatctccattcatgaatgttttgggtgcagttagaactacattttaatgaacaatataacctaattatgattgagcattttacttttccatggactgtaaagatatttgttgagtggcttagaggtttgcataccagagtttcctggtcaaaagcgtgcattatgcaatcagtttttacctcaaacattcacatatggattcccctatcttgcttggttactttattggtaccaagaacatgaaacctctttctttcttgcacccccaggtatatcccaatacatgttctgttttaatgtaatttactattattcacattgcttaagggatgacaaagtatctacttgttctcaagttttattactggctgatgtgtgtcagactagacttggctctgtatataaatatactccagtagagagacccagcctctgtgatcccaaatacattcattggaacaataagtgtgagtgcttgctatgtgcctagcatgttacagctgagatggacccacaagtgaaacagacactgctgtgtttctttcttgagtaggagaagtaagtcatggacaggagaaactaaagcactaggtatacaaaggcaagagctccaagggatcaaagtgctgtcatattcaaacaaggggtctgccttgagggatcgtggga

SEQ ID NO: 9235 - DNA, 1042 bp, Homo sapiens
aatgctttagttttctcttgctctttttgtcttttaacttggctattttcttatatatagaatttctgtccaaaaatctaactgtgtgattttttagctcagctcagagtagcacaacaaaattacagccaccggttggacccagttcagtacagcattcaatctaagggccttgtagcttccaaacgtttgtattattccaatccctgggtggcattgtaacatatatttattcttgattgctccagaggtttattttaaaaatcagaataataacacaactaggttaagtgcaatgtactttgaaattccaaaccagtagttctttaacctattcatgctggttggatgacaaggcattttaccattcttttttatttaaaattacccatatttgtggcttttaattaattatctaattaaatgtattttattttattttgcctgcattccaggttttcttatttctatgttgtttctcctttatacatatttactctctcttttttttttaaattctgaggtctctcgaacaataaatggactctagcattgttcccatgtgacctaaagaaactaccatattagaagaggctaccatattagattagctttcacttaacacagagggatctgaaaagatggaatagtggtaagaacctcctaagaagtgacatttcattggaaattggaaattctattgactaaatcaggaaatagaaggagacctcctcaactgcccttgattggtaattacagctcatgggtagttttaatagccttcagaattcctcatctttccttctcatatgttttcctgtaagtagtgtctttttccagaagttgcttcaatggttcttttgaggactgaatagaaagagcaaatgtgtagtcacctttactgagttcaaaggagttatttgacatatcaagctttcccattggctgaagaaaccttagctcagagttggtagacccaatccctgagccattatgagataccagtgatccttggcctggtccctcaggtcagaactcagaa

SEQ ID NO: 9236 - DNA, 1049 bp, Homo sapiens
tatctcatttatttcgttttcttcacagcatattttagtacttgaaatggactgtttatatgttgtattctctgtcttctactgcacaagcttaaggtccttaagggtaggaaatctgtctgtttcactgttatccctccagtgcccagaacagtgcttgcaacatagttgttgcaataaatactgattgactgagtgacatttaatattcttcatttgtctcttcccttctgtagctattttgatttatgttttaaagagagaggtaacaatttgctttgatatgctgggcttagtaaattgggtttgccccattcatctgaagaagctatgctgccagatcccatcaatcttttaaatgtgacttttctttttctgccttcttctacgtgctggaagtggatttactttatgttgcaaaactgttgtcccattttttaaccagtatgtgacaactcttggaataagtctatactgattcccttcacttctttcttagtttgggggtagtttgtgtgagactgtactcttttcattatatggccctataagaactgagaccaactctgtcaagcagtcgttgtcctccatctcccttctctgggattgcagaaggaaaaatccctagcttatgcatcaagaaactctctattattgatgttgtaaagttctgcacacatcagatggagaggtgatggaaggagcagcaaagctgctgtaaaatcttgaaggggaaattgaggagggggttaccagtgttcattttgccctgctccttgggagtcacacctgcatggaaagctccaagcagagtagaaatcaagcacataaggccgagtgggctatgccaatttctggttaaggattctctgttccagcataaactttgcattctcatgacagaattaaactactgtctgagttcctagtaaatgcatgacatattgtgaattactaagtagtggtcttgataggttagaggacaggatggtcagggagataaatgagacatggatcctattgctcaaggagcttctaatgaataatat

SEQ ID NO: 9237 - DNA, 1066 bp, Homo sapiens
ccctcatcccagtccctcactgtccagtgtctttgtcattcagtctcccctggtttaatgtgtcagcaggagggctttatcttcttttcaaaatcaaaaggagatggcccagtgtggctcctacatacccatgaaaaccttaaacatttccccttccacattttatcccaatcatctacattgagtaaaaataaacaaggaaaaaaaaaacaaatacttcgccttcataatcaatttttcttctcttccaagttttcgaactttgttacttaaaatgtcaactgtatatatcccttacataaagcataacagtcttaggataccttttcaggtacaaaatcagtgactctcaacctgggcgtattcaaaggactcccttgtggagtgtttgaataatgcaggctccagctactgcctacaggaattcgtgattctgtagtcttcattagtgcttggtatatgggagttgtttagtaatagtcacagaatgttacacagtgaaatgttttcgcagtagtctgacaggacagtggataagtgcattgcaaaatcttttctgcttcctctttagttgaatttggagaagggaaattccctccctctattcttcctacatgtatattaaggaaaatggggcttcttttgcagaggtttccaagcctctgaaagtagatgaatcacccttaaaaggctaataggtcccgctaatcattttgcaccacacaaaacaaatagtgacttctgtatcagtaatactagtaaacagctgtcctagaaatgactgtgaacattagtcctagggctctcacaaacctcaaagtgatatatggagagaacccagcaaattgaaaacattctctttttgtgagtatattttaggtgtatcttgtcacttgagccagtaggagcgtgcttcttggataataatatgggtttcccaaacaactcttgaagcacctagatccatacatgtcggatgcaaaaccatatccatggacctggaactgggctgtgacctaagtgcttgtttttcccatcaaagcgtctttcctttggtaccttcgct

SEQ ID NO: 9238 - DNA, 1031 bp, Homo sapiens
atgatcatgccactacaatccagcttggatgacagagtgagaccttgcctccaaaaaaacaacaacaaaaaaaaactgatagtagagacagaaaagcatgtaatctaattgtacaccatgtggtacaacataaatgagtgtcttctactgatcattcatcatgttccctgtggccttaggcccatccttcggcattgtgggatgagttttacaaattccaattggagacataacagtatgaaggataactagagcactgaggtgagttgataatgctatctaagcaagggttaattgtcaaggaatgcctaatcccagaaatgaatcccagttttgtggggcttgaagttcatactattgcgaatgcctgctttgagaaaaagaataagttagaagaacaaaattgtgtttgtttagaacaaggaaaacaatcacagcaacttaaaagtttgaaagtcaacaaatatgacagataccacaaaactcagaagaataacatagtatttttttaaatgtctgacacacctctctaatgttttttttcttacatttttgggttgaaattttgcttgattgcctttccctaggataacaattttgtaatcattgccatagaaaataagaaagattatttaatttttctccagtgtggttgactgaaatttgtgttttttattattgagagtttagaaccatttctccaaagtcacaacttgttatttttaatgacatgccaatttttaacattgtgtaaaatttggaaaaacttctatcaagtttctttttcatataaacttttacagatactcttgctattaataatactgctgcaagtctgtgttccataaagaacaacaacaaaaaaactagtaatttctgtgtctgtgagttttgtcaacaaaagaaaaaacttacagtgcatttttaacttgtatgctgcatcatccaggagagaactttcattttgtctctgtatgcaagaaccacatcttctagtgacaagtttacatgtctaatcatttggtagtttt

SEQ ID NO: 9239 - DNA, 1033 bp, Homo sapiens
aatgttcagctgattaaactgctcccattacagcttgagtgacactgggtaacagatctgggaccggatcctacatcatcccaccacgtaagtggactatatcatgccttcattcattcatcttttcccattccttttcaacaatgcttactgagtggcaggagctgtgtgggattctagacagccaaagacgtttgctgttgccaccgtcttgttaggagatctgtggctcagaggggattcataatgtactgtgataaatgctatgagccagcaatgcccaaggattatgggagctagtgtgtgtgtgtgtgtgtgtgtgtgtgtgtgtgtgtgtgtgtgtgtgtaacagagggaaggaacgtcagagcgtcctttccacaaggaggtccagttggaaccaggtccaaatagagaaataggtattattctaaaccaggaacacaagagtagcatttgcaaagattaggcagagtgagagaactgggaggtgcatacagcatggctagagctctgagctgcagagaggcacgaaggttctttcttttagtggtgagtgggagtggttacattaaatggttttaaagctgggagtgacaagatcaaatctgcattttggaaaactagccaaaatctgtgtgtgttgcagggtgaaggaaaaggtggtgggatagactggggccaggaacactagttgttggaaaccagaaagaagggactgaagtaagggtaggggagaagggatgaattgaagcacccaactcaagatattagggagggacagttcacagaatttgttaaccagtggttgtgtctgtgtctgtgtggctggatgtaggggtaagtgactaagaaggaattaatgatgcttctcaagtttctggcttgttgtggtgtgcatggaatggtgagaccttttatctagattaaaaatataggagacagagaaaggttaaggcgagaagatcctgtataagtggattttgatgagccattgacacatcaggcagagcttctgaatgggagtggtgct

SEQ ID NO: 9240 - DNA, 1030 bp, Homo sapiens
ctcctttttctataaggagaatgaggaacaggattgccctgcaaggaaaaccagttcttgtctgagtgagaatgactattcaaaaggagaagtgaagaatactctaatatggcctcctggagcaggaatgaccaaaacaggacctccaggaatgggtagaagctgggaggactgagggtgagaggagcctgagaggtctgggagcagggtgagcaaaaatgtagtcctggagaagcacagttagagttgaacaagtgcttcttcaatcttgtggttctggattggggccacattctggcaaaagagcctttgaatggcagattagggtttagacatcagcttgtgtgcagggggaagccatcaaagctgtcttttgtttgcctgttgatttgtgtgacttgataaaattctctactgagcatttctcatagtacccacttaatttttaaaaacaactccagagcagttaacaactccaagtagcctaaggctgtgtaactgagaagaggtagaagtcagcagatttgattttatatccatgtgagacaaaattgtgtgcttgttcaaacctttcactctgtcttctgttccctccccgatgtttgataatgccagagcccagagtggacagactctaagtggtatctaggggacagaccgtcgaagacccagatgtgttcctgcaaccttgccaataagtataagtccctgacagccccacctccccaagtgtttctagcttgtttattcccaggttaggtgtccccttgttctcctaatttctacctctctgggaagcaaaatgagtgtcaatcacccctaagccttggccccaatgctgcaggcaaatagttctttatctcaacctcttagttcctaggtctgtactttacacaggatcagtgtgtgtaatcttttgttcttttgtcttcacagtaacttaattcctgtggtaagggaggatcatgtgtattcttaagtgtgggtccttattatttgtatgtagtttgcatctgtattctgtcagctc

SEQ ID NO: 9241 - DNA, 1026 bp, Homo sapiens
ctgaacagcacaaagttgaaaatttaagacacttttctatataatcatttgagctttcaccaagaatattatttccatatatgttgacaggcgggagaggaaagtttcttagcagaactgagatgaaggcatggctggtctcagtgagtcctctcacgaaacagacacagttttattggtccaattctgcccctaattctgggatctgtgcatgcatgttggtgatgctggcacaggttatccttccaggagttgctatagaaacaggtaacagccacacccactttctctgtctgttttgcattttgcgtgtggaggtctggcggtgctgccttatgcgcccttctttggtgggttgctgcttggttaatgatgctcagtccttaggattttctcttgtttggcatactgagatataatttcctatccttgtcacttttggcttcactccttaggctttgctttgagttatcttgctaacaaaattcacatgtctaaaaacaagctgagagagatcacggacacctgccccttatccccacccaattcatgattgaggaactagaacctttcatgaaaccacaactgctccagaaactagagaacaattgacagtttgatgcttaaaaagagaactagaaaaataccccacggatttggtgatctggtcaatacagagtactttaagtcaattagaaagttatacttcctaggtcattcttcttttgccaagctcagtcattggtggctttccattgcaaaataaaatgtagttacttttgtaaaattttaaatgtagtctgtcatttcttattttacttttttaaagcattgcattagttttgtatttctccactacctctgcctaggagaaatacaacacatgggcttggatgattttctttcttggaaacatggttgacaaagctatacaataaaaggataattttctcagcagaacaaaacacactaccctcttgtcgctgggcttttaaaaatctgaagaataggccgggcgtggtggct

SEQ ID NO: 9242 - DNA, 1031 bp, Homo sapiens
gatgtaaaataaatccatcacattagaaacagactattaaaggcagaaaacgctcagcctctgccaatgaccatttttaaatgtgtggcctttgcagatacatcagttaaccaagacaaatccaattttacctcccaccacttaagtaaatttctcttctttgtaaaatttcctattttataaagacatgcttcatcttgactatgtacatactaaattgttcattttttactgagttaaattgttttctgtcatagtgagaaatgcattcttctgaagaaatgatattcatgcccgggaaatggggatatttattaaaatgttttattaggaaactagatttagacatatttctataattttcatatttaagtatttttattgcccaatgaaatgactttcagtttaaaatggactcagataatcagtctccaaattctcacttttatacttaatcaaatatagttggtggatttatatttgcctgcatatgtttagaaatattagagatgttttcagtagaactctatcaatcttttgctgggttgtaatagctagtaaatgacttaaattattttgtgctttcatccaactctgatttaataagcctttacggatttgggattgtgtacataggtgtgggaggaacacaaaaaacaggaaacttctcaggcctaaagaacgaacaggctgtttacaagacaaaagcacctcacagtaaaagaaaaacctgtgtgtaaatgtgaatttttggacttgttatttaagttgcctcttggaattttagtcatatctattatttccaaagtcagaagaattatctgtgcccagggttattccagataactgatgtttaacattttgagtggcatataacacacacaaaaaagattatatttctggaccactttttaaagtgtattaatgtgtctttcagttttcaaacataatcttttgaacaaagtgataaaagcagggctggcttcatgggcctgccatctatgtcatcgcatagggccctgtgcttagaa

SEQ ID NO: 9243 - DNA, 1030 bp, Homo sapiens
tcatgagggcatggaagcagagagacagccaggcacatccttttctctactgtcctggtttgcttgggaatttgccttgccaagcatctatttaagacagcgttatcccatatccagtcatgggtgttttatgctatacagcaaagccctttcagagccacctctggacatgtagttgcctagcaaataacctttccatcttgagttcataactgatatttgaatgtgactgggcatttctaaaattaagcttttgatcctggaaacattcacagctctactagagaaattgtcattctttctctactcctctctccacgtgcttgttagatttttccatacgttgtttataataacttttccttgtggttgaagataacagatttttgcttttaattcaagaaatgtcgtctgctgtaatgttttgcaacatgatactttccaagtttcaaagcgagcttgtgttgtgggattgtgtttttgcatctgaaactgtaggggtggtgataatatcccgatctacagagtgcagatcctctgcccttccatccctgtcagtgtgtttaagggaacgtaaaggatttttctgtcattgtaatttaaattcagaaggagtctatttgtatggtaatcatgagctaaggaaaacagtgtttcatttctctctgggatttgttttctgacatcttcacattctctactactttaacctggcaacagcatattaacagcaattcatactctgtattttaacatgtagaacagtacccagaagattaatacatgatgaggagaaagaagtaagaagggaggttgaggccataattaattttgctttcatgcaccatatgctggtgttttctgatcttaactgaaattagggtcaccactgagttttcaatatttaaaaaaatgaccgtacatagtgaagcacaaataaaattgcccttcttttgaatattaagcttccaacttggggatgcaaattatattcttgttgtttggattcattatttttcaatgaggctct

SEQ ID NO: 9244 - DNA, 2127 bp, Homo sapiens
ttcctggtcccaccttggcctctcaaagtgtttggattacaggtatgagccttcatgcccagcttccacagagttttgaaggtatcatttgagcctcacagaattttatgagtgagagagtatggatgcatttatcctcattttataaatgtgaataccaaggctcagaaaggttatgtaacttgtaagatattcagctagaaagtggcaggaacaatggaagcctgatctttagaggctttagaggattatacacagtgtaattggcaagttggactttggagttagtctgtagttgaggcctggctcttttatttactaactggatatcattggtcaggtagaagctttctgtccctcagtttctcctatgtgatgatgacaatgataatgattaagacctgctataactgttcttaagattaagtgaggtagtggccaaaagtgctcagcacagatcctagtgcaaaaataaatactcaatgaatgtcagctcctctcataatcgttttgactcccagcttgtgccctttgctccatgctaccctgctctgctggtcatagaagaagcttctgagaatacagcctgtctggactgcatcagatctggggataagaacagctctctgctatttctcagcctctctaatgagtgttactattcaggggagtacacttcttgctcaagggaattgtattagtccatttcatgctgctgataaagacatacccaagactgagtaatttatgaagaaagaggtttaattgactcacagttttgcatggctggggaggcctcaggaaacttacaatcattgtggaaggaagcaaacacgtccttcttcacatggtggcagcaaggagaagtacagaatgaagtggggggtgggggaaccccttataaaaccaccagatcttgggagaactatcatgagaacaacatggaggtaactgccctcatgattcaatgacctcctactaggttcctcccacgacatgagaggattatgggaactacagttcaagacgacatttaggcagagacacagccaaaccatatcagacacagccaagccatatcagaaattgtctcacatcctaggaagaaagatgagtgggaggatcagacattccaagcaccaacccccatcattatcccagccaaatatccaatcaaactgttgtttgtaacatgaattaatgattgcagagattaaagttcacattctagactggtttcctaagaaaatagtttcatcagtaaaaattatatcttaattatacagccagaatatcttatttacttgacctcaccagagaggaggtactccatacataggggagttgtctagacaaccaaaatgtacaccttttaggagcttagacttcaaagtacttcttttgattataagcttataatactccctatgccttttaaaactgatcacaattaaattgaaaggtttagtgatgactgcaggttatcatataaaagatctatgatcacacagtgctgtaatgaagtgtcttttgtgacactttaggcacagttgagggagataggttgttggctgtcaccattaaatgctctctatatgtctatacatgctctctttgcatcccctctatgatctgtgccttttgatttcttgtatctgtttttttctttgtatagctgtcctctttatctcttattcttagttatcacttactgtagtcagaacctgcttctggcactcccatgcaatccactgttgtgaatggagaagctgtaaaatcatagttgctaaaattatgccttaaaaaagtgtatagagacccctagtgaggcccagtcagcctttcctctgagttaagtgcataaacttctaattactcctgatttacagctacatttgagatggttgctgccctcaaggaagttaaaaatcagttggggagagaagacttacgtttctacaaatgaaaaaggacaagtatgtttataataaagtgcttagtcctgatagtaagtgcaataggaatttagattaagtgaagtcattagagaagcttcatagaataagagcaacttacactagaactcaaagaaatgcttagaattgtacattaactcatttattcatt

SEQ ID NO: 9245 - DNA, 1050 bp, Homo sapiens
gaagttccgtgtgctgcaggttcaatggcaggaggcagagaggcattgatggaattccaccttctggctagtaaatttgcttgtccagatgtcacctgagatgtatcatcagaggttaattcctgttgcagccttaggtcagaagggaagtgcctctcttcactcctcagtctttggagaaacacatcttagagtgtgagttacagtcactgcccctaacaaagtggctcatgtgctatggaacattgcccctgatccttgttctcatcacagttctccttattttgtacctgctacctttgtggataataattaactacaatcatggtgttataatttactgtgtttatttgataagtggtatgttcctggttcttgatttttcttttattctctaatgctctatgacataggtgtgggttgactgtcaccaactctgtttatttatgcataaatggctttgcaaacaaaaggaacttttcacttacaagaggacttcaactgaggaactttgaatctcttgtgagtcagtaattttttaaatagaaaagacagctttcacagccttgatataagggagtcctagtttcacttgggctcagtcttttttttttatctgatggatgtccccagataacagaaaatgtgatggttatgtcttccaggccagcatcagccaaatgtgttgtcagagagtgactttaagaacattattttgtttgccaacatcctaaaaattaggacgatgatgtgaactttacaaatgtcaataagtgggggtcagcataatctagtagactgttgactagttccacagtgtgtccttcattctctgtgtcctcaaattcagaggactgacacggggattgggataaaaaagcaaattttttagcatatggatgacaaacagtcaacacctctttttaaacagtacattgatcaacaaaccgtgtctaccaggctcttgctcatcctgccacttatgggtcaattggaggcaaaggatagaaggagaaatgtatcacttcataaatatgaatctgatcattg

SEQ ID NO: 9246 - DNA, 1060 bp, Homo sapiens
gcctgtaatcccagcagtttgggaagccgaggcgggtagatcacctgaggtcaggagttcgagaccagactggccaacatggtgaaaccccgtctctactatacacaaattagctgggcatggtggcacatgcctgtaacctcagctacttgatagcctgaggcaggagactctcttgaacccaggaggcagaggttgcagtgagctgagattgtgccattgcactccagcttaggcaacagagcaaaactctgtctaaaaaataaataaataaaattaaatccccttctctgcttgacaaaagtgtatgtgtgtgtgctcgcatgcgtgtgcacacgtgtgcatgtccttcggtatccaattaaaatgttcctcctccataagacctatttgaatgcccgagccagaattcgtggaacctacttctgtgtcctggtggcactttctgtcatgccagtggcccacatctgctgccttgtggtattagcaattatggctgtgcctggtttcagaatattgctcgaagctgatagataagctccttgagatggggcctgaatcatccatgcaggttaccttcctaccaagatgctctgtatactgcagtgttcagtaaaggctaccaaatcatatctgctttccaaaaatttactaaaatataaatattctggggacacccagaactccctttactaaagcaattggttgctctagcagtattaagagacaatggggtttgtttcacaatagagcttaaatcattacattaattgtttccatatgttgcagttggaaagtccagttccttgttattcttcctactgtgatcctaataaattacattgtctcttcttggctgctggagcctaattagcattaattcttcagtgaattttaaatatattcactatcctttcctatttttcactagaatagattatttgtgctgtcactaaagcagggtctctcgtggttctagaaaagccatttctacacacattacctgccacttctcacagctctccataaatcccatagcaataccaaaatatttctaagc

SEQ ID NO: 9247 - DNA, 1031 bp, Homo sapiens
cacttcttcataattatccctattttgcagatgaaaaattcaggaagtctctgagaggaaaagtaggtgtttcaggtaaaaacattggtttcttgtgaaataatatctcaggagggatgctacctaggttcagaccctctagagcataaaagaaaaagggtgagaagctgatggtagaagatggccttgtttctgtatcgtgagttatgagtgctgattgtcagtgatgaagacacattgcaggaagtagccaagtgggagaggtggaggtgggttgccaagagcatctcaggaaactcagactggaactcctgcaattgtggacaccaaccctgtgaatgtgttgtttttacacagtaactctctgagggaagttgaaaaggtactaggaaaaaatggctgaagcatcagccaagatttagagccctttcttgtggttttcgcttagccaaatgttgagaatatggctgtacattccaggcagcatagaggagaaactcgagagtaaaaccacggcagacttagtgcagcaatgatacacaccacttagtattcttttttttttcttaagctagtgaactagcaagagttctacataataacaatccaaataactcattgaatttctagcaacatttgtttattatttattattattattggcaaactgaacatctaacctgagagtaaaatgctgatacgaaacacatgaccatttgtgctgctgggacaaggtgggggtggggagtttataaaggtgcctttaaatgcatgaaatagatgcttttcctacattgacactagcgtcccaacagaaggatgacaccaagagagtctcagtgtcttttataatgtcctagaaagtgatgaaggctggggtaggggtgccagggatcagcaggggctgggcaatgagataaaaaggtcttttaaggcttagagcagaggtgtgtctgctgagatgtccaagagcaataaccaaacagtcatcctaggtccagattgcatcctgctcttgccagtggaatctt

SEQ ID NO: 9248 - DNA, 1050 bp, Homo sapiens
agaaagctgctggttgagtcactgccagagatgactattgctgaaaccataaaatggactcctttaattcattaagacagaaactacagcaaaatcaactctaaaagtgttatttctggagagagaataaaaagctatgagatgagaaaataaatatgaaagagctttgcagcacattctttctttaagcatcgagtgtctttattgggaagcttgaagcctgggtagtttgtatgacaccgtgatttaattgtgactgtgtgatatgaaacagatgacgatgcttagaactcaaggctctgttaaggttttataatgtgtctacgcttctaaaataatcttttagttcctaagaatcactttctggaatccactacccctcctaacacatacacaaacacacatacacacacacacacgtgcacatgcacacaaacacacctttcaaatctgatgatagaatctcttctggtctactcctttaaattagctcaccagtcatgatttatttaaagaacaccggactaggaatcaggctacctgggtcttgaagctgccctgctgtgaatagcttgaagctatttaattgccttgaaccttagtttcccctactatgaaatttggcaaacaattacaatcctttatacctcaaaagatcactcttaggatcaaaccttctgttttgtatcaacgtatttttaaaactcttaaagcattggatataataaaggattattattattattatcatcatcatacaatactatgataatccttttaaaacattactatcatctcataaagataaaaggctccaggctgccaaaaaaaataattatagtaattcttttttcaaaatccttttaacaggatgcagtacctacctggtccagaacttaaatacatttgccagaaaaataagaccttatattatattcatgggcttctttcctttccagaagacagtccaggacacctggaaaggctgtgttcttagatagttgaacccattacttcccagaaggaagcaggaagggtgtctcattatct

SEQ ID NO: 9249 - DNA, 1033 bp, Homo sapiens
gagcctaaaagcagttcctaaatcacattacctccgatcatccttgggagatcataaatacataattcagaagaaagatcttagatttttcatgatgtacccattataattcctggcatgccactctagagttttaaagatgctgataagtcttgaaattagatgtagggctaagctccaggctaacgtataccttgctgttatgtaattgaaataaaatctacttttaggtgactactttcaaataaaatagaaaaatgtcaatattttaaaaaatgcataagtactcattagtagccctcttaagaagcttcacaaagacaaagcactttaaactaagcaaccagtactacaaagtagactgagcgatccagtgttctgactttccccatattgagagaggcttaatttgttcttgctttgtttttgaattgaaggctatgaaagcaaattttgatcccataggataccaaatgactgagattttctcttcatggtatatggcattcttcttgtcactgcaaataactttggcaaagtctcaactttgcatgtcccatctttgccctccaaggcctaagaacctcttctcattaggtgagaaagtcagaaaggctgcagtcaaatttaaagcaatattacagccttgttggcagggagacataaccgcagcagacagactcttgaggtatgcaggaattagagatgcgcttgtttggtatcagccagaacagaatgggattttttatttagcattttttacaacagaaggtgttgttctgtctctatcagcagtagccagggcatgcttgcttcatctctgaatgaagaattacaaatatctctgcgcaaggccgtgacagacccatgatgtgtgctttgatacatgcacaaaaccatttacccgtcttcaaaaatgatgcttccagaagcaattcatttaaaagttcctgtcatgccacaagggcatcaacatgtaaggaagagtgaactcagtttctcatggtgtaaagcaagtacacacctaggtgaa

SEQ ID NO: 9250 - DNA, 1036 bp, Homo sapiens
gaggctgaggcaggagaatggtgtgaacccgggaggcagagcttgcagtgaaccaagatcgcaccactgcactgcagcctgggtgacagtgcaagactctgtctcaaaaaaataaaaaaataaataaaaataaaaaattaattaattaatgttaaattgatataaattatcactcatgagaatacacagatatttggtgtgagatttaattgacagtccacaattgataattaaccataaacacactcatgtatgtgcatgcacacacacatacacacacacgtacttccagcatataaaacataattatacccaaagttaccctaacacagttgaggataccagaataacacaggtgaagtacttatgaactgtaggacagcacatgataaaattttatacccaactttgagaaacaacttgtatgtgctataaagttaatggctgcacttatcagggaggacttcacagaagaggggagacttgacctgggccttggataagaagaagatcaacgtaaaagaagagaacactgatgattcaagcagaagatataaagagggatgcatatggcacccttgggagactatgacaggagtagcctacctgccagtggaagtaggaattggagagcagtagaggagggaaattgaagtagtttcgactagatacttgatgaaatacagaaccataaaaggtttttgagcaggatggtggcatgatcaacgtcatatacaaagacagtttatctgggaaaagaggactttggagttagaaggagtctgggatcagaccagctggttaagaggaggcagatcgaggtgtgaggggattgctatccaactgcaggtagtggtagcagtaagataaaagatacctggataaatgggcaaaactcagtgattgaataggaaggagtgaaggaaggaacaaggatagttcttcctcatggatgtcagaagctggtgttcagtagcaggcatgtatagacatcataagtttggttggcttcatttgtgtttcttccctttaaatg

SEQ ID NO: 9251 - DNA, 1041 bp, Homo sapiens
gaagcagaggctgaccttgtccagggcagtaggattttttaaaatcgcagtataatggcatgttaactgaacgctaaagtctaagtaacatttactctggaagttaaatgagataatgtcggttggttatcataataataatgcactagaaaataaagtcaattaatttgttttaaaaaagcaatgctcttatttgcttggaacactataagtactcaaaaatgaagaaaaagaaaagtagacatttgccaggtagtcagggagaaaaaggaacaatgtatatattccagagagaaggaacaaggtgtgtgtaacaaaaccagacagacaggaagagtaggcacagcgtgtatgtttgttgggagagcatactgaaaatattggtaaacaaattatcatatttgctttacaaaatgatccctgagcctgcaaaaaggagcatggcttgtggatagaggaagatcggataaaaggagaccagtcaggaggctatagaccaggtctagataagaatgaatggggatctgaactaaggtaggggatggagaagagaggatagattttagatagttctaggtggtagaattaatagaacttggtggctaattaaatgtgataataaacaggcaaagaggattctagaacacctccctgcaggaactcccggtaaagtttgagcatgtcatgtctgacttagggcatgcatatctgaaaccacctgtgctgaatgacaagcctgatttttccagcaccaatgctcttcttgattgtttgcttgacactttgggaagtagcattaacactctcaggtcactagggggctaatcatagccattttcatgattgcaattctgaattggagttttcagagaataatcatggcagttcacataagggtctttcctggaagaggctctcactgtctttggacaatgtcatttgcattaagaccattccatgaggctagtgtcataaaaatcattacttatatagcttttgctctcaaatctttagtcattccagaggtctactgaatactaa

SEQ ID NO: 9252 - DNA, 1027 bp, Homo sapiens
gctattcccatgtaacaaatatggatattgagacataatttatatttgctcaaggttgtacagctcagaagcagtggaaaaaccagcattcttatggcaaacctgtctgatccagaagcaatgtttttctcttactctctactgttgtgaagatggctctttgaaggcactgtctgatccttcttgagcttctgcacagttcctagttgggagctgagttactctttcagatcatagagaagtctcattcttggcaaccaaactgttgtgctgacccagacattttatatctggagctgccatttgagagtcgccagcagagggttcaagttcaggtaagccacagcctaccagttttgggaaatgataaggataatgacattcctgaccccagccttccaagatgctcaccaagcccaaatgtgcacctgttcagagcaagccataattcctcacctcagaccacgaaccatgttcaggtaatcatgaagatgattcccattgattcagtaggacccaattacactgcaaaagagtgaaattgagtagaagaatggcatttggggacagaattgttaagtaacgaaaaagaagtaatggcaattgacccttgaggtgtctgatcagacccacacaagactgctaggaaaataaattagttgtaagggatctataccttctctgtgaaccccaggccattagcattgtcctttcaatttctccagaaagttctcaggcttcatttagctactgatactgtagaaatttcatttttaggaagaaagtcataaatatagcaacacctatactcttttgaaaaggaaagattcctagtatctgggcaataaagtgagaatttgattcatttatttaaaagatctctcaggtacaaattcagtcacttctagggtggtcttttatttttttccttttatgtctgtaaaaagagatatgatcctcccactcctgcccatctcactgatgtctttagaaagctggaaccagagtctgattacagacatttgtt

SEQ ID NO: 9253 - DNA, 1117 bp, Homo sapiens
tcccaacactttgggaggccaaggtggaaggatcacttgaggctaggagtttgagaccagcctgggtaacatagcgaggactcatctctacaaaacaaaaaattagccgggcctggtggtgcagtccaattgtcccagctacttgggaggctgaggtgtgagtctgaaactgcagtgagccatgattgtgccactgcgctccagcctaggagacaaaggaaaaccctgtctcataaaataataaaaatgaaattttactgtatgtatagatctgggcttaacaacttatgaggagatcaatttttgaaaatagattctaattttaaagggaccagggatctttatatttaaaataacctcataatgaatgttcatgaaaagagaatggaatcagttatctattttgtaaattaggatttctctatagcaaagtacataatatctgtacacattgtatgtataaatgttaacatgcatttacttttaatgtgtgtgtaacttaatgcacacggaaatgataggatggggtgaatacagaattagctctgtaatacctggggttgagtctggccttgacataggactttaggcatatcttttaacttctctaattctcattttccccactggtaaaccagaaataataaagtctaggaaatgaatgtgatacagatttataaactgtaaaacaagtacaagctgatgtgatttttctacttatacattcaaaaagaaaacttacaagcttgaggagaatacaaggggcttcacccttgaaatcacaactatagaatgttttaaatacggttttgaaatgccagcagaggcagaagagaatttcagtaattcaggacttaattggttctaataaaagacagtgccttcaccctactgctcgccccatggacactttataccatgagcctttgtgaagcagagcttggcatctacccagacttagcttagaagagcctgcaaaacccgaagtgtttgtggtgggcagcattgaaaccagctctgaagagatttcctatattcgggtttcctcctgctttgatttcattgtacttctttaggcatttcaattaccattttgaacacaacatctttgagagtt

SEQ ID NO: 9254 - DNA, 1235 bp, Homo sapiens
gatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggtgagtaaatacccccagttttcattatgtgcactgctttataaagaaagatggaagatggcggggagaagagtaagagagaaggaagatgggataaggagtccagtgtaatgaagcctctctggagctgagtaaaggatctctgagcagactgcgttttttgcttgttggctgttgctaactcagccttagtttggagttcacaggtttgctg

SEQ ID NO: 9255 - DNA, 1025 bp, Homo sapiens
ctgccattttacaaagcatttttgtcacatataaactgacattgtttgacagagtgggggtgggggagataaggaattagaattgaaagttgctaataaagtttatgctcagatccactttacataatgagatggtgagttagaaaagactggagttaattgctaggtagaccttctgagaatgcataagttattgaggtgactgcatgatggaatataaatacaaaagggcatatagacagcttctcggttgtgcattttaagagctgtaaatcagagtactaggaaatgatgaggtgtgtctgctatgctaaacagacctttatataattcagtgtcatattgcttaattctgaattgaaagaaaaattattggactaatggaaaagtaaatacatgataattagttgaaaacaaacgtagagcctggggcctctgcatattttcccttagagaaattagtggctacaatttgaattattgctgttacctcattagcataattttcaaggctgagaaccaaccctttaaaagtctacatattaaagagctttgtgaaaaatggtaaacaagaaagacctcttattgatatatatttatgtaatacctacaaatagtctcttttttaaaggaggattagaaaacattctctggactcttattagcagatgactttggggaaagagaacagaattaatggaaatgaatcacttaatcattttaaatttgattttgagaatgtataattaggccatagatgatattttaaaagctgaaagattggaatttttctccacactccatgaaggaattgagtgtacccaggctactagactggacatggacgtctgattagtgcacatggtgttttttgaaacatgagggggtggagtggggtgttactgactcacagacggtgtgcttggagctgttttgcaagttgtgaagaacatactatgtcctcctttcacttattttgagtcagatggccaggttgggagttggggaggaaggaatgtctagat

SEQ ID NO: 9256 - DNA, 1026 bp, Homo sapiens
cacgtgcttatgttgctgtaggaggctgctgactggtctccctccttcctctctggctgcccttccatctgttcaggagcagaagccagagggatcctgttaaaatctacatcacatctcatgactcccatctcacagctcaccagtggcttccccctcaccaccactacagccccactataatgtaaaatctcttcaagaaatgttggacttgcccattgctagaccctcaagcccctagaaagtgcctggtagattctaaatacatctgtgttgaagtaattaattaattaattggttttggttggtttctatttctctttctgtgccacatctttacccctgcatctattagcctcacagtttttcttaaagatttgtggggggcgagttgtatattaagaatatccaactatttctgatatttgttgccagtattttcccagtttctttgccttttaattccattgtcttttttttcccataaactgaaatttacatttttgtagagccacagctgtctgtttctgtaataactatttttcttgttgtggcccttcaaaagtctgcaaagctgtaacattctagtgcagatcatctggccatgttcttgcccactcattttcctgtgtctctcccacaggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaacccc

SEQ ID NO: 9257 - DNA, 1050 bp, Homo sapiens
tcaagtcttccaggctccaaaacccatcctcttctcacaatagcgggccactggtcaaagtgcaaaagaaaagaagaaagtatactagttattgtgtataaattataatagtgtgtgtgtgtctgggcctatgtacaaagtgcaaaaagccacttgagtgatgtccagaagtgtgctctggaaggctggaagaagagagtatttccagtcttagaatgaagacttgagagaagcagagggacacttcaattggaccatgatgagttaaagagtctggggaaaggaggatattccaccgtagggggacccatgtgatcagaagaaaagcaagtcatttcttcttggctggaatgtagagaccatgaaacaagagggggatccacaaggcagaaaggtggtctgggccagatggaggtgtttgcctcttcacttggcctcacacagcaacattctaggcacagggaagagccacaggtgcaaaagtcctggggtgggaaggagcttggtgtgtagaagaacacagaggaggtcggtgcagttggagcttgctgagcaccagagaacggatacattttaacagcagcactattgcaggtttttaagtaagtgactggcatgataatttacattttttaaagctggctctggctgatcctaggagaagaaattgaacaggctttcttcccaaaaagggaagaaagcagagggccagtaaggtactctctgtgaacatctctgtgagagattgttttccctgctgtagtgtccatcacaaggagactaaaggaagctttgctgtaacctataacttcatcaggacaaatggctttgtatcgcagtagcagctgtgtcctaggtagcctagaaggctatggttatagcactgtggcatatgctgagggagaaggaggaaacaggaagttttcagatggagctagagaccatgggcagccagggagataaaggttttcttcatggaggaaggggatattcctactgatatctttaagcatgagtaagatttcagtaggacactttggagatgccctc

SEQ ID NO: 9258 - DNA, 1050 bp, Homo sapiens
attaaaatgtcctattaccataactagcatccgggagaaacagagaatgtgaaatcaggagctcttgcttccaggtaccacaatgccaccactggtggcatgacgcttacaccaccctgagctgagccatggtccttgagggtttggttccctcatcttctatagttgctatggacccaccactcttaacatctacgatctcagcaataagaatcaagaagccaaataaccagttctcactgctaggggcttaagcagagggagtcgagccagagtcgccgcgatggtgttgttggagagcgagcagctcctgacggagctgaccagacttttccagaagtgctggacatcaggcagcatcatatcaccttgaagaagtatgacagtcgaaccaaatccattccaaagaaaggtactgtggagggctttgagcctgcagacaacaagtgtctgttaagagctaccgatgggaaaaagaagatcagcacagtggtgagctccgaggaagtgaataagtttcagatggcttattcaaacctcctgagagctaacatggatgggctgaagaagagagacaaaaagaacaaaactaagaagaccaaagcagcagcagcagcagcaacagcagcacagtaaaggacatacatttcctgctttcaccaattaaccactgaattgctattttttccttttggccacatagctaggtttctggttcccccacagtaggtgttttcacataagattagggtctttttggaaagaatagttgcagtgtttataggatagttgtggtaagaatctagtttattttgcatttggctaattggtctgtgctgcatggttatatactcctggattatagataaaaagtctccgtagacatctctgtgaagagcaagctatcattaaacatgtctgtttatcaagaaaaaaaaaagaagccaaatgatgaggtttgcaacctcaccaataataaatgaaatgcctactgaacaatgatccatttctttcacccaggggaatggcagcccattaccactgacaaca

SEQ ID NO: 9259 - DNA, 1032 bp, Homo sapiens
tgtaactcacatatcttaatctcctgcattctgaaatctccatttgcactgaggccatgcttcccatgggctgctcctagccactgacagtggcaggcctgttcctgagaatctccccacgggttcttgctgaacatttcttatactgcatggctgtctaagaggggtctacccattgttacttccctccattcagtgttagacttacactgaagtctgaggcgcttgtaacttttatcagctccctcccattttccctcacacacgcatttctcctaataaaatatttgcaggtttactcccatcttagcgtctgctttttagatgacacacagttacacagcaacaaatgcaatgtgttatatccttggattggcttctggtccagaaaatagacattagtgtgataattgacaaaaattgaatactgcctgtagattagtaaaaaatattgtgtcagtgttaatattcagattttgatcattgtaccatggttatgtacaagacgttgacatttggagaagctggggaaagggcaaatgggaattctaagcctgaaatttccaaataaaaagtttaaaaaatttaaaaattatacacaagaagaaacagttattctatcgcattttaggagcttaaaaataataaatgtttatatgtttttcaataatcctctgagatgaagtaatggatacctaaaatttgaaatattaggatttttttcctcttaaagtataagaataaaacacaaatctaggtataccatttgaggaatttttacatatgtatacacttgtctaaaccatcatacagatcaaaatatataaattttcagtaccccagcaagcttctttgtgccatctccgagtcagtaacttccagtaaggtaactttatttttacctctcatggattagttctgcttgttcttgaactttatataaatcaattttgttgtacttttttgtgtctggctttttaaaaattcagcaatattatgtctatgagattcatcaggaattagtcttaatta

SEQ ID NO: 9260 - DNA, 1035 bp, Homo sapiens
cagtttcgatattatgatgtaggaacaataacttcaatttgttgctaactgctttactgtttactgcatttttgtgatttgaaaagatgctaccttttaactaagattgatgatgaatttttttttacctaactctgtcagcatagggtgctgctgatggtattaaattaatatccataagctttcttttttgatagtaaccagaaggcctacctccttttcaatttttggacttaaaaattagatcagtagttataatgataaagggttagaaaaaagttcgggaccacaaacaaattttgtttctaacagttttatgaaagtattcccacaaactaaagctttgtgtactgaatgaagatatgatttctgaatattttcagaaatgggtttattactgaacacatttttattcgaatattttcttttatttgctgctttactgtatcacttaggaaaagtctgtccttaaactttggatttaaaatgtgatgaccaatgtgcttggctttcaagataaaattacctctgaattttcatctgcactcaacttatatcacatgcacaataattttagcatcttccctggaggagtacgatatgatctttacagcaggtatcatataaaaaatatttgcacgcttggcatatatgtttgggtatttttctttagcagctttctgcaaataaactttcatttgttcagtcagcctttttagcacataagagctgctattgtgtgtgtgtgtgtttttaatatcctgataaagtaattccaaaatcttttatatgtcataatatatatctttggctgaagaagatttatgaaagtggcctgctgtagtcctacttacagccagtaattctctacattttgttttgctacattcgctacctctacacacaactgaacaaaacatcatacgcttaaaagtcctacattacatattcatgggcttcatcatgtctattctttgtcagtgacagttacgtagcatttttttcaaatgaactttgcattctgaaaatattcag

SEQ ID NO: 9261 - DNA, 1023 bp, Homo sapiens
atcacctgaggtcaggagtttgagaccagcctggccaacatggtgaaatcccatctctactaaaaatacaaaaagtatctgggcgtggtggtacgcacccacaattccagctactcagaaggctgagacaggagaatcgcttgaacccaagaggtggaggttgcagtcagccaagattgtgccactgcattcgcctgggcgacaagagcgaaactatctcaaaaaaaaagaaaaaaagaaaaaaagaaaaatttctcatcaatagtctagaacagtattgttcagtagcactttctgtgatgatggaaatgttttatatctatgtacagtatgtacctgttagccacatgggctgttgaataaaatagtgtaactgaggaactaaattttaagttttatttaattttaattaaatttaagtagtcacataaagctagtaaccactctatggacagtacagttgtagatgtactacagaactgtaaacagtctaaattcaggggctcctatgagtaagggaaagtaaggaagaggaactgtctgggaactcagttgaagccactgttgcctaactaggaataggtaaagaatcaggtcaaaacattttttattttgaaaacaagatcattgttcattatctctagtagaagtgctgctctttatataagaaaacaacgtgcattcctttttttacttattcagtaaatacttgtctgtttatcagggactgtagagtagtccctgcttatccacagtgtatatgttccaggacccctagtggatgcttaatagtaccaaactgtggataatattgattcctgtatatactatgggtgaatttatttttccttctttataattccactgatagaagatttacttttaccatagatcttagcaatcagcgtataattttttttctttccttattgagaactttcagcttttcactaaaaggaagcactttacagcctctctttgacatatcaaaattgccagcattactactcttatgctgtggag

SEQ ID NO: 9262 - DNA, 1050 bp, Homo sapiens
tgttccatgcctgacaaaaaagacacagaatgttgttcattgcttctagataactatccctcttaatgagcatggttaagaagtcaaagtattttaggaggccttgatatttaatttctttagtcattatttatactattaaatgtgtgaacatagaatttggctgtacatcatttgctacttcaaggtagttcttcagtggtgatcagggtttcactgtgctctcagaaagtagaaatagttaatgtatttattctttcttttccttctgcctttttttacttctatccctttttctctttttcccatttcccatcttttactcccatcctcagtctgtcagtgataacaacagagataaagcatcaacacttacttctttgaaaattggtacccttggtgaagaaacctaatttcttttaaatggaacgtgtgttatctttgcctttgtatgagtttgttgttaatagatcaatagtattttgttacctagataatggaaatagaagagcagaagcaaaagcaattggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggtaaggggggcaagaaaatatgagcacttgtagcgtttagaaaagtaaaatggatggctgggcgcggtggctcatgcctgtaatctcagcactttgggtggccgagacaggcagatcacttcaggtcaggagttcgagaccagcctggccaatgtggtgaaaccccatctctactaaaaatacaaaaattagctgggcatggtggcacgtgcctgtaatcccagctactccagaggttgaggcaggagaatcgcttgaacctgggaggtggaggttgcagagtgagattccatctcaaaaaaataataataataaaagtaaaatgcctttgtaattcttatttggtctttttttgatataatgtatgtatatatgaataa

SEQ ID NO: 9263 - DNA, 1341 bp, Homo sapiens
gataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacagga

SEQ ID NO: 9264 - DNA, 1058 bp, Homo sapiens
acccagaagatggggcagctcagagactggtttcctaatacacaagacctagcaggaaatgatcaagaaaatattaggcatgcagataggaacaactctgatgataatcatttggcttcagaagatactagtgccaagcaaagtggtaagataattgtgtttgattgtaattatttcactgattattccttgttttcgtcccctgtagcttgctagttgaagaaaagttagaagtatgttaatagattttgtattgtatccaactttgtcattgacttaataggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaatagatgctttgataaaacaagatttttaaataatttgccagttttctactttttttttagatggagccttgctctgttgcccaggctggaatgcaatggtgtgatctcagctcactgaaacctctgccttctgggttcaagcaaatctcctgcctcagcctcccgagtagctgggattacaggcgcccgccaccacacccagctaatttttgtatttttagtagagacagggtttcaccatattggccaggccggtcttgaactgctgacctcaggtgatctgcctgcttcagcctcccgacgtgctaggattacaggcgtgagctaccgcacctggtctacattttttcagagtgctaaatgttttttgttaaacttatagcagaaaaaggagatggaaaaaaaaaaaagaaacctagactgactttcatgaaaaggaaaaaatggcttatttaaacagtatttaaaatttggacttaaggaaatgtggcattggtaataactatgactatgtagtttctttatcttgtatatggggaaaacaacttattgtaggcaaaaattttttggttttccatcttctgacagtcttgctccccgtttcctttcatgtctgccttctaaat

SEQ ID NO: 9265 - DNA, 1003 bp, Homo sapiens
tagctgggactacaggcgcgtgccaccacgcccagctaatttttgtatttttagtaaagacggggtttcaccatgttggccaggatggtctcaatctcttgaccacatgttccacccgcctcggcctcccaaaatgctgggattacaggcgtgagccaccatgccctgccaagagttaggtattccttacagtctttgcattctgggcttgcttgtacccatccttcttgggacagctttctgagtattcaaagggacttcagtgttgtgatctaagtttttggtcactgcagccatgtcttcattaggggataccccaagctcagtaacactgtagttcttgcagactcatagaggtactgccttggtggtcttggataagatccagaagaattctctggactatccagcagagactcttattctttaccttcctgtctcccaaacaaatagagtcagtcagcctctctctctctctctctctgtgctgagctgcctggagctggggggaggggtgacacaagcacccctgtggccatcatctctgagactgtgctgtgtcagacctgagccagcacagtactgggtcttgcccaaggcccactgtaaccactacctgcctaccatctttgttcattcaaggccctagggctctacagtcagcaggtggtgaagccagctggtcttatgtccttgccttcagggtggcaagtggccccgggcaaatccagagatgttgtccaggagtcagtgcctggaatcgggatctttagaactctactgggtactctactgtggctaagcaggcaccaaaatcacaaacaaagtcctttccactgttccctccccttccttaggcaaaggactctctccccttgtccaccaccaccacaggcctatggagagtactatcatggtaccactgatgatcacttaaggcccagtggctcttcagttagcttgttgtgaatgctgccaggcatgggacttccttcagggcagt

SEQ ID NO: 9266 - DNA, 1024 bp, Homo sapiens
acctaaggcccatggcatatactacttggctaccactgctaggacccaagggctctttaatcagcaggtgatgaatcctgccaggactgggtccttcccttgaaggcagcaggttctcttctagcccaggatgtgtccataaatgtcatccaacagctaggtcctagtatggggacctcataagtcctcccagtgccttattcttctgtgactgagtgggtattcaatttgcaaaacaaagtcctctttattcttccccttctctccgcaagcagaaggagggggtctcttttggagctgtgagctgtgctgcctgggattaggggaggggtagcacaagcactcccttcgccaccctagctggttttcactaggtcatgtgacccctccaagtctacaagctctgagcccagcacagcactaggacttgcctagtgctgcagttgcagtctttgtggcctaaacagcctttcaagtttgtttaggactccagagcactaaatttagcccgtagtgacaagacttgccaaaactcaacttccaactgctagagtggatacttcccctctggctagggctggtctaaatgctccctccaagggcactggcagagttctacttggtgctggccacactgagttccaatgcaaagtcccagaatggctgagctctccttcccccaagcatacagattctctctccgcaccatgtggccactgcctggagatgagggaagggtggtgttggcatttcaagactgtctttgctatcctcttcagtgcctctgtcagcgatatgaagttaaaaccaggtactgtgattgctcaccggatttttggttcgtatgaaggtacttttttatatggttgctgttgtgtaatcaggaggaccagggagagaccttggggtgtatacaggagggtatctttattattgagtgcactcagacccagcagactcaacgtctaaagactgggcgcagaacaaagacagtacttggcttttatacacacttcacaaaagg

SEQ ID NO: 9267 - DNA, 1156 bp, Homo sapiens
gtaggaaagcagggaatggtgtcctgtggtgctaagaatttgatttgtcttatcccaactatatttttctcccatcttgaactccaaaatccatttttcagttaagctgaaggaatctgttgttgaaaatcatgcagtgttaagttatgctgtggaggaagaacatgcatatttgggtccaactgtgaagccagatgataaggttagtaatgtcttaatgttcactcgatttttagagctgtttggcttcgtattctcttttgtttagtttacagaagctatgttataacattaaagtcagtgctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcagaagtgacaactgctggggttggtgatttggggttttcttacatactacttgctacattgtggtatgatattccccttaatttctaggctaaaacactgtcttatgaaccattatcttcagcaactgtttccactgggagccttttaagttatgaaaacacagatttgagccttacagatccaggtaataaggtcaaaatgtttataaataagttgaaagaccggcaccagttgagttgcaatacagtgatggaaggaagcattgggttttcatgatacaccatggggaactatttctctaaatctcacaagtaaagtatggccaggcgtggtgcctcacgcctgtaatcccagcaccttgaggtgggaggatcgcttgagcccaaaagtttgagaccatcctgggcaacgtggtagaaccctatctctacaaaaaaatacaaaagttagccaggtgtggtggtaagtgcctgtagtcccagctactcaggaggctgagg

SEQ ID NO: 9268 - DNA, 1034 bp, Homo sapiens
gcattttcttttaatccccactccaatttatgcctgtctccaagactggcagaactaatcttatacacctagtgttatagtgccaagttggaagttttacctaaacttattcccagatattgaaaaatgacttcagaacaactggtaattttactaggggagtagggaggcaataagaataaagctatctaaacagaggcctagaggtgtgagggcagtggagcctaagcccagttcaagaccagcctgggcaacaaggcaaaacccaatccctacaaaaaatacaaaaatcaggcatggtggcgggtctctgtagacccagctaagattgaggctgcagtgaggtgtgatcatgccgctgcactctaatctgacagcagagcaagacccgcttaaagcgtttaaaaagagtaaaacatgcaactttcttgccattaggtgagtgagtttctgcctcttgtatcagcaacagaagcctcagattatccagctgtatcagaactttccatagaaaaaccaaggacagcatctacaggtaagccttggacggcctccacacttctaatggaaagtagatactttgcctatttctgtcataaatttcttttcccccagcagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagtatgttgaatttttaaaatcttcaaccaactccctgaaatgtttaaagccttgtgtttacaacttgatttcacttttctttcctcaggttcatctgtgagtcgtctaaagggcgtgaataaagtcagagcatcttttcctgaagacagaaagactacacaggctctaaggcaccaaaggggtctaaggtagggttaattttttttttttttttagtgattcactttttgcagtgtttgtctctaatt

SEQ ID NO: 9269 - DNA, 1062 bp, Homo sapiens
atgcccgcgacccctgaagacccacagcctgtcttacaacctgtcatggttgtgaaaagttttgagagaacgtctgcacagtgtctaacggtgtctggtatatagtgtgcactcaaatggtaaccagtttagttgcgatagttggtctacccctccaggtgttaacctctgcagctccgtttcccttctagaccctatttctgggccatcgactcccaccaattaggcaggaaaatactgtttgcctccatctggcccaaggctgtattcctggagtttatgtgagaacctaactcctttctcagctccaactgtaaccctctccccacctccaacacacacataaacactcacatacacatgctaccacactgcctgctgtgccatcagcctgcctgaagttcacatcattttagaattggacgggccttcataatttaaattttattatgaaaaagtgatagtctaaggaactcatttgatttttttgtctaaatgtcaaatatagagtagaacgcacaagtgtctgttatagaaatacttgagagtcctatatgcactgttatccacaaccatttaagcacttatccactaatccctaataagtacccctaataagtacatttctaaaccagttattcaagctacatcctcccaagattggactttgtttctactttggtagggacataaataaacggaaacaactgacctaactttttactaaagagataataaagggaataaaattaagattacatttggattttaacttgtgttcttattcctactgccagcaaaaatatgtaaagtgtttttatcattataaatgaatatactattcattgtgcagattttgacatgttcataaataagttagtacccaatgtttgcttgataaagaatgtgataaaatgttaacatttgggaaatctgggtgaagaatgtataggaattatttgtatgtaatatttgtcaatctgaaattatttaaaagaaaaagttaaactgtctcattcctgaacaattataaattattcaacccaaaactgaagggggcct

SEQ ID NO: 9270 - DNA, 1034 bp, Homo sapiens
cctggcctcactcgatgctcctgcctcggccacccaaagtgttgggattacaggcatgagccaccatgcttggccagattttttctttgattgcttttctagaatctgttttcacttttgtgtttgtttctattttccttctatatgtgcaggatatattcagaaaaagtagaaattttatggcctggcacagtggctcatgcctgtaatctcaatactttaggaggccaaggtggacagatcacttgaggtcaggagttcaagaccagcctggccaacatggcaaaaccccatctctactaaaaatacaaaaattagctgagtgtggtggtgtgtgccagtaattcccgctattcaggagtctgagctacaagaatcacttgaacctgggaggcagaagttacgttgagccaagatcgcgccactgtacttcgacctgggcaacaacacgagactcagtctcaaaaaaaaaaaaaagaaagaaagaaattggcaaggtgcggtggctcatgcctgtaatcccggcactttgggaggctgaggcaggcagatcacgaggtcaggagttcaagaccagcctggccaacatggtgaaaccctgtctctactaaaaatagaaaaaatagctgggtgtggtggcgggcgcctgtaaccccagctactcgggaggctgaggcaggagaatggcgtgaacctgggaagcagaggttgcagtaagccgagattgcgccattgtactccagcctgggtgacagggtgagactccatctcaaaaaaaaaaaaaaaaaaagacattttgtaagaacttttgatccttaaaagtacataggctgatgcagtggctcatgcctataattccagcattttgggaggccaaggtgagcagatctcttaagcccaggagtttgagagccacctgggcaacaagccaaaaccccatttttacagaaaatacaaaaattagccaatcatggtggcatccacctgtagtcccagctactggggagtttgaggtgggaggattacttgagcct

SEQ ID NO: 9271 - DNA, 1123 bp, Homo sapiens
gcgtggtggtgggcacctgtagtcccagctactcagaaggctgaggcaggagaattgcttgagcctgggaggcgggggttgcagtgagctgagatcgcgccactgcactccagcctgggcgacagagcgagattccatcccaaaaaaaaaaaaaaaaagaatgtaatactttaaaggttaccaaatcttaacaaattcttatagcctgggtccttggtctgtgatatattacacaaaaatgtgatgatataatggctttggaatcaggtagacctggattcgaatcctgcctctgccttcattaactgtgtgaccttaaattaagcaagttattttctcttaagtccctgtttttccatctaatccttccttccctttttttttaagggatggattagaaaagttaggcgaaattatggagcatattgagagctgggtagaattgctgctatttcataaacagtgtattcaatttttgaacatttgaagatgaaagagaagtagcaggaagatgagttggtgaatagtctgaaatcattgaggctacttgggtccttaaggaaaacaagtgtcaagaccataaccaaattagtcatggagaagaagtaatgactgttagaacccatttgtaaataaaattaattgaatagaattactcacatagtaatagtttcagaatctagaaacattgtgctgggggactaatagagttccctaaatctgcattcttcattttatagagagaaaactaaagcttaaagagatttgtaatatgttcaagttgctgtcaagccagtagttagggagccaagactagaactccagcacctaactcatagccccactgccttttctactattctgtgcttttcccagaagggagtctccaggaatttcttaatatctccaggaactcttttatttacgttccctaatacaatcaaaagattattttgatatgtttatgaagctttttatgtgatttttgactctcatacagccagaaaactgtattaaactggttagtaaaatacacaaattatggtgattgtggatatttatatatgcatatgtgatacatagatagtgacttctgatcagttttccaaaaaattaggattca

SEQ ID NO: 9272 - DNA, 1050 bp, Homo sapiens
ggttttgccatgttggccaggctggtctcaaactcctaacctcagatgatctgcctgcctcggctaacctcagatgatccgcctgcctcggcctcccaaagcgctgggattacaggcgtgagccaccgcacccggccgaggagaagtattttattaagcaccttctacgagtgggcactttaataggcacttgtatgagtattacatagcttaaatttacatttgaagcgcttatggttttagtgtgatctttgtttctgatatctgctctgactactttaaaaatacagtcatgtgttgcataatgacagggacaggttctgagaaatgtgttgttaagaggatttcatcgtatgataatagagtgcacttacacagccctagatggtacagcctactacatgcacatctaggcttcatggcatagcctgttgctcctaggctacaaacctgtacagcatgttactgtactgaatactataggcagttgtaacacaacaaaagcagttgactgaaatgttacgcagctcatgactgtatttgaaagagtgggtagttagaaatatttcctcacaggatcacagcttgtgaatctgcaagcttggtcattgctggatcttgattgctaggaatttcaaaatacccttttcctctttcccaaataatagttaaaacctcattaaaacctgaaattcttaattcagaataatctttccttcatccctttcagtcctgattttaagtggttgaggtttctttacatattaggcatgtattaacaattcattgaatgattgccttatcaaatgaatgtattgaaaaaaataggtgagtgtactaggcgtggtggctcacgcctgtaatcccagcactttgggaggctgaggtgggaggattgcttgagcccaggagtttgagaccagccctggcaacatagagagaccttgtctttaaccgcctcccaaaaaaagctttgtgtttttcagtgctgcatgtggaaacaaacaaaaagatgatttcctgaaattatagaggacatttgacattcct

SEQ ID NO: 9273 - DNA, 1057 bp, Homo sapiens
ctgaaagattttttatccagatgtattttacatttaagggtaagggaactttgagggatctagcctaaaggttataggaccagttactgaccaacacatcagagctcagatcttcagacttctagcccattgctcttctagtcaaggaaggggaaatctggaaacagtataggtagccaaaccttaagttacctggtattaatgagagattaagaaaccctctttctggcagtggaagactgcttgtttgaatggaggtttatctaagtttctcagcagagctcttgccagattcacaaggctggggacagaaattgaagtcaggacctgccacgttggaaggacccttattaacactccttggcatttggttgggactctgaaaggctgttccttgagaataaggggcgatccagaattaatctagctcccatagggacaagagtcctgatttaaatcattgcaatagcagttgaatgacagagatcggggattacgagtgtctggtctacttgcctgccagaagtaaaaataaatcctttctggaggattttctgggtgtgattatcattcatctttttttaaaaaaaattatttttctcgtttttttttttccttttttttaattatactttaagttttagggtacatgtgcacaacatgcaggtttgttacatatgtatacttgtgccatgttggtgtgctgcacccattaactcgtcatttaacattaggtatacctcctaatgctatccctccccactccccccacccaaaaacaagccccagtgtgtgatgttccccttcctgtgtccatgtgttgtcgttgttcaattcccaactatgagcaagaacatgcggtgtttggtttttttgtccttgcgatactttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaat

SEQ ID NO: 9274 - DNA, 1048 bp, Homo sapiens
ttcaggagcatattaatttccatgtgtttagtttccaaagtttctcttgtcattgatttctgaccttgtggtcagaaaagatacttttatgatttcaattattttgaatttttcgagacttgttttgtggcctaacatgtggtctatctgtgagaatgttccatttgctaaagagcagaatgttctgcagctattgcatgaaatgttctgtaaatgtctgttaggtatatttggcctacagtgtagcttgagcctgatatttctttattttttgtctagatgatctgctcaatactgaaagtcgggcgtgaagttcccgactattattatattgggctttatccctctttagctctaataatattttctttatatatctgagtgctccagcattgggtgcttatatatttacaattgttacaccctcttagtgaattgatcccgttatcattatataatgacttactttttatctttttacagtttctgtattgagatttattttatctgatacatgtatagctattcccgctcttttttggtttctgtttgcatggaatatatttttcagcccttcattttcagcctatatgtgtcttataggtgaagtgagtttctggtcagcagcgtttggttgggtcttggttttttatccagtgagccattctttctcttgattgaagaatttagttcatttacattcaatgtgattattgataggtaaggacttactactgcaattttgttatttgttttctggttgttttgttagtttctctttttttcctttttctctgtcttcctttgtgtataaatgatttttttggtagtatgttttaatttcttgctttttatttttatttattttttttaattttttaattttattattattatactttaagttttagggtacatgtgcacaacgtgcaggtttgttactaatgagcaaaataaccagctaacatcataatgacaggatcaaattcacacataacaatattaactttaaatgtaaatgggctaaatgctccaattaaaaattctc

SEQ ID NO: 9275 - DNA, 1050 bp, Homo sapiens
caagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacacaaaaggcatgaattcattttttacctgtgtatgtctttcttggatccagaacattattcatccagcacgcacttagttatttaacatctactcactcagtctctccagcagcaattttgcattgtctatctagcccccctgtgattgttcccaaagttttgtcttctcaacaccacaacactccaggggaagggaactaaaccagttgctctttacttcagttaaatttttaagatgtccaccaaggcttatctctttcaagccatcctacgtaacccagtcaccctagactaagtaataatgttatttaatcaaagattaaatatttatttttgcttagaacttattagatcatctcagaaaagtcagagataatatatgaactgaatcatcgtgacaacaggatcttgagagttagtgctttagtttatgttgtgatctcttcctagggagatgctttgtggcagaggttgctttctgt

SEQ ID NO: 9276 - DNA, 1097 bp, Homo sapiens
gtgtccccaagggttattctctccatgacagggcagctctctggatcagactgccttgttttcatgctattcaggtcaaagacggagctgtcatttctcccttggaaagagtcatggtggttttttggtgcttttcttagacacacagcaggaaaaatgccttttacagcagttgatgagcttgtcaagcagccattctttcgggagcacagatgagcacaggttcactcctggccggaatataagaagaagcagagcaaagttaaaagaaaattatttctctactcacaatacttctttttttttttttttttttttttttgtgacggtgtctcgctctgtcgcccagatgggagtgcaatggcatgatctcggcttactgcaacctctgtctcctgggttcaacctattctcctgcctcagcctcccaactagctgggattacaggtgcccgccaccatgcccagctaatttttggaaatttagtagagacagggttttgccatgttagccaggctggtctcgaactcctgacctctggtgatctgccctcttctgtcggcctcccaaagtgctaggattacaggcgtgagccactgtgcctggcctgtactcacaatacttctgacacccaatgtgtgggttttccacaccaagtaattcttaaatattttgcagccaccaaccagatgtcctagaatttaattaaattttaccactacccagagttagcacaggccctataggttaagagctcagtcctgcaagactatctaccacttcagatatcaacggcaagtggtgggtccacatattacccacacttatgtctaacttggctacaaatcagggcttcctacaaccttcttttggtttctataatttactttaatagcttagagaactcagggaagcactatgcttatgtttaccaggttattttaaaggatataaatgaacagctggatgaggagatgcaaaaggtgaagtctggaagggtccaaagcacaggagcttctgtccttttagagttggggtgcaccaccctcctggcacatggataggttcactaagtcagaaactctccatacctcctc

SEQ ID NO: 9277 - DNA, 1051 bp, Homo sapiens
gtctgaaatcctcagaaccatggaacatgatgatgtaactctcagcccaaggccaaaggcctgagaacctgggtaaccactggtgcgagtactggagttcaaaacccaaacaacctggagttctgatgtccaagggcagaagaagagcgtcccagctcttgaagagacagcaaggatttgcctttcctcagcccttttggttccatccaggcccccggccaattggatggtgcctatccacattgaaggcagatcttccccactcagtctacctactcaaatgccagcctcttctggaaacaccctcacagacacacccagaaataatgcattgtcatctctctaggtatccctgaattcagtcatgtcgacacctaaaactaaccatcacagggatggtagcagctcctcatagtgactagccccagggtgcttcatcatcatttgctgttttcctttaacccttttgtaaatagttgcttcattagactgtcttcagtcactccttttgcacataccatctatttcctgataggacgctgactgatacaatggggataataatagtactgaccgcagcccatggtggtgaggattaaatgcattatgtgagaaatgcctgattgtagtaaccaccattaaatgtctttctgtctgatacctccaagtatggtcaaagctttctgaaagatttggcatataagttaaataatactgtcacttatctcctcttccctatcctgtttcagaaggatgggttgagattcaagacttttgaacaaatctgttctaagacaaatgtaaagtttcctccctctcatttttatggggatgaaaaaggagacaggaaccaggctagattcacctactgtgtcaggcactttgtactttatacatataaccattgtactcagcttatggcttgggtcatgttacccacagtggtacccccaaatataacaatttccaagcatttgcctgcccatcttactaagaaatggagtctttttaaaggccaccctgcagttttatggtccaggaatccttaggt

SEQ ID NO: 9278 - DNA, 1056 bp, Homo sapiens
tgtgccaggaactgggctaggtgtgggatatatatcctttgctccccatggaattcatattctataaaaggaatgtaatgtattaagatgttagaaaacaaaagacaaatgaactgggttcgttctgctctaagaagagaagaaaggattcataactgtctttcaagtatttattttattttcactttgaaatgagcttaaatcacagatatcatgacttctacaagcttagaagagttctctcctggggagggtggataaatacagattaggaggatatggagggcaaagaggcaaccaaagaattaatagaagtgtgggggtatcttactagaaatctgcttaaattgagaaaatatgatgtaatgtcctgcctgatggtgggaagaggaccctaataggctaactgtggtgtgccctttggatatctttttttgatttcagtaattatctatggagcttaatggttaagactccagaactggaaacctgtattcacacccaaactgtgccactcactagctttataatcttggctaaattacttaacctctctgtcaagtagaatttcctcatgtgatatatagggatcttaattacacctacctcaaaaaattgttaggagaaatacatgctgggtataagagcaatatctgacacattggaagagttaagtgttagttatcatggttgttgcagttactattgcaacattttattatgcttatagattctatgggtctggacttcaggcaaggcactgtaggatgccctgtctctgctccatcattcctgggacttctggggcaagaagactgagagcgcatgagtggtttgtgactggattcacatgtctggcacctgggctgggatgacttgaaggctaggtctgcagaccagagtgtcaacaagttgcctttccacatggcttggcttccttataggatcgggctagttagaatcttatatggtggcttagggttccaggtgtgagtattcccagaaattggatggaaactgcattgccttttatgatttaattttggaagtcacgta

SEQ ID NO: 9279 - DNA, 1190 bp, Homo sapiens
ttttttatggtgaccagcaccccgggatgctccacgagatggtcaagccctaccctgctcctcagcctgtgagaacagatgtggccgtcctgcggtaccagccaccccctgagtatggggtaacgaggtgattatcaactgcagacgtttcgtgcggcttttcaaaattcaatagtcatgttattagcatttattattttcagagcagattaggtttttgtcatcaggcttttttccttatgcatgatatttaataaaccactttgtggccagaatatatagggtgaaatagagtagagggcaactgagggattttctccaaacatagcagcaggcagttggggatttatgagtttaggggagggacctcacttgttagctgtccttgggagctctgcctagtggcctggcaaagtagcaattttccaatggctttgtggagaccgtccaaactcctggaacatattattaccagagggttttatagtcttttttcattgtagattttaaaggaaaatgtagtctgaatgctagaatggaggagttaaagggactgtagaaatcacatagtcccatccctcactcaacagatgagaaactaaagcctggagagattaatgaatttcatagacacaactctgaggcagctgggggctacactcaagtatcctgactgccaaaatctattcactcccttgccctaattcttcctacagccttcacttgtattcttccagttgattgatggattcagcagcacctactgagtgtatgctgtactctgaagccctgttcctggttcagagatggggtccctgcccttcaggaccctatagcattgtcttggaggaaaccagcatctgaacagatcattgccattcaatgtgctgttctaggagagaaatgggccgaggatgctagggtaacaggtaggatagtataactcacaactggaggggctggagagagcttcccagaggaggtgacatttgagttggaacttgaaggataaatcagagttgtagggtagagatgaagtagcagtatgtgctgtgtgagggagtgccgtgtcttcagacaaagaggtcatgaggatttttgtctggaatgagtggcaataatgcagagcactggtgggcaagggtgtggtaagaagtgacaggagatatgtttggacagggaagttggga

SEQ ID NO: 9280 - DNA, 1022 bp, Homo sapiens
aaagcgtaggagtgtaaaccccatctgactacaagaatgttgtcactttggctctatgtgacaattaatgctccggctggccgatttagtgttagtgttcatgagttagtggtgatttcacaggtcaagctggtcattttgctggccaagggttttagagtagtaggctctacttgcttcctgagggttgtcagggagcagtggatttgatggtgcatgtgtttacagacaatttgtcccagcacgtttgtgcagagcttccactgaaaaggtctggagctccctggagtcaagaccagacttggctgagggagctctggctgcctttattggaggggaaaaatgagagccagaaacagacaggggccgcctaaagattgtggcctcactcccaccccctcttgcacccttagaagttgggaaataggcatgttgtctcacagccctcagcctataagatgctgcacaggcccaagcttgcctctgtcatttttgggcagcttcttttaggtatggtctgaaaattgggaagtgcagactcagcacttcttgggaaacaaggacctctttcttctctcctaatgaagcttcaaggcagacatgtccagaagctatacagacccacttgaaggcagagtttggtgctggggtttttcccatggctgtttctgaagagttacacaaatggtgcagaaattggaggccttgttatttttcattgcctttttattaacatgtactttttttttttttttaagatggagtctcactccattgccaggttggagtgcagtggcgcgatctcggctcactgcaatctccgcttcccaggttcaagcgattctcctgcctcagcctcctgagtagctgagactacagttgcgcaccaccacacctggctaatttttttttttgtattttagtagagacggggtttcaccatgttggccaggatggttttgatctcctgacctcgtgatccgcccacctcggcctcccaaagtgctaggattaaacatgta

SEQ ID NO: 9281 - DNA, 1050 bp, Homo sapiens
tagatctttagagtcctacgaagatagaagggtttcgacgcaccgtgaagagagcttagtcactatgaagaggtccagtaggaaaaatgagacagacacacatcagccactggacctagagtgcaaggcagaatgtggcaaggacctgttagagaaccacactcaaaagaacccccacctcaaaaaaaaagtgggttgggggagaagcctatagcctttagggtgggccttgaaaagtcattaacagtttagaagaattttgctgcacagcactgtgtcaacagggacattcctattcttttacatttaggcaacagagtttgaataaatgcattgcactttaggctttacctcattttcccatattatccatctctccagaagatttcttccccacattttaacagcagccatttccacaaatcttggtctctttggtaatgactaaactagtagctttcaaactcagaactcttgttcagatagtgtggaagcataatatgtaaaatgaaggacagctgaagaaatttctggctgagatgggttcatcttcagaactcctctccttcccacttggccccaatgtcccttctctcccttccctcccttccctgtccctctcccagggttctgcagaacagtttggtttgaattccccttcttaattttccttattacataactcatttaaaaacactccactctctctgccatttaaaaccagccctcgctggagtgttcctgtttgtgaatagacccaccttaaccacccacttgcagcctatgtatccagctgcctggcagaaccctggtaatctgcaccagagctcagggacagcagaaagctgaagaccctttccccaaataacaagcctccttacccaagaaaccatcagcaaattttaaaaagacaacaaaaaatcaaaccagcatcttctaaggtcagcgttgtatcatattgcttttctgtttgtgaattaatgtgtggctttaaaaagtagatcgtgtttcatgttgttttgcatcaaataagcctcatgtgaatagatc

SEQ ID NO: 9282 - DNA, 1034 bp, Homo sapiens
aagctttggttgtggcttctattcttgagctcagactatcattttattacttctggtcaacattagtgtatacttggtggccctcaacaaagagaagaacttttatgcttaggttgataaccaggcagaagctctgagatcctgtggttcatctccaggatgcctgcttagtaatacctgagtgccctccagagcttggagaaggccagcagccactatgcccattgagatgttgtccaaacctagggttaggtggtcaaatatcagtgactttgcacagaaagagtgaggtgctttgatcccttcagggctgtggatggggacgggcagcgctagtgggctgctactgaccccttagtttaggtctctcacatgcctgttgttgctgaggtctcacatgcccgtggattgggaaggaagtttcagaggcaccatttcaaatgctgcagaaaggaagaaggggcagtgcagtgggtcactgcagtggggcataaagagcccagaagtagtgctgtgctctgagtcaggatcttggtggcctcatcttgttttcagggatgccattgtttctaggaagcacagccaccacttagctttacaagtcagctccttcagtctatcgattcagaagctgttccattgccctctgatcccatcgacataattcgacaatgcaagggttgtgcagtcaagaaggaaggacattgtactgggacatcaggaagaccagattctggccctgtctctgtccccactggctgggagaccctggacaagtgcctttgttcctcagggctttcctcttctcagcaatgaagcaaaagagggagaactggatgttgatgtttcctgtgatcctttctggctctaaagttgtgagtttatctgatatttgcagccttacagtgtcattttaatttccatgccctgtatttaaaaccacatttttctgccctgttagtgtgctgcattctttctattacttcagaacacatagtgctggtcctaaataattattcgttaaattaacgaat

SEQ ID NO: 9283 - DNA, 1035 bp, Homo sapiens
atagcaggattatttatcataggcaaatgtgagaacaacccaaatgtctctcaacagacgataaacaaaatgtggtatattcatgcagtggaatacgattcagcagctaaaatgaatgaagtagtgacacacggattgatgaaccttgaaaacagtcttctaagtgaaagaaactggtcataaagtgctgcatattatatgatttaacttatataaaatgtctaggataggcaaatctacaaggagagaaaataaagtagtggttgcctgaggctgagggaagtgaggtgttactgctagtgactacagggtttctttggggagtgacagaaatgctctaaaattaaattctagtgagttttgcacaactctgtgaatatactaaaaacttgatgccttctctgatgaattctacccaacatttaaaaaagagttaataccaatccttcacaaactcttccaaaaaatgaataaggtgggaacatttcccaactcatcccatgaggctagtattaccctgatgccaaaaccagaccaagacatcacaagaaaaaaaaaaaacggcagaacaatatcgctttggaatatggaggcaaaaatcctcaacaaaatactaggaaactaaattcagcaacctttaagaaggattatataccatgactaactgaggtttattctaggaatgcgaggttgttcaaaattcaaaagcaatcaatgtaataaaccatatcagtagaacaaaagacaaaaacagcatgatcatctaaatacatgtagaaaaagcatttgacaaaatctagcaccctttcatgaaaaatacactaaacaaaatcagaatagaagggaaacttcctcaacctgtaagaactacgaaaaaaaaaaaagtccacagctaacattgtacttatgatgaaagaataaatgctttttccctaagattatggacaagacaagaatgatagatcttgccacatctcttcaatattgtattctagccagggcaatcaggcaagaatgagaaataaaagacatcca

SEQ ID NO: 9284 - DNA, 1023 bp, Homo sapiens
gatagtaaaatccatggatgctcaagtctcctataaaatggtgtggtatttgcgtataacctacacccaatctcatatactataaattatctctagattacttataacacctaatgcaatgtaaatgttatgtaaatagttgctgtactatattgtttggagaataatgtcaagagtaagaatctgtgtatgtttagtacagattcaaccatccttttttgttttttctcgtatattttcaatccacagttgatcaaatccatggatgcaaaacacacagatacagagggcttaccgtgtatgctttctaccctcagtcagctttcagttctcattggagagaattagacttaaatatttgagcaatcatacaacagtatttgagaagatgtctcagtaattaattcttgtgtgtgataggtctcttatttcagtggttataatttttcattttcatttgggtctttttccatccacttagttttgttctttgaatgtactgttactctgtggtttttataccttccttctatctctttgaacgctataaacaattctcaattttttttaattatttgatgttttcaaagtgttaatcctcgtttgtttggctttatttattgattctcccttatggtatctttttttttatgggaacttaataaagaaaagttatatggtggtctcattttttcatttattgtgttaattccacaataaattcctcagttgtgtgggcagccttgtgagccagttgtgaatttgcctttggttaggcttgatggttttcactggttctggctgggcagggtggcttacacctgtaatgccagcacttaggaggccaagccagacagatcacttgagtgcaggagttcgagaccagccggggcaatagagcgagacccagtttctacaaacaataaataaataaaatcactggttctgttccagatttatgttactatattggcttgatattgttgatcattgtggattatacattgcctaaagttttatatt

SEQ ID NO: 9285 - DNA, 1055 bp, Homo sapiens
gggggacttctggaaacttaacacttatggtggaaggggaagcatacatattcttcttcacatggtggcaagagagggaagtgcagagcaaggtggggaaaagcccctattaaaaccatcagatctcatgagaattcactatgatgagaacagcatggggaaccaccacgatgatctaatcaccttccatgagatccctcccccaaaatgtggggattacaatttggattacaattcaagatgagatttggttggagacacagaggtagaccacatcaataatcatatattattattatgtctgctgtgtttatctaacatttctgtgatttttgggctggagaaaggggtcagtttaataagacaactttaagatgttttgactaatatatgtcttggagacaactattaggcatatgtaatagatgtcaagagctgttaatatccactaggatgtggctagaagggaattagttcacacaaattcctaaattattgctttatattaatttgtcatattcaaatttctattaatatggtacctattgctgtagccttattttgaagacacagtttacaagttcaggcactttttaccaataatagtccttgagttagtatatttgaaattatcctagtataatggtttacgggtggattacttgaggtcgggtttgagagcagcctggccaacatggtgaaaccccatctctactaaaaatacaaaaattagctgggcgtggtggcaggcgcctataatcccagctactcaggaggctcaggcaggagaattacttgaacccaggaggcagaggttgcagtgagctgagatgatgccaccgcactccagcctgggtgacagagcaagaccccatctcaaaaaaaaaacaaagtctatataggaggcaatctttataaatctttgactctaaacttcaaaaaaaaaagtttagggccaggtacggtggctcacgcctgtaatctcagcactttgggaggctgaggcgggtggcttacggggtcaggagagcgagaccatcctggctaacacgatg

SEQ ID NO: 9286 - DNA, 1050 bp, Homo sapiens
acactttaattcaaatattaaatgatgacactaagtgtatcatagataaatatctacaggagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaattggagtttatccaagtaagtttttttaaaagcacctgcgaaattctgtttccaaaggaataagtcatacattaaatatgtgaaatatatttatgttgctaatcattttatatcagccaacaatgtagtactaccagatgcagtggtgacatcacactcaagggttttcaaccagagagaaacatgattcatatatttaagagattactgtagtgactaggggtagggtaatgggatcaaggcagagaggctgagagatcagctatagatgtatcagaggtggtcagcaagacagtagttgggtttgggcagaggtaaacagatttgaggtatgttttggaagtaaaaaaaatattggggttacttgctgctgggtatcatgtagaaggagagggagttaggatggtgattccactgactaaaatggagaaagctgagaagttcagagagcagaacagttttgttgactgttgattggtagccatatgatagacacacagtgccaagtgctctgagtatatcttctcatttaattttcacaaaaggcttctgaggtgggtatattctcatattatagatgaggtagatgctaagccacattttctgggaagtatgcatatatcctcagtgaaattaaataacttgcccaagtaccagcttactgggaaatggcagagctgggatgaaactagccttttcaactctaaaactttggctgttttttcaaagttcatgtatgaaaaagaaatacaagcaaattattcctgtaggagtaaggagtaatggtctaatttgttgcttatactaattagacttattctattg

SEQ ID NO: 9287 - DNA, 1054 bp, Homo sapiens
tattttttgtagagtcgaggttttcaccttgaggttgtccaggctggtctcatcaaacccctgggttcaagcgatctgcctgcctccacctcccaaagtgctgagattacaggtgtgagccaccatatccagtgccacaagattttaagtgttctaaccacacacacaaaagtgataagtttatggggtaatgatcatattagcatgatttagccattccacaatgtatcaaatatatataacatcatgttatgtctatcaaaacattatattatacaccataaatacatacaacttttatttgtcaataaaaaataaaaaaagaaataaatagcaagagttatactcactgaattgaattgtttgggtggggacagcattatcagcattccttctccaccctagcctgcagcatcttggctatcctttcttccttatttcagtcttctagttcccttaagctgcaaatggactgctgtttggtttgctttttggaaaatgtttctaaacttgtatgtttagtattgatcaaaggaaaaaaaagataatggactcttgtatacatttaattatttattgtgataattaaatatacacaagcatggaactataattctatgcttataacattcatgcaatcttaaaagcaaatcagtttacaaagtaaataaaaacaatattgtgaaaccagtacaaaacttgtcagcaacatttagttaatctaatggatgatgttattgtgctgaagctcattttcttctcagagattgctgataatatctagtgtgttgttgatgattcattttctcacacttttcccagttgcaacctgcagttcttgagaatcttcttgccctgatgaaggccttccttccatcagaagctttatttgtttattactcggtcatgttgcctttgttctggtagcagttgttcctggcactagtgatccatgacccaaatgaagatggcaccgattatgttgatgatgtggacaatgcagtcagttaaggcattagccagaggagagcacagtttcttaaaggtgtctacc

SEQ ID NO: 9288 - DNA, 1032 bp, Homo sapiens
ttctgtggaatagttaagtaactttttttttttttttttttttgagatggagtcttgctctgtcaccatgctggagtgtagtggtgcgatctcggctcactgcaacctctgcatcccgggttcaggcaattctcctgcctcagcctcccacgtagctgggactacaggcgcgtgccaccacgcccagagttagctgactttttaaggacctttccttatctgagattttgtgattttgtaaataaaatggttttcattgtatcttgtctggatgatttgattacttccctgtttctctccctagcaagttagctccataagagtaggcaccaaatctttgggactcaggagatggacacatgatatatttttagtaagtgctcattacatgactgagcttacaggaagttgtgtcagactagtgtttggagaggctgaagtctacaggtggtcattaaccacttcatattggaaccacttctgaaactttgtatgtgaagacaaatatcattgtgacaactcttttagaatgttatgtagacttaccagaaagaggttgattagagtaggcttattcagggaattgatatttgtattaaataattaattttctcttcagcaatgacaattatatatagtaactcagattcaagggatattgctaaaatgtacaaatgatttatatttcctgtttgtaacaaagctttgcattttcaagatgtcatttcaaagggttgattttaattttatgggaatgccttctttaaagatgccatttatattttttaacagctttcttaagatataattcactgccataaaatttacccttttaagaatccactggtttttaatatattcagagttgtacaaccattactgctatctaatcttagaatatttctatcacccccaaagaaactctatccccattagctgtcactcctcattccccatcttccctagcccctggaaactgttaccaatatactttctgtttctacataattgcctgttctggatttttcatat

SEQ ID NO: 9289 - DNA, 1127 bp, Homo sapiens
tgatatgtaggtttagtaactgagagcaaataagtaacatgtctttccagtcattgtttacctctttaaaaattaatagtaattataattatgatagtttatcaagctcttactatgtgctgtgatgaactctacatgcatgatttcatttgctcagcacaatgatcttatgaaataagtatattaatattattcccattttatagataggtaaattgaaacttgcagagcttaagtaacctaacttggccacctagcaaaacagaatttaactagtagtgagtctgacaccaatatcctcactcttaatatttttttaattagatctatttgtgttagaaggttatgcaaagaaatagaagcccatgacagccttttctttaatgatttatatttgtgaaaaattttagtgtttttttgtttgtttgtttgttttttaactgaatgctcactccatcaagcttgaatagaccaccaggatcatttttatagtggatgttttataaggcaatgttgagattgtaggttagcaggtaaaaatgtccggactgcttttgtcagcagccaggtgtcccccactcacccccatcaccctgcagcttgctaacagatcttaaatgaaagaaccttctggccattctctctggctcctcacatctcatcggcttgatttgatgtccatatcttaagtctgtgtgtttgctggggctctggttttcctctcttcctcatagcaccttttatagctaggggcaagcctgtgtctaggcacctggcttcttatctctaattgctctctgccaatcttaaaaaggccttaatttacctctcctaaatactctgaattcccacattcagttctgtttattgacagcttcctattttcaaggtcctgtgttgggtgcagtaaaggctggaggggttctctgccctccacaccttgctgttcagggagagttataagatttagacacaaagaagtataataataaaagggatcattgtctagggtatttcagtagacatacaaaaaaggaggtagagtacaataatgcaatatttctcaaagatttctcctgaagtacatctaatacgagaggaggggaaaagtaccctctcggtagtct

SEQ ID NO: 9290 - DNA, 1081 bp, Homo sapiens
ggtgaggataagagaaatgagagtattcagtgagaccagaagagagcgaaagattaaagacttggtcacaagttctgaatctcagcccaaatgtggtttggcaggcaatgttgggatccacattgatagacaagattaaagtatagcacagattggtgcctgggtacctgtgcaatatcaagaacccaggcgtggagggaggcactgggaacaggggctgagtgagaatttaaaaggaggctagactatgggtcataacccctgccaagagtctgggtagtatggttaaaggataaacaggaacaagggaaagcataaagaaatccctcaatggtaagccaatggattccaaagtaggaattctttacatgtgccttgtgaagagtctggattggtgtttgattgctggaaggaccaaattcatcataggtgcttgtaatatagacaagatagataagtgctgaggcagagatgcccctaaccctatgcagagtatcttctcaacttgataaaagtctagttttattatcattttcttttgtggactgtgcatttcttatttcctaatacttaattaggaactatgctatgatattaaacaactttgtaattactcaaataatgtctagtaagctcctccaacttggtatgtctcatatttgcctaaacttaactcatctgattgcatggcttcattgggattccttggcgataggatataattaaataatttaaatgcaagatttcagagcgtgttctcaagatgactctgtttttgatttgtgtttggcaattaaaaagcaaaatctgaccacaaggaggacattgtggagaaccagacttagatacctcaatgataactaaatttccatgtgtttttcatgtgagcctttagattacaaggggctgtgaagtatcagaaggatgtatgcctccaagtactaggtcgtatttacagtgacatgccagtattcgtcagtagggctgtgacttttttttctgttgatttatttaataggaagcaatttattgactttgcaagtgagcatccgtggagcttgaagccagaaatggagtggaa

SEQ ID NO: 9291 - DNA, 1031 bp, Homo sapiens
tctacttgtacatatccatcagggtgatcaggtaaattggcaatgagtagtactatattttaaggaaccttttttccttagcaaaagatctcaagagggcacttaaaatattcagtaaactacaatgtaaaaagatgtgctatcattcaggctttgttgtaacctttctagagcacaggcagagtagattccacatacatcttaaggggtctaagatttctggaatggtaaattagcattggcttcaacttaaagtcaccagctgcattagcccctaacaagagactcaacctgtcctttgacgctttgaagccaaacattgacttctcttctctagctatgaaagtcctggatggcatcttcttctaagagaaggctgttttgtctacattgacaatctgttgtttggtgtagccaccttcatctatgattttagctatatcttctggataacttgcagcagcctctacatcagcatttgctgcttcacctgagacgtatatgttaggatgtggctacttttcttccccatgaaccaacctctgctagcttcaaacatttcttctgcaatttccttatttctctcagccttcatggaattgaagcgagttaggaccgtgctctggataaggctttggcttaagggaatattgtggttgatcttctatctagacccctaaaactttcttcatatttgcaataaagtctgttttgatttcttaccatttgtgtgttcactggagtagcacttttgatttccctcaagaacttttgtattcacagcttggttgactggcacaagaggattagctcttagcctctgtcagctttcaacataccttcctcactaagcttaatgatttctagcttttgatttgaaatggtagacatatgacttttcctttcagttgaatacttggaagccattgtacggttactaattggcctaattgtgtgtcggggaagagggaagctggaagagagagagagagaaagacagagaatggccagttagcaaagcaggcagaaca

SEQ ID NO: 9292 - DNA, 1030 bp, Homo sapiens
ccataattcaggcagcccaaatctagtggttgataggggcaggagcagaaaggcccagccatttaagctcactaggaggcaattctcacaggcagtgctagctccagagatccccactgagtgagcctgggcttttcctccctgcatcacagtcccatctctacctctatccaatcccgcttctggagaacccatctggcagcaaggaggtttctaagaatgctctttgttacctgctcaagccctgtactttatttaaaaattgtttcattatttaaaaggctgttttcagagtagcagaaacttcttcatggtggaaggctacatacaggcagatatgtaagtatttcacataagaaggtacagttgattgtggagcagaacgccccaaacatcaatgacagcttaatgtctttgactattatgaaaaacagcctttccttttaaaaaaaaaaagcttttccataatttagcttgacgtgtatccccaggccctgtaaaaacttccactacttgtcaatgagtgatagtttcatttcttgtaaagtgccaaaatgagaattcagagtttcattttggagaaaaatgggatttgtaaagtgttgcatggggaagaatggattagttgacctaaaacaaagtgggggatatggggatgtgtatgtgggctgggggttatatatgtttatgtgtatattcctaatattctttggccagttaactaaaattttctaagtacatatggaaaaaagtaaattgccattcattttatgacgtgtcaaacgatgttgttattcaaaggaaaccaatttcccatttttattattaaaaaaggcttaaaataataacttgttccagataatttaccttttaagataataaaataattgattctaatactctttttagaggaagagggatttaatatggttcttgaagaacatgtaatgctgtagaaggaacaagagcaacttctccaggacaggtggaagggccctggtaaagtaatggtggtgatgggcacagtggc

SEQ ID NO: 9293 - DNA, 1061 bp, Homo sapiens
ctctgatgattagtgatgttgagcatctttttatatacttgtttgccatttgtatgtcttcttttgggaaatgtctattcatatcttttgcccgttttaaaatcactttattagatttttttcctattgagttgtttgagctccttacataatctgattgttaatcctttgttggatagatagtctgcaaatattttctcccattctgtgggttgtctcttcacttgttgattgtttcctttgctgtgcaggagtttttggcttgatgtaatcttatttgtctattcttactttggttatctgtgcttttgaggtcttacaaaatctttgcctagaccaatgtcctggagtatttttccaatgttttcttctaatagtttcatagtctgaggttttagatttaaatctttaatccattttgatcagatttttgtatatggtgagaggtaggggtctagctttcttcttcttcatatagctatccagtttttctagtatcatttatgttagagactgtcctttccccattgtatgttcttggtagctttgtccaagatgaattgactgtaagtgcatagatttatatctgggttgtctattctgttccatttgtctatgtgtctgtttttatgccagtaccatgctgatttggttactacagctttgcaataaattttgaagtcaggtaatgtggtgcatccagctttgttcttttttgggattgcttcaagtattctgggccttttgtggttccatataaattttaggattattttttccatttctgtgaataatgtcattggtgttttgataggggttgcattgaatctgtaaattgccttgggtagtagtgacattttaaccatattaattattttaatccatgagcatggaatatttttccatgttttcatgtgtttacaatttattccatgaatgttttatagcttttcttgtatttatcgttcacttttttggttaaattgataccaaggtattttaattatttgtagctattgtaaataagattgcttactttattgtttttcagattgtttgct

SEQ ID NO: 9294 - DNA, 1055 bp, Homo sapiens
tgaggacttccgacttaaggtgtaaaactttgagtaggtaatgtcaatttctataacttagaacagcgatttttaaactttgagaaataaaaccccctttttgcccacagataaatgctaaatataattatatttttctaaggtcaaatttgttaatataattcaaaatcgtatttagtttactatagagcaagtcaatacaagtaagaatttctataatgaatacaaatatttggagttgggaattataatactagttttacaattttacatcagtctcagcaacctgtttatttctgtatttcatggggcttaaagctgggaaagattctgatccttacagataagtaatttcaagtggtactggttatgcaatctgtgattgcataaccttgtatgccttttgcaatcatagatactctgcaaatagttaaaaagctggagaagcaagtctaagatctgcgtaagaaccaattaatctggtctcataaactaacatattggtggcattgtataactttcgaggaaatgtttactgtagtttcataatatagtttcataaacgtaatttagtttagaattgatatcaaatattgaaaataattttcctgcaacatctttggagtcaagttatacctagagtcacttcaaaaccaattgcataaaatattcaatgttacttgtttcatgttattaaattaaaaacagtcttttgtaaaaaaggcagttccaattgtctttggtaggtctatgttatgaccataaagataccatgctgttgtcatgataaataataactacctctgtcataactcttttatatttatattctcaattgaccctcataaaaacacagcaagatagttgtagttattattcccaatctacataggaagagaagattatataaattgcttcaaattaaactcctaacttcaagctagagattcaaacatgggtctctgtgtccctgaaactcacagtcatgcagagccctgggactgctgtgttggtacagcacatgccctggcagaatgggagcctgtgttcactgg

SEQ ID NO: 9295 - DNA, 1025 bp, Homo sapiens
gaacagaactgtctcctccttgcttctcacttaagccaaagcatcttcctcccctcaacctcatgttggccctgtgcaccctgaaaggaagttgcacttttctttactgccgagttgtcacttttaatacctagacatcttgttgaagtctggctcttgttaaaatattctatcagagaaaaacagtttttctgtgctagcaaagaaccaaattttcttcccttttggtttgatttttataaatcctttaaaagaaatctttaagtaaaaatatgtttgtgagtgtgtttgggtctttgtcttgaagtagtgtaaaattttatttaaaatgaaggtaaaatgaattatggcctatggtataaagatggttaaatagcaacacaaaagaaaacaaataagcccccatcagcaaaggtctaaacaacaaaatgttcaaataaacctgttattctgaaatatgtaataatagagtttctttataatattgatgctgaagcactataggatcctgaaattaacatgttgaattaacaaattatgtaccgcatagtttattattgagtgtatttctagtattctgttttaccattaataatcaatttatgagatttttacaatcttgattaaatgcagcctttaaagagaattttggacctccatcttagcgtaaaaagtttttaaacaagctgtttgttctaaaaaagacaaatagatatgccctacaatctataacttcagtataatctcatatatttctacatctaatgatgaggtactaaatgtgattacacggtaattcaatgaacttttttttttttttttgagacagagtctcgctgtgttgcccaggctggagtatagtggcgtgttcttagctcactgcagactcaaccccctccaagctcaagcgatcttcccacatcagcctcccaagtagctggggctgcaggcatacaccaccacacctggctgatttttgcattttttgtagagccggggtttcaccatattgcccaggctcatct

SEQ ID NO: 9296 - DNA, 1031 bp, Homo sapiens
gataactgtacctggttatgtaggatgttaacattagaaaaagctgggtaataggtacacagaaaccctttgtgtcattatggcaactcttctgtaaatctaaagttatttcaaaataacaagttaaaatgttttaaattctcaaaatgtttaaaatcttttgttatactaaatgtcccaatttggagtttggaacaattatcactgtaattatagaaaacattaaaacatacattgaatagtttttaatgtattaagcacttacatatatatatatatatatatatatatatatatatatatatatatatgtcacttgatatggatcatacagagcaatgttcttgcccacagaagttaataatttagacagtctgtttcaaagccacattccaagcccaatatcaatgatactgaagaagagaaatttccatctcatcaaagtagtaaaagatcctcaaggtgcttgatactgcagcaatatttcctattgcctctgcagtggctgtaaagattacgaactctgtggctagatgggtggattcgtttgttcttgcactgctataaggaaatacctgaaactgggtaatttataaagaaaaaaggtttaactggctcgtgtttccacaggctgcacaggaagcatgatgctcccatctgctcagcttctggggaggcctcagggaactttcaatcatggcagaaggcaaaggggaagcaggcacatctttcgtggtaggagcaggagcaggagagagaggacaaaggtgccacacacttttaaacaaccagatgtcatgacaactcactatcgtgaagacagcgccaatggagggtggtgttaaaccatgagaaactgcctccgtgatccaatcacctccccctaggccccacctccagcactggggattacaattcaacatgagatgtgggtggggacacagagccaaaccctatcaatggggaaacagtgtgggagactttttgaggtccatacagttgtccctgggctgcagcatcccacaggggag

SEQ ID NO: 9297 - DNA, 1077 bp, Homo sapiens
tggtggcgtgtacctgtagtctcagctacttggaaggcggaggtgggaggattgcctgaactcaggaagttgaagctgcagtgagccaagatggcaccatcgcactccagcctgagtaacagagtgggaccctgtctcctccaccccccaaaaattgcacagcctaatcagttcaatatatgagagtattcatgtaagaaatgtgttaactattcattcctaagtactttattcacctttctcttaagccagatcttcagatagttgcaaacatgggcctcaataacacatcatcattttcttacagagggagggaaagagggaggaaggaaggaagtggagatatgcaagtgttacatgtggcacacccagagagcaattaagtatggactgctttcccttacctatattttcctagacatacctaaccttggttttcatcaaggcattataaataaactgtgtatggacaacaccatagagttgagttttttaaatacttcttatatgcaaagacctgttggtaagttttctgtagagactgtgaatgagcttaatcaattttcataattaagtgcacttgctactagacagtgattgttgtataattcattgtattttccttttacccttgtatggtagtgttaagtgtaatgtacaattttgatagcctttctccatctggagttcctgtttgtttgtttatttatttatttttgtctctattttgtttatttgtgctctggtatttatttccttatactaacttaggtttgttcttgcttttttagtttcttgaggtgcatcattagattatttgaagtcttagtacttttttgatgtaggcattttttgctgtaaacttctcttttagcactaattttgctatattccataggcatgggtatattatatttccatttttatttgttcaagaaagtttaaattgttcttctgaatttgttcatttactcactggtcattcaggaatacgtgttgttggttctcatgtatttgtatagtttccaaaatttcttttgttattgatttctagttttattccattgcagtatgaga

SEQ ID NO: 9298 - DNA, 1030 bp, Homo sapiens
aactgaaccaaacccttccttttcctaagaatagaagtgctctgcctaatgattggagttcagctcagtgtttttggtgttctccagtaattggttagaatctcaccaattgtgttttgagtggccaagcaagtatttctttgtagggataaagagaggtacaatgtgaataatttctttaaagagttcatgaaggaattctggtatatcagaaataccactgatatgtatgacctgcctctgctcctgccccatagaagttgctatcaaatgtggaaagacactgtggaaagaagtgtccatttttaatgttaaatgtaaccaatttgataagaaacctataataattgtatcatctaggtctctaatacttgaaaacttaagttctataaattataaatattgaactgagaaaaaaattgaaggtaaaagacgttattaggacaaagaattaggttatttgtgaggcagtaaatgtaaaatgttgactgtattttataacctattagtttgaactgttcaaaatcagaacatagtgagcttcacaagttttcatcttatggacaggattaataatacttcataaattcactattcccattctcagatccaagatgccttatatatatttctactttccttactcctttgctcactcattttgctcattggactttccagtatttgcagtgttttgattcctgactgtcttgaagtctttcaggacaaaagtggctatgaagctgctgtctgccagagagactaaaagagaagccctcttctttgacccagatagtaaagatagatcatttgatcaaaattcagttaggtcaagttagttaagtcagaatgtcaaggaatcagtttagttagttaagttagttaaattacatataagtaatgtacttggacaagtcatagaacgatgacctacagattaaggtccatagcctggccccatatcacctttctagcctcatctctccctccctcttttttaattaataaaagacaaatagagacagggtct

SEQ ID NO: 9299 - DNA, 1051 bp, Homo sapiens
aatgtctgttgcagagggaggctggtgggagcagtgagatgctgtgacttaatgcttttacagagctcgcttggcaccctttgattatgagcccacaagataagaattgtttttggaacctggtatttgtttcctaatgcagtggtttgttttgtcttagtcacatcgatcagacaacaacatggcaggaccccaggaaggccatgctgtcccagatgaacgtcacagcccccaccagtccaccagtgcagcagaatatgatgaactcggcttcaggtgagtgagacactgtaattacagcacatggagtaatgcttacgcattggtaaaagttgatgtggaaaatagtcattactcgtttacagaaactgggacatggtgatgtttattgtctctccagtttcatacagaagacatagtctattttaaaataacgtaagctatattattgccttgtatagttgttaacgcataagggggccgataactgaaagccagtggttctttaagatttggttctgaagcgggtatctcaaatttgtagttctgttaattttgacgtatttggttttattctgctgctttcttgtgtctcaggtatttgagttgaatttaccctcttccctttgtggtttggatggaaagccaagctatagtgttcttattttttattattattattttttttttcattttttttttttgctatggtgttcttaacccaacttttaatgtggtgttattcattctactctgaaaatatctggaaggcagtaacttttgtaaacccaaaagaatatttcttattcccagggcaagcatggattattaaacgcatcttcaccttttttactagaagataaacctgagtataaatctttttctacctcttatttggcaatttacttgaatatgcagtttttctcatctacataatggggagtaacagtgccccttatgatagaagggaagatatgaaaggaaataatacaatttatatgaagcctctagtaattacagagtaggtactaagtgaaagtttagccccttc

SEQ ID NO: 9300 - DNA, 1074 bp, Homo sapiens
atcccagctactcaggaggctgaggcaggagaatcgcttgaacccagcaggtggaggttgcagtgaaccaagattgcgccatggcactctagcctggcgacagagtgagactcggtctcaaaaaaaaaaaaaaaaaaaagtttatgtgaaagttttgagggacaaatggaaatggcattttgaagaaaccccactcaaaatatgggaacatatcttgtgaagtgtcaaatgtccagttggaggagaaagactagtattgaccctgtgagaggcattaaagatatgggagtcatttatgtgaatatggcaagccatgggatttcatgaaagttccaagaaaagaggattaaaaaaatatgattactgtttgtcataattgtggtgtagtattcaagagcatgatttctggagagctcaactgtcaaggtttgaatctcactctgccacttactaggttgggctgaatgatcctggacaagctaacttttctttgccttagattcctcatctgtaaagtgggtataataatagtacctccatcgtagggttgttaagtgacttaacatttgcttgcaaagaacttaggaaaagtgccgtgtacatagtaagaacagtttgtgaatcatcataaatacacgagaccagaatttcaaaacaagcagcaggcagaatgttcctttaaaaggtcattgaatgtacttttccagctactcttgttactttctaaggaaactacttgataatcctgtactttgtaggactcatcagggtgtgtttagtaaacttcagtgtcctaggtgacttctttattcccaaattgtggggcaggtgacaaggggaggttggtcctctaactcgtggtgtagttaatcaggattttcctgtttgaatagacatggcaaatggttttagttagtcattactaatgcaagagggtccttaggcaagagcaggaagttaatggtgagtcaccttcagtgttatgacatggagtatttctttttaaaatatcacagggagttggtttttgctatagtagctaagttgtcaatcaagtaatactagtagtaaatc

SEQ ID NO: 9301 - DNA, 1974 bp, Homo sapiens
ccttgtgtcctgccctaaactgcttgatgaggtgatgaggagaaaatgttctgctggatttctttttgttttcttttagctccattcatgattgtattgtttgaaaaataacattataatgaatttttatggttggaggagggggaagttgaattgactaaagtattgatatttgttaccagtatttttgaacagctaaagatgtgaaaactttaatccagtttggggaggctgggagttggtgctggggaaaaggtttggctgtgtccccacccaaatctcatcttgaattgtagctcccattatccccacatgttgtgggagggaccaggtgggaataattgaatcatgggggcaatttctcccatcctgttctcagatagtgagtgctcgcaagatcttatggttttataaggggcttcccccttccctgagcactgattcttctctctcctgctgccatgtgaaggagtacatgtttgcttccccttttgcaatgattgtaagttttctgagacctccccagccatgctgaactgtaaatctgttaaacctcttttctttataaattacccagtcttgggtatgtctttattaacagcgcaagaacaaactaatacagtaaattggtaccagaagtggggaaagaagtgcagagtgtgggatggagaggttacttagcctgtgacaaaacctagagtaggatgttagagcaggtgaactgtccccacatattgatcattagagaaatgcaaaccaaaaccacaatgagataacacttaactcccattaggatggctaaagttttttttgaaaagataacaaatgttgtccagaatgtggagaaattggaatcctcatacattgctgttgggattgaaaaatgatgtaaccactttggaaaatagaatgacagttcctcaaaacattaaccataacattcccatatgaccgagcaattccattcctcggtatagaggctaaagaattgggaacgtatgtctccacgttgtgggaacgtatgtctccacaaaaacctgtacccaggtttacagcagtattattttataataaatagccaaaaagtgaaaataacccaaatgtccattagttgatgaatgggctaacaaaatgtggtatattcatataatggaatattatttggcaattaaagggaatgcagtgcttgatacatattaaaacatgaataaatctggaaaacattataaatgagaatagccaggcacaaaaggccatatattgcttaattccatttttagaaatgtccagaatgggaaaattcatagagacagaagtagattagtggttgccagggactgggaggaagggcagtaggtagtgaactgctaatggatacagggcttttttgtttgtttttgtttttgtgactttttttttttttttttgaagtgatgaaaatgttctgaaattagatcgtggcaatgggtgtacaattctgtgaatttgtaagaactaccagacagtacatgtaacaagggtgaattatcccagtaaagagaaaaaattatttctaggcatgatgtcatttaggtatatagtgtattgagaaataccttttgtatattgatcataaaaagatgtattcagtcattaggttaggacactcgtcttttccttttcttttgtaaaagatagcttttcagtgtgaattaaaataagcaatttttactgaaaaactacattttatgtttaagtagataaattattatgccactttatagcgactctctattgatgattcagtccccttaggtcatgcagtaaacacttagagccaggagtgagtgttttgtgttttgtttttactgctttaagacccacagatggcctattagtttgtgtttttagaagaacattaatttcttttaaaaagtctactgttttgtagttttgagtacactcgtaggtatgaggaaaacccaaatatttctt

SEQ ID NO: 9302 - DNA, 1050 bp, Homo sapiens
taaagcaaatctctgaaattcaaagacagaatgtcataagtacacctgtatttcaggtggttggctaattatagaagaataatttcaggtgactttaaagcacagtgattttactttatgtacttaatggaatatcttaaggagataaaattgcaaagaaatctgaaacttgaatcattttagtgatcataatgttatttttagatgattgcgtatgtatagaggacaatacatattaatgttgttagaacccagtttttcagcatgagaaaaaacagttgttacaaaatcaaagtaaaaaccatgcatcctaaatctgaattggaaatatgcattttctgaaggagagtaccacctagaaacagttacaaaaaagcaacagaataataataggtaccccctagtacgcagagtaatgtctctaaataccatttcccactcaaagaaatcagggcttcttcaaaaaaggctgagtaaaatttggggcagggaatatactagatgaccttggaacatctttttgtgcctaaaagcaaacaaggaagtagaacaagcccattgtagccatagcaaaaagatccagcttgacctggtcaaatatggcacactttgaacattgatcagaataactgtgctggattaaaacacatcataaacatattttcaaatctgtgatttcataatgattttttttcccttcgctccaggtagcagagtatcagaattattattattttttttttttgagatggagtctcattctttcgcccaggctggagtgcagtggcgcggtcttggctcagtgcaacctctgtctgcctcctgggttcaagccattctcctgcctcagcctcctgagtagctggtaggtactacagtcacccgccaccacacctggctaatttttttttttttttttggtatttttagtagagatggggtttcaccatgttagcccggatggtcgtgatcttctgacctcgtgatccgcctgtctcggcctccccaagtgctgggattacaggcgtgagccactgcacctggccgatt

SEQ ID NO: 9303 - DNA, 1031 bp, Homo sapiens
caagaaatctggtggtatttgtatcaagaaagcatgtgtatatttttctcatcctattattttctaaataaccttaaggtagatgtcaggaaatagatcacaaagaagagtcatgtcttttcttctttttttttttgagatggagtcttgctctgtcacccaggctggagtgcagtggcgcaatctcagctcactgcaacctccacctcccaggttcaagcaattctcctgcctcagcctcctgagtggctgtgattacaggtgcctgccactacgcccagctaattttttgtgtttttagtagagacggggtttcaccatgttatccaggatggtctccacctcctgacctcatgattcgcctgcctcggcctcccaaagcactggtattacaggcgtgagccaccgcgcccagccagaagagtcatatcttaagtgaagatggctttaaatagtgtttctcagaataatcaagaaagctagaaaggacttttcagccccaaagaacagagggtataaagacatcactcagtatctgaacactagacgctgttgtaaagttactgggtttttaacttatactttgtaatagatattaatgcagctgagttagcaagcaatagtgagatcagtgtcattttctaatcgtatacctcatatgctgtgggatgtggaaagccactaaacttcaaaatgcttatgaattactacagaagctgtctttaagtacttcctataggatttaacatatcatgtggctgttgtagggtgctgtgctcgtgtacactaacgtcagtatgggtgaggttaatgaaaaattccaagatccatggcccaagtgatattgaaatgtaaaattttgaaaaaactttaaaggcatttatatatcttcttagttaaatatggaaattatcaccttaatttattatactatgttggcaggattttggaaaaattcatccttacagagcttaactttttatttttatttttatttttatttttatttttattttgagacggagttttgc

SEQ ID NO: 9304 - DNA, 2089 bp, Homo sapiens
attagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatc

SEQ ID NO: 9305 - DNA, 1029 bp, Homo sapiens
tgaattttctagaattccttttaggtttctatttatataacattgtggtttgaaaggtacttgatgttatttcagtcttttaaatttataaagacttgttttgtggtcaaatatatgatctctcctgcagtatgttctgtgtgtgcttgagaagaatttgtatcctgctgctgttagttggaatgttctgtatatgtcttttagcgccatttggtttgatgtacgtagttcaagtttaatatatccttactgatactctgtctggatggtaagtccattgttgaaagtggggtattaacgtcctcttcagctgtgttgctatttcttccttcagatcagaaaggaacgcgttttttctttctttacatacagtttgacccttgaacgatacgggttcgaactgcgtgggtctgcttatatacagatttttgcagtaaatacaattcgccccctgtatcagcaggtttcacatctgcaaccaaacctatataaagaatatggtattcgtgggatgtaaaatctgtatctgcagagttctgcagggccaattatgggacttgaatatgtatgtcttctggtatctgccaggggcctggaacccgtccttcaagatactgaggtacgactgtatttaggaggtctgacattgggagcatatatatttacaattgttacatcctcttgcaaattcacccctttgtcatttacttaccttgtctctttttgcagtttttgaattaaagtctattctatttgataaaactatagtgtcttctgcactcttggtttctgttttcatggaatatcttttttccatcccttctctttcaaaccatgtgtgtccttgtaggcagcatttagttgggtcttgttttcctttacccattcagctgctctgtcttttcatgtgagaatgtgtgcatctattttgtgttgctatgaaggaatacctaagactgagtaatttatacaggaaagagatttaattggctcacagttctgcaggctgtacaggaagcatggtgctgg

SEQ ID NO: 9306 - DNA, 1049 bp, Homo sapiens
attctccttttatttgcagatttttttttctttttttttgagatggagtctcactttgttacttaggctggagtgcagtggcacgatctcggctcactgcaagctccgcctcctgggttcacgccattctcctgcctcagcctcctgagtagctgggactacaggtgcgcgccaccacgcccagctaatttttttgtgtgtttagtaaagacgaggtttcaccatgttggccaggatggtctccatctcctgacctcgtgatccacccaccttggcctcccaaagtgctgggattacaggcgtgagccaccgtgcctggcctatttgcagcttttaaaatctgctttggactggcaagccaaacaattctcccctgagtgaacaattcttccttctagagaaaatgaattttagcagagatagcattaacaatggagggaggttactttatctacttccagatttagggctgtctaactggttcaggttagaagtcagacctatgggaaagtagaaaaatacagggcgacatacaccaacgttacctgtaggtgatataatgtttcctccatacgggcccccctggcatttccctgaaatgatggacatcggggactccacatcgaggtgcgtgcatcatctccagggtagatgtgtccagttgcccggtcactttcagacccaagaagtgctgcatttcttggattttttccttcattaagtttccactatatttcatttttgtcactggaagtttgtttatctcaaggccataaaatttttctaagtatctctggaaaaaaaaatacattcagcaatgtgtaagtacacacagaaaatttctgttgggagctccacatatatgactcaattgcacactgatgcttttggaccaggaattttgcacatcttactcacaggttagattattgttttttggacaattaattataatcaggaaaaaaaaccttaattttttgtgctatcaaagacatgtcagccaggagcagtagctcaggcctgtaatcccagcatttcgggaggctgag

SEQ ID NO: 9307 - DNA, 1026 bp, Homo sapiens
ttttcaaatattaaattttatgaagataacattaaaaatcatttatcactttagattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggtgagaaaagaagctgtcattttttttaactgaggtatttggataaatgttttcatataaacataaatatctattttttactgttaatgttagtagtgttttaattttaattaaaatatcttttcttaactttttttaacttaaattttaatgtaagttgtggtaaaaaatagagaaattggagaaaggtataaaatgcaatccacatcaactcaacatttctacattaaatgcttttcatagttttaactgttgagaggactttttattcttcttatgaagtggaggtagtggcaggctttaagaaaaatggggttttggacagtgttttgggaagccaatttgattagcaaaattttgatcaatcttggttgctcttgtctgtttttatttaggatcaggaatggagcagaaactttgatcccaaacttcagaatcttttgagtgaactagaagctgggttgggtatagttctacgaagatcagacactaacttaacaaaattgaaatttaaggaagatgacacacgaggtatataaccatagcttaataaaagagagtacaaaatgattgtctcattaatacattagtaaatgaacatatttcttcatagatttcttcaaatacttttggaatttctctgagcataggttttaaaaaatgagtagatttatgtggatgtagagaagaggaaaatataattgttaataatgtgcaatctagcttgagcctccagagtagctagaactacaggtgcataccactatccgctggctaatttattttagttcttgtagagat

SEQ ID NO: 9308 - DNA, 2309 bp, Homo sapiens
tttactgagttgatccgttgggatgaacatgtacttattttattttatattagcttcttcaagcattcctgaaatataaagagttggtaaagcgtccaactataagcaaagaattgatgttagaaagagaaactttactggcaagacttgtggactcaattaaaggtaaaagtttatgagattatagtgtttgcttgagagaatatttttgtatattacttttttcttcgttgcataccatttaggattaaagatacatttttctgacattttcatgctgaagattaatttacttattctgttataaatgacagatttttttgcattaacaagttattataattcgctgtttcatttgatacatggtacagtccttggggataaggaccaactcattatttttctttctacagcatctgacatagtgcttggtacgtggaagttatttaggaaatctttgctaattctttgtaatcatttatttgatttaaattttatagattttcgattagactttgagaatcggtgccgaggaattcctggtgatgcatctggaccactttctggcaaaaatctttcagaagttgtcaacagtatagtttgggttcgccagttggaattgaaggtatttattttaataaaagatgaagagtactaattataaaatctgctaaattaaggcatgtagaaggtactctagagctgtagtaaatatattctctgttttccttggcatgtctgtctaattttcatacaaaatgcagaacactgaaaaagtatgcagaggagtcgtaatggttctattccttctttctgtagagataatgcatcatttattccaattgcagttgttccaaagaaatacctgtattcaggaggaaaacatcctttatgctgagtaaaaaaaagaaaaattattgtttacaaaaatgagctggacatggtgctgcacatctgtagtcccagctactcaggaggctgaggtgggaggatcacctgaacctgggatattgaggctgcagtgagccataattgtgccacagtgctccatggtggacgacagaaagagatgctatctcaaaaaaaaaatattgtaaaattttagtagttgcaaagtcttacctgcaagtatgtttatgtaactaaatcactttaggttggaaggaagttaaaggaaaggtaaaaggtaattatggcatggtctaaggtagtgagaacaatttatagatgtaaacgactattattttaatattattaaaattgacctaagactcttatggacttactaactggtatgtggttcagtgtcttgcattagacttgtacaataaatgttaattgattatagtctgtgagtaagagcaagacctcatggaatattacaaaagccagcatgttcgacatttctgcttattcaggtttgtatttttgatgttttattttctgatatattctgcctaatgtttctgtcagtcagttttccagggtgctctaatgttctctgtacagttgtggaggaaaggcatttatgtctcttaattgacattccctttggcctaattactatttgtgcttttaatcggagcatgttgctaagggccgaaattattactgaacatgtttagcagtaatgctgaagttctcagagtttcctctgaaaatcactggggcacagatattttgagggctgactttccctttaccctccattttattcttggagttatgccttgtatgggttatcctcttgcgtttgctcttctgcggctgtataattcagaagcaaagtaggggttgatatttttatattctttggtgaatcttccgtttcactgtttatagatgaaaggtaaaataatttctgaatcacagatcagagaaggggactccttactttatgctaatttttttggaatttaaataatgcacatgtctgtaatttggctttttaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtggtaagtatagatatattaaactgtaaaatccaaaaccatatgttattaatccaaatacccagagggaattaattatctttttcctttctccaaacttgctactcctcctgtaatttttttttgttgtttgtttttgatcatcaacttttaattcattaaggctggaaactttgatgattt

SEQ ID NO: 9309 - DNA, 1037 bp, Homo sapiens
tcaggacatgacttggcaaattgtaggaactcaacacttacttgttgattgtgtgtattaatacatgaacaaatgccctattggagatgaaaaaccaattttctgtttaaattttaggattgagaaaagttaacattttcattcaaacaattaaaaataaaaaattaaaaatgaagttattaattattactaattggacttttactttgtaggtggcacatttttataattctattgatcaacaaatgattcaaagtcagaggccaatgatgttacaatctgccttagcatttgaacagataattaaggtaaatgggcttttaattttattataattagattttacatgtgaagtgtttaattcttaattttccggtgttcccttcagcttaatatatcaaatgatctagattttgttttgcttccagggacttccttcaatcttagcaagtaaaattattttttctaactgtaggtttaagtggttagaatatttcatatattttggtactgatttcgatcaattgcattgatatagatagaaaatgatttgtatgatgttatgttcatttatcctctgaagtttgaggtccttatacacaagcttccttagacctttcccaccacctcccaattttgtaatgtaatatttttttcctttttatttgtggttatttaaatgtctgtatataagaaattaggaggctgggtgcagtggcttacgcctgtcatcccagcactttcgaggccgaggcgggtggatcacctgacatcaggggtttgagaccagcctggccaacatggtgaaaccccatctcaactaaaaatacaaaaaaattagccaggcatggtggtgggtgcctgtaatcccagctactcgggaggctgatgcaggagaatcacttgaacccaggaggtggaggttgcagtgggtcgagatcgtgccactgcactctagcctgggagacagagcgactccatctcaaaaaaaaagaaaaaaaagaaagaaaaagaaattaggaaaacccataatagcg

SEQ ID NO: 9310 - DNA, 1030 bp, Homo sapiens
cagtagtgtgatctcggcttactgcaacccctgccttctgggttcaagcaattctcctacctcagcctcctgagtagctgggattacaggcgtgcgccaccatgcctggctaatttttatatttttagtagagacaggggtctcaccatgtgggccaggctggttttgaactcctgacctcaggcgatccacctgcttctgcctcccaaagtgctaggattacaggccactgtgcctggcctattctgctatttttatggaatactatttcatcggtatttttccatgttatcatctgcacatcaaaaatgtgatttttaattataggtatatataaaaatttattttgccatttctatatttatcttgtttcaaacttttcactattatagttagtgctttcatgaaaatgcttgtgtataaatcttggagcctgccttgaaatttgtcttaggataaattctaaaggtagagttgttaagacaaaggatatgccagtttaaaattatttgacgtgtacattgctctttacaaagattgcattgttttatattctaacagttctgggaattctgtttgcccacaaaattgaagattcaaagtaaccattcattacattttttttcaatttgataagtgtaaaatggtgtcttatcgttttattgttttagtgctttaataatctaaattcactttctatctacatttaattttgccttatttttattgtttgtattttggctacaggatagtaaatttattttataaatatttaaataggtgtgttacatgctgtgacaagagaagctcattaatatttaaatatattcttttgacactttactaattcataacataccacctttttttgaagctgatatgctggatgattaaacttctagtattgtaacaaaattattgctcaatgaaaaacttcaaaatagtatgtataaggcatttttgctaaattaaatctaaatgtgcttaaagatcaccatattactgctgacatacatttttaagtgtatta

SEQ ID NO: 9311 - DNA, 1028 bp, Homo sapiens
tatatgagtaggtaaagtaaaattctcatagtaaataggtagtttcttaatgttcttattgtagtttcttattgtttcttattgtatatctattaaacatacacaagtgtgtgtgtacacacatacaaggattgcagttaagtaacttaatgatacttaacagtatcaatatttctgtttttaaaatttaatatttcaatatttgtttctatagtgatgattgccatcattttagactggaagagcctaatttctccctggcaagtagtatctctaaagatatcgagagctgtgcccaaatttgggccttttatgaagagtttcaacaaggatttcaggaaatggccaatgaagactggatcacttttcggtttgattcaaaaacaatatttagactaataatttggttgttttatttttggatgtaatctttgcaatgtgtttttggtattttataggactaagacatacctgtttgaggaatttttgatgaactggcatgacagattaaggaaggttgaagaacattcagtgatgacagtgaaattacaatcagaggttgacaaatataaagtaagattgttttattattttgccaattaaaaacaatgtttggagctttcatcttatgtagtgactgaactatataattttactttatatgtttttcaattaaattattccgtttgatgaagaaaataggaaatacagagtaaaccatagaaattattgatatttctactaccaatgagaaagaagttataagaaatttatgttaaagttaaaaaacagagtgcttatacattccagtccatcatgggtcctatcctataataataaaaatagaaatagtctatgccatgttttaaaatatattaaactacaaagggtaatttgtgtgtgtccatggcaacatttaatcaaaagctttatacaattctgtttaagaatatgattttaagattattaaacaagaaaatggaataattaaaattttggtaactaataagcataaaagtaaatactaa

SEQ ID NO: 9312 - DNA, 1044 bp, Homo sapiens
gaattttgctatcgtagacttcagtactatactaagaaattattttgaaatgctaaagattgcccttttattaattagaatgcatcatactttgatatctttgtagtttactggttgaaaagaagccatttctgaagagaggggaagaaaatacaaaggctttgaggttacaataaacatagtgggttataggaccagaaaaataggtttgtagtagagtatagtatgaaatgagttctgtgaagtaggcttggctgcatcacacaatactttttctactactatattactctattaatatttaaggttccagtatgacattaagatggagagatccaatatacaattggctatttgaaaaaaggtgcctttctttaaatttataaaatatttctaagtaaattcaccttttaaaaataatttttctctttattcaatagattttatgcttggcggagcagattaaattcactgaagatgtagaaaatgctattaaagatcatagtcttcatcagattgaaacacaactggtgaataagttagagcaatatactaacattgatacaagttctgaggatccagggaatactggtatggaaaagacattcccttttctgcctggttttgggttattttttggtattctatcctaatttacctattgtgtttttgactgtatatctgtgttggtgattactcgaggaattacaacatatatacttaaatttttataatgtactttgaatcagtaatttactaatttaaatagaatatagaaaccttactaccatataggcttctttatcctctccttttaatattgtagttgtcttaatattttacatttacatacactgaaaactccatgagattatgttataaattttgcttttaaccatcaaagttatttgaaaaaactcgaggagaacaatcttttatatatacctagatgtttaccatttgttgcccttcctttattcctgatgttccaggtttccttctggtgtcattttccttctgtctaaagaacttcttttagtgttt

SEQ ID NO: 9313 - DNA, 1035 bp, Homo sapiens
gttgtgttcaaatggtggattctgaatttcagtatacttatgaatatcaggtatgagttgtggcagtgttttatatttccaattagaaattatttactgtaaagaaaatttgttattggtagaaatacttttttatttaagtagtaatttttccataatatttttagtattattgtcttgtttaatcagaattagaaaggtgtcacataagaaaaaagtgaaacttcattctatatacaaaaaagttaaaatattgctagtattgtactgaattctcaaaaatgtaccttttcttggagttgcatttatatacaatttgaaatatatcttcatccaaggagaactgaatatagacaacctcagtcaaagcaatttggtttgtgtctccttatacaaggcaaaaattagtgttattttaaatatgctaaaatgtttgctaaatattttttagtttgtaagatgaaaaaattttcagacaaataacctagttaatgtaaacatgttctcaaaaattccacctgttgcctctgcctttttctatcataatgaatgaatcatcaaaatatatttgaaaatattgttaataaacctatgttaggagagctgccaaatggctttttcaaaagggaaatgtatttgggacccaaatctatctacctcaattgaggaaaaacacactgtaaattgtagctggaatgggagtctgttttccctacagtttagtagaaactttgagaattatttgataaattacatgattaatttcttaaggaatttttcaaattcattacactttgtgatctccaaaatagttctgatttgtggatatcataagagtcaaggaaatagtttatataaattttaaaatatgaaatgggatgattactgtataataattttggatttcttttccttagaagtatatctttgtgccattaacaagaacttgagaaacaattttgaaacctaacaatgtattgagtatagtatgaaatactttcttgaaaaataagtttgatttcagcttgtgtttag

SEQ ID NO: 9314 - DNA, 1044 bp, Homo sapiens
gtgtgagccccacacccagcccattattcatttttaaactttccattttggataattcagttataataatatttatattgttgtattatatattattctattgtctgtgctgacattgttcacagtgccttaatgtattgtctcatttaataattaccacaaccctttgaagtaggtgctattatttttttccctgctttgtggctgaagaaactaggacttgataagtaagagtaagaagtggagctaggaattgaacccaggtctgtctaattctgaagcacatttttttttgtttaaccttcaagcataggagcagaatgaagcacatgtttttgatcattattctatatgaatgttaaaacaacaaacacttagctattttgttcctcacttctccaaataggagatatacattaatgtcactagaatataaattcgtttgtacagaaaacgtaaacttttttatataatgtggattgctgaatacaggaagttgtaagaactaagaaattatcatgttatataaaataacattttaacagtacatagttttctaggtagcccaagaatgtaagaccagttctaaattgttaacatgttgtttatgtgatgtttaaactcttcacaaagaaaaagagaagaaactattaagtgagaattacctgccttcaagatttagtttcttctacattcacttttttttcttctcttacaaagaaagagttgtcttttctcccaaccagtactaatcttttcacctgtactttggaatcctcttccctgggaccttattatcccttgtgctatagcttcagtcttccctcctctaccaattcctcattaggttttaaacataatcacatctttttcatcttaataataactaaaacataaacaaaccttccctgatttatatttcttctttctcttttctttcctttgtagctagatttcttggtttttctactctagatgcttctacttactaattgcccattcattatttacacattctaatttagcttctattcttagggtttt

SEQ ID NO: 9315 - DNA, 1050 bp, Homo sapiens
gttttcgttttctcaaactttttcttttctgactttgtaagaatgaaaaatggaggaatagggatttgtgaggatagcgatgcaagtgaggtgggttttcctggaggcctaggaaagggaacactcccattagctcctagtctgactgagctgtctcctcctttgtgcttctgtagcaacatacagcatctaccaactatgttataattgtctgtttacattaaactataagcaccttgaaggcaaggaccaagcttatcacactcttcattgtgtcctcagaaccaagtatgatattaagtgatagcaaatgaatgatagtattgtgcttaattatatacctgatgcctacattgtgacaccttttcagtagatatgttatttcattagtacaaaacattcagagcctaacaaggctttccaatgcagatactttgaggtaatctgctcatagatgtgtgaatgttataataggagtatcgtattagatggaatatatttatgtatatataggggtttatgactgtagaaatgacgacaggataagattgttaaacaatagagtgaataccaaagattcagttaggaaaaaaaatggtttatgttttgaggtcacaccgctgtttgtttgtttgttttatttaatgtgttaagggttcttttctttttatcctgtattttgttcaccatgcacaggttctgaggtataccacaatgaattctctagtcaaatgctgaaattgtatttataactagaactttgctttcttcttttttctcttcctcagcctatgggataaatctttgctttcttgtatgaattcagcaaataagaaaatatagaagaaaatatgtacatttcctttatctcacctttaaaatctggaactctcagtatgagtctgtctagatttctttctttcttctcctttcttcctgctcttcctcctatttcttctttctcacaaaaatattaatttttttaagcacagcgatgtttttaaaatgtaaactgggtaattttactctattataaaaaacatgttaaag

SEQ ID NO: 9316 - DNA, 1035 bp, Homo sapiens
aaattcagtggttatttcttttcttcgctggttggcatttatggatttttgatagcttatggtactctctttaagagtctctttcacatgaaaacatttttagaaattaagaaaactctgttattcagcataagatgatacagtggactttggggacttgggggtaagagtagggtggggagggataaaaggcaacaaatatggtgcagtgtatactgccctggtgatgggtgcaccagtatctcacaattcaccactaaagaacttatgtaagcaaataccacctgtacccaataactaatggcaaaataaaataaaataataataaagaaaaaagaaaaccctgttattaactgaaacataatatccaagattatattttataataacctttaaaattaagattatattttataaagtaatgttttcatccatgtcacctcacttagtacattctgaacagttttctttccgtatttctttaactataaagctttaacttaaatgtgacattagaatgtcagcctctgaagttgttagagaacatttcctctctaaagttttagtttccctttgttagggtagtaaagtaggctccatcttaattgacataattatcttaatcatttctaatgattcactttcatttatattaaggtactaactatacgggctttggggagggttaatttcctgatttagttctctatggtactttggataaatcactttaacttactgttttgcagcttaattgggtcaatggtagttgtatgtgagtgtattagataaaattcatatggaaaaaacttagcttaatacctgtactttatgatgggtgctcaatagttattaattacattccttttttgccattactctttccccaaatcttctgatttgttaggtgacaaaaacatgatagaaggtaaagaatttttttcatgtacatccctgggttcattattctgctgtttgcacagtaggatggggtaccataatggccaggccagggtgaaatgtctactcaaaatg

SEQ ID NO: 9317 - DNA, 1047 bp, Homo sapiens
ctgttttcaaattcatcttttttattctttatcctaactcctcttattagcttcagacttgctcaattactggcagggcatggtcactcatgctgtaatcctagctctttgggaagccgagtgggaagattgcttgagcccatgagtttaaggaccagcctgggcaatatagtgagaccttatctctacaaaaaaagtaaaaattagttgagtgtggtggcacgtgcctatagtcccagctactcaggaggctgaggtaggaggattgcttgagtttgagaggcagaggttgcacaacgagctgaaatcatgccactgctctccagcctgagtgacagagcaagactctcaaaaaaaaaaaattcaattttatctgttaaacatgtcttcttggaagtctctcgggcattacaatttgaaacaggttcaaaactgaacttatgagttttctttcctgtatttctttcctcagattatggtactataatatacactaattatttaagacagaacttataaattatattatactgagacttttgttaccttatcccttaatgtaatgagtcattaaattctgtcaattttatttccctgactatgcctcaaatatgtttccccatctccctcttggtaactgttaccttgtcaactaggcactaatctaatgcctcttttatgaaaattaactttaatattcatcagactaatgtatatatctcaattaaaaagtaagtggcatgaaaaatcaacaaagttatgggagttaggatttctttttttttttttgagacggagtctcgctctgtcgcccaggccggactgcggactgcagtggcgcaatctcggctcactgcaagctccgcttcccgggttcacgccattctcctgcctcagcctcccgagtagctgggactgggacttaggatttcaagagtcacttttcagtaatcataaggcaatctgatattactgtaatattaggcatagagatcactggaatgtggtcggttgattttacacaaaaatgccaaataaatggggaaa

SEQ ID NO: 9318 - DNA, 1026 bp, Homo sapiens
cagaacttgaaagactgaagcacagaatagcagaagaagttgttaaaattgaagaaagaaaaaataaaattgatgatgaattaaaagaagtacaagtaagttaaaaaacattctaagatccatttacatttttgcttaccagttatatgtaggaatttaaacattatttgtaactcaagttgttttctcatagtattataaaatgtggttttcaaccaaaatgttacttgtaaaagagaacaagaaggaaagccttccaggaaaagtataaattaatggatgataattaaaaataatctttgttttccaagagccatatggttttgattgcagagggaaaaaatgtgttagataaattaagatatactgttaagctctttttctccagttgattaaattagtcagctagtcctaggatataaagagcctcttgaaaatgacaaattgtctcaaaacaagttagattttccaaattaggttattgcagttgtggtggcaagacgtcttactgtctcaagttgaacattttttacaccttgtatgattgaaagcattttgatattttaagagagagaacattagtaactatagtcattttgcataaatgacaataaaacataatttttcaagagttaatgatttaaagaaatatataatttgaagataaaaatggcctttttctcttttagcctttagtcaatgaagctaaactagcagttggaaacattaagcccgaatcactttcagaaattcgctcactacgcatgccacctgatgtaattagagatattcttgaaggagttttaaggttgatgggtatctttgatacatcttgggtgagcatgaaaaggtacatttttcaatttgtgaaaaatattatttcggcaatgaatgacacattctttcgtagttttaaatatttcttatattgtttttcaaaatgcacttcatctaaatacatgggtgtacattttggcttgaaatttcaaggtattctatgtaatcatatatcaagatctatatatt

SEQ ID NO: 9319 - DNA, 1050 bp, Homo sapiens
tttttttttttttgagacagagtcttgctctgtcgccaggctggagtgcagtggcgcgatctcagcttacttcaacctccgcctcccgggttcaagtgattcccctgcttcagcctcccaagtagctgggattacaggcatgtgccaccacacctggctaattttctgtattttagtagagaaggggtttcaccatgttggcgaagatgatctcgatctcctgacctagtgatccgcccacctccgcctcccaaagtgctgggattacaggcataagccaccgtgccttgctggaaatttaaggcttttgtatttgtttttaccttctaagttctaggaaatgcttagcatgtattttccaaaacagtgtgtgggcaggtaggaggaagatttaaccacttactattagagctgtggttctaatttgctatcgttactaagtcagaaatatattttatctcttttgttctaaatgcagacccaaaggtttatgttcttttaaaaaaaaaaatttcaataggtttttggggaacaagtggtgtttggttacatgaatgaaatctttagtggtgatttcagagattttggtgcagccatcatctgagcagtgttacactatacccaatgtgtagtcttttatctcttgccaccccctgccctttcccgagtctccaaagtccaatgcctcattcttacgcctttgcgtccttatagcttagctcctacgtgagtgagaacgtacaatgtttggttttccattcctgagatactttacttagaatattagtctccaattccatccagattgttgcaaatgccattattttgtttctttttgtggctgagcagtattccgtggggtatatatataccacattctctttatccactggctgaatgatgggcattgggttggttccatatttttgccattgcaatttgtgctgctacaaacatgcgtgtgcaagtgtcttttccatataatgccttcttttcctctgggtagatacctagtagtagaattactggatcaaagagtagatctacttt

SEQ ID NO: 9320 - DNA, 1024 bp, Homo sapiens
atttagaagtaaagaaaaaatataattgaggatttctatttttgtcatctataatcagccatttcagagcaatctggaatatgaaacatattaatgttaaaaccatactgaatgagaatagatattccttgggtgcttcagtatcccaggatcttcttagtgaatattatttatcattgcttgcataagtgctgataaatagaacattctgctaatagtatctcaggtaacccaacttttgccgtcttagactctgtcgaaaagcctatatttagaagtacttaaaaattatattttcaaatattgtatagtgaaatacagaagattcagaccaaccaattgtgtgttttttttaaataggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcaggtatacatagataataataatttaccttggaatcttttcgagctttatatacctattagacattgtgagtgagaagctattttgttagactaattagtatttacatttatgattttgaaaataatacttgtatgttggagtgaagcattctggcttatttcatttatcatatgtattagacctgtacatttgatgctaatgtcaaattgctgctccttttaatataactctaattttaaagtttatttctgttatatgtggtagaatttgagagattgatggatcgtaaagatcatctgcattatatttttggtttgaaaactgaaatttaattgtgaaaagtgtagctaattgacttgttcagctagttaagagtctttgattcctgagccagcatttttttttaaccattagaacacatggcatctttgaagtcaatttatcttcatatggctcattacagttcagaattattacataaatttcaaaatgatttttca

SEQ ID NO: 9321 - DNA, 1034 bp, Homo sapiens
gcgcccaccaccacgcctggctaattttttgtatttttagtagagatggagtttcactatgttagccaggctggtctcgaactccttacctcgtgatccacccacctcagcctcccaaagtgctgggattacaggcgtgagctaccatgcctggccctttttatttgttaatgtgaatacttactattaaaaaaatagtaatctcataatttagtatatttaatttaaaactaaatattacacattgatatgttaagtaatgcactttcttacagcttttctacagtagttaatattttactgatcagcttaactgttttgtctctttttcatcagatgtaattgttgaaggtgtcttatgtttaattagaaagaatgaaatgagataacatagtatcatatttgtaatagtctgtcaaacacaaggcctgtttgcaggaagtttttgttttgttttaagccttattgctagaattaccttgtctttttgttatcccaagcttttagctttaaccattcagcatgagaaacctgatttagaagaacagaaaacaaaactattacaacaggaagaagataagaaaatacagctagccaagctcgaagaatctcttctagaggtaaaagtctagctatttaggttacttttttcgtattactttttttttaatgaatacaaataacagtgtttggaaaattaatagtatcttcagatttttttttccaaagacatattagtgtatatcttacagtcaaaattctaacaagaaggggagctatgttttggaatacaagatcttaatgagcaatgtttaagacaagcaatttttaactaatttgtattgttttattatttaattatatgctaataatttcaagaagcattgaaagcaagaaattataacaatctgtaactttaagtagtttttattttttattaaattgacaaaattaataccttgctatgtttgataatgatataatttcttaaaataatttatgaattcatttgatataagaagactataataaaa

SEQ ID NO: 9322 - DNA, 1047 bp, Homo sapiens
taatttttttattcttaattttaattcagtttaactggaaataatgcagccatgcacttgtgcgcatgttctttttctctttttctgtaaattgtgtttttagtattattcttgaatcattattgttctgctttataatgttattgttaaatacttatggctgaagggatttattggtacaggtaggcaaccagatatagggccaaaagagctttctttgccatttccagcttagaaaattaaggaagaagatcctggttggcctgtctgaggtcacatggaaacccttgtatcaatgtctatggagtgctgcgatgtgattgagcaacaccgtaattatatgctcattcttaaggtcaggatatcttctgtaaccagataacaggagaagggtaaccaccattacccacttattgtctacatattatgtgcctattttttgacaacattttggagttttgggctcagtaataattagcaattagtttactgactccagtggataatctgaggaccatagactgacaggggctttgcttctgttcttgaacctagagactacattgttcttcctcagtacaagtgaagaaatggctaaaataaatgtagtagtactgtgtgtacatttgtttgtgtgtgtgtgtatatatatatatacacacacatatatatatatctgtgtgtgtcacagatatatatatctgtcataaagaattaactaggccaggcatggtgactcatacatgtaatctcagcactttgcatggtcaaggtggaaggatcacttgagtccaggagtttgaggctgtagtaagctatgatcacactactgcaccccagcctgggcaacagagtgagaccatgtctgtaaaaacaaacatcaaaacaaatgaaaagaatttgctatatcattaaattataagtattgaacaatatcattaaatgataacgtttttgaattaatacatttattgtcttatttatctttatcgataattatgtatttctttaccttaaactatatgttattataatcattttaaagat

SEQ ID NO: 9323 - DNA, 1029 bp, Homo sapiens
actgtactgaatgctataggcaattgtaacacagtggtaggtatttgtgtctctaaacatagaaaagatacagtaaaaatacagcattataatcttatggaacaaccatggtatacatggtccatcgttgattgaaaagtcattatgcagctcatgtaattctttcctctcttttctttctttctatactcaatctaccatcaaattcttttggtttcaaccctaaaacttactctgaattcattttatttgctttattagtaccaacctaatacaagctatcatcagctctcaattactgccataccttttatttgttgtctctatgtttagagtatatccagaatccagtcacttctcagacctttaggactttctaccactttgtttaagccacttttatataagcgagattattaccattcaggcttctatccttccccactttaagtctatcctcaacatagctgctaagtgccttttgaaatataaattagatcatatcacttctctgctccaagtcttctgatggaatgtgacatctcatcttcttcagaatccttataatgtcctacaaggtcttaccctcagatcttatctcctaaccactcttgacccttgctcagttctttaccaacgtaatagtctttttcttgttttttttactgctctaagtatgtttctggaatatcagaacctttgcacttgctgttcctattgctcaaacgcatgttaaaataaaacaggacacttttcagagaggttcttaagagaggtttttttttcctacccatttagtctttaatatacgttttttgtgccacatggcacataacctttcttactgattttatagtttaactccccatcaactctttgaaatacttatggtactatttcatctccaggtcaaatgacattcaaggtttaatggcattaattaaaaacctcatattatttatatattcagatgctttgaaagtttaatacacttttaaaatcatactatttctaagcaaaaattatgtt

SEQ ID NO: 9324 - DNA, 1013 bp, Homo sapiens
gcaagttgtttcttttttgttatctcagtattgtatttgcataaaataaaaaacaataaaggtttcagttattcgtttgtcttattcttatttttttgaaggaagtgctgtatttattttttaaattatggtcagaatataaagttccagtgatttccaaatagttttacatgataattcacagtgcaattattatttttggctctctaactatattaaatagttttgaatgattcatattgatgattctgatggtatcatgaatcagaattatttggattgataaaaccagtatactcagttcacttaaagtgcaacagaaattttgctggagttttgtgggcaggatggctaacatataattccaagtaacatgaatgtcacctgtgttatattaaatggcaaggtatttttcatgatttttttctccaactcaaaatgttttattgctttgaaatattgtgtaaaatgaattaatggacatatatttatatcctgtgggattttaaaattaaaagttataattgaatttactaggctctggataataaagtagtgaaagattcagtatgattcttgccctcatgaagtttacagtgtacattggttaaataaacaagtggtatggtaatctgcattttagcttttttagacagtttttgtactggcatgtattttccaaataaaatacacttaagtcagtaagtagttattttaaatgtaaatattttatatatattttgacatttttattgtataatacatggtaattacaggagtatcagaaaatgcatagacatgaaaagaaaatgagaaacacctggtattccatcattaacactaatcattgttaacgtttctatgtatgcctttgctttctttttatgcacatagaagtgtatacattacaatatggaattattgccaaatctcttgaatggtctgatttttctgtaaattatcttttacctcaacatgtttgtaacttcagttttaatgtatggctatcagaa

SEQ ID NO: 9325 - DNA, 1050 bp, Homo sapiens
ctgcataaggttatccagttttcccagcaccatttgtagacgacactgttctttcctcaatgtttgttcttggcacttattgaagctgagttggttgtaaatgtgtggatttatagtcgggttccttgttctctttcattgctctatgtgtctgtttttatgcccctaccatggtattttggttactataggtttctagtatactttggagtcaggaagtatgatttgctctagttttgttctttttgctcatgattgctttaggtattctggatcttttgtggttccatataaatgttaggagttttttttctatttctgtgaagaatgtcattgatattttggtagggattgcactgaatgtgggtgatgtggtcatttttacaataattaattctttcaagccatgaacataggatatctttccatgtttttgtgtactcttcaatttctctgtgtatgttcatatagcctcttttcaagctcaccaattcttcttctgcctgatcagttctgctgttgagacactgatgtatttttcagtttgtcaattgaattttttagccaggaattctgtttcatttattttaaaaattatatgaatctctttcttaaagttgtctgatagaattccttctctgtgttatcttgaagtttgttgagcttcatgaagacagctgttttgaatttcctgtctgaggtcacatgtcttcatcactccaggattggtcactggtgccctatttagtctgtttggtgaggtcatgttttcctagttgttcttgatgcttatggacattcatcattgtctgggcatttaagtgttagatatttatttctgtctttgtgttatggccttgtttgtacctgtccttcttgagtggactttgaagacttcaaatataattgagtgttgttaccatagctgtagctactacagccattttagcattaccaggtgccctaacccaggtatgctgtgacccctacagacccttagatatatagccttggtggagttgggcaaggtaagacagaattccctgagtt

SEQ ID NO: 9326 - DNA, 1998 bp, Homo sapiens
gtaattatcattgctttaccattttatagggtttattatgctattctttttccagtcatttcatatttttaaggaaactatctttgtcagcattttgagattatgaaatttaaatcaaaacaattccagatttcagaaatgaacaaatagagacactgagcggttattaattatgagtaattagagctttctggataaagaggcagctttatgccaggactggtggctcacgcctataatcccagcattttgggaggccgaagtgggaggatcgcttgagcccaggagttcaagactagcctggacaacatactgagacatggtctctaccaaaaataaaattagctgggcatggtgggacacacctgtaatcccagctagtagggaggctgagatgggaggatcgcttgagcccagggatttgaagctgcagtgagctatcattgcgctattgcactctagcctgggtgtctgagcaagaccctgtctcaaaaaaatccaaataacaacaacaaatgaagcatctttcaaatacaagccattatagtatacaatttaaaaatcggttttccccaactttgagttcttttgttttttaaactgcttaaataaaacagtaaaatattaagccaattgaagagagataataagattataaactgttgacaacatttttggtctctatttttataaaacaaaatgtctgtttttgtacctatgttctttcttcctgttcggctgaagttctttttatttgttgatacttattatttttttattcaggttatttcacagttgaggattttgggcagatccataacagctggttccaaatttgatagagaaatctggtctaatgaactttctcctgtcctcaatctctggaagaaactaaaccaggttagtagtggaatattcttctgattcttttgctttttctcccgcatcgtaaccatgtgctccccatttctgcctgagtcatacaagtaatcacattgcagaggttcctaactgtgaagtcatggcccatgacctcctttcttcataccagtgcacatcaaagttagtattttttactctctcttttatgaaatagatctttccttatctttaaataagtaatcatattcacataatttcagttcttccctttagcagttcattccttgtcttgatgtttgataattttcttcctctcagggctatgcttcttgtaacagtttctgagcccagtttccaacttttttttaagtgacattggcagttttgtattttctaatgattttcccaattcatgcagttcttaaaatgtatatacatagtacaaccatgtaggtattcatatgtatatatattattatgtaatatagctatttattctgagaataatgtgtgattgttttcagtttttacttagtaataatatgaaaatggaataatttgcataattgactaagttcacctcttactaaacagaaaaccaatggcaaaagtaaccttaattattgcaaagatctcatcttacattttggagacataatccaggtatttgttggaaagtttccttctctgtgaaatacaggttaacttgtttgactcaatttccagagtttgggggaagattagagtctactctgtagttttggcaccttagtcccctataattttctctgcctacttctgaatttgcaaagtccatgttgtttttgctccacatttgatttaaccttaaagcacaacttatatctctgttttttataagaaatccgttgatgtgattttgtagttttagtgatcattaatgaagttgcgaggacagctcatattgctaagtgtgcagtcttctactaagccacttttttttaaactacattctttgaagttttgcacttcaaagttcccacagttgactcttccatctgtgcaaagtttacttggatgtgtcatttagacttccttgcactaactgcttctcttcatcaggcacatctgatttta

SEQ ID NO: 9327 - DNA, 1054 bp, Homo sapiens
gttttgttatagcaaccagaacagactaagacagggataaggaattttattccaagtgcaatgggaaaccatggaagttataggtagagtgggtatgatctagtttacaatttcaaaaagtttttgaagaaagctgttgtgtagaagatggtgagaaagtaaggagagcattcaggaagctcctgcagtagtccaggtaagagcagatggcagcttacattacggtggcagagcagatgaagagcagtgggtgcccttgagtaatgtcaaaatgtagagttattatgagaaaaaaatttagagttattatagggaaacaaacaaacaaaaacaaaaaacgaaaaaagaactgaagactgtgttaccatagaaaccttgaggaatctttagttaggaatgaaattgttaactaggccgaatagcttctgagaggttaaacaaaacgaggacagaattgaccactggatattcagaataaaagtggtcactggtgaccttgacaagtaaagtttaggtggaataaggagactggaagttagatttaaaggctgactagagataggagatgaggagctggagtcaatgtatctagacaattcttttttaaaatgtgcttataaaggagagtagtgaaataaggtgatcaagatacagggcccattgtgtttttttcttagagagggaaagtaagtattaggttggttttaggctaatgagaaagatcccgttgaggaagtagttgaagatgctgaaaaatcgaagctcttaaaccatttaggaaaacaaaaacaatgatttttgctaaatgagggatcaataataaatatagacattcctgcttcttaaatatattaatttttttcttttttttttttcttttttttttttttttagctataggatcttgatgtaaccacttctctcaatgtgaaaccactgaagtttaatcttgccttgcttttctgtccttacttctggtcatatagaattccattgtttcagtatttacaagactatttggtttgtgtatttgtttttaattattagctcaatc

SEQ ID NO: 9328 - DNA, 1034 bp, Homo sapiens
atgatgaaaaggaaatgaccaaagaaaaccaaagatatagttaagttttactaaaatattaacattttacataatgtgaatactattaacaatatgtgtaaagaatctaatgcagtacctacatttgacttttaaaatatcaaaatattaacttcagtagattctaagaatttaagaatcttaataaattatgagcaaaagggctaaataaaacagaagggttctactgacaaaggagataggaggctttcgtgagaagcagtttccttttgatgatttttttttttttaagggctggtatttgatttgattactgagtttgttagaatagtttcgtaattggtccttgaaacatttttatgatggctgctttacagtccttgttcaagaatcccaacttctgtgtcatgttggtgtttgcatctgataatctttctttttaaatttaaattgaagttttactggttcttggtataatgaataactttgtactatatcctgaacattttaaatatttgtaagactctggttcgtatttaaatcttgttgtttttttttttttttaagcaggtagtcaacctatttaagttcagaatgcatgtcttgattcacttctataggttgtggttccaacatcaatttggtttataaaatatctgcagtgctattctggtctgcctcacttgtgtcttatatgacaggactttaccaccaccactgccatcactacctcctccccacagtctccacagagccagctgtgagagggagggcatgccctctcgttacttcagtagtgaagtggagcccagaattccacccacaggcactgcaggggaggagcaatatgcttcttacttcagggagcaggcagaagtcagagtactgcccagcatctccacctggcatctctccttctactgcaggccaaggatgactcatgacttttaataaaataattattgatttcttcttcttttttaatttgtagaatattttacattggtaagttagaaatgtgcattggtgcccag

SEQ ID NO: 9329 - DNA, 1050 bp, Homo sapiens
cttgatcttaacattcagtatgatgttatctgtgcatttgtcaagtgtggcctttaattgtgttgaggtagataacttctgtttcaatttgttgatagtttttttgtcaggaagagatgttgaattttgtcaaatgccttttttgtgtctgttgaaatgatcatgtggcttttgtccttctgttaatgtgtgtcatttttattcatttgtatatgttgaaccatccttgcatccctggggtgaatcccactttagtatactgaatgatctttttaatgtatttttgaatttggttcgctagtatctttttgagagttttcacatctatgtttcagggatattggcctgtagtttgctttttctttgctgtgttttttctttgctgtgtccttctctggttttggaatcacaatcatgctggctttgtaaaatgagtttagaattgtttcttcctctttatttttttggaatagtttgaagaacattggtattagttctttaaatgtttatggtagagtgcagcagtgaagtcatcaggtcctgagctgttctttgaagacttctattacacattcagtttccacacttgttattggtttgttcaattgtgtgtgtgtgtgtatgtgtgtttggagatagggtcttgctctgtcactcaggctggagtgcagtggtgtgatcttgactcactgcagccccgacttcctgggctcaggcaatccccatgcctcagccccccaagtagctgggactacagtcgtgcaccaccatattaggctaatttttgtagagatagggtttttccatgttgtccaggctgatctcaaactcctgagctcaggcagtctgcccattttggcctcccaaagtgctgggtttacaggcatgagtgaccatgcctgaccccattttttaattgataatttatcttggtagattgtatgtgtctaggaatttatccacttttttctgctatcagtgtgttggcatatagttgctcataaaagtctcttatgatactttgtatttctgtgatatcagtagtaatgt

SEQ ID NO: 9330 - DNA, 1012 bp, Homo sapiens
tatatttgtcaggaatcatatagttaatagcagaagacccgagtcacactggcttaagccatataaaaattaattgactgatgtaactgaagaatccaatggtatctagcattatgccagcttgatgtaggaacttaaattgtcattagcatgtcagtttatgttagctatctagtgttacatatataatgaaatttatgttgatttcactttggggcaggtcccctatacatgagcttgagttttatattccaagctccaagtccaacagaaagaacacgtgttttctagtaacacacacaaaaatcttaggatttgctttgattaaaaccagttggctcatgcgttatgcctattcccatactagttcagtgggcagtgtgtgcaaagctctcactgaccagagcttcagccaaatgcctcttcctggagctggggatggatttatctttgcctttaacacatatactgagagtaaggaaatgatgattaccagtgaaaagtctagatagttttagaagaaggggaaatcaacacttcttgtgctgaaaaattggaccattttaaatgataataaaatccatgtattttatatctatttgatagaaacaaaaatatgggatgttctgcacagatttattttagctgtttggagaatagaaactttgcagaagttggtatctggaaaatatttcagtggagtgctataggaattaagttttctttttttttttcacgcccccttgctgtttgtactcaatatagggaaacctctgatagtcaacctaacagtcctctctgtttgaatataaaataatagccttcctagaacttcctacattcacatatactagcattaaaatatccagtgcttttctacatatacagaaaggtctactctggcatccttgtcttcttttttattttaccttgaaaaagaatctgttttgcattgttttttctttgtacatacattgccgtctctgttaatcaaccatgattatcaaaatac

SEQ ID NO: 9331 - DNA, 1092 bp, Homo sapiens
gctggaattacaggtgtgagccaccgtgcgcggcccttgatttcaaagttttgtcctaagcagttggttaagtggtttagtgagttgaaggatactgacaatatggtaatagagcagagttttgttgttgttgttgttgttgttgttgttgtttagggaggaggggagtggtcttgcaaattaaaagttctaatttgaacatgataagtttagatgtcttttagacatcttggtggaaatgtcagagaagtaattgatgagaaagctactggaattggaaatagaaaattagcaattatcagcatatcaacatagtgtttaaaaccataggaatggccaagtatctggcactggtgcacttcaatattgagatgtttagaaaaggaaaagttgtccatcattaaaaccaagaaatagtagttaggtatatagaagaaagcctgggaggctgtagtgatcaagaagccaagagaataaagtgttcttaaaggtcagaattatcaactatgtcaaatgctgtaagtgaggttagagaaaaatcatgtttggcaacatggaagacgttggtgatcttgaggagatgttttgtgaagttctaaagaatgaaagcctggtcatatgagtttaaaaaagaataaggggtgaagttgagacagcaaatatagacagttttttcagggagttgtgttatgaagtaacacagatgaatagagtgagactgacagggagaagagccaaaggaatttttttggtttggttttgttttttaatataggggatttttgaccatatctgtgttcactataaatttttaaattgatggtacaagaaaaaggaaatgattttaggagtaaagttcttaaaaaggcaagaggaaatagggcccaatgcacatgtggaaagataggccttaaataggagcttgaactattcacaaaataagttatagttataaattattattaataattaagaggagacctataagtaggtggacattataaattcctgttttgccacactaaaaattaaatactgtgccaaaaagtaatttttaataatcttgtttcccatagtggttcaggttctgca

SEQ ID NO: 9332 - DNA, 1030 bp, Homo sapiens
caagttacgtaacacttctgagtctcgatttcctagtctgttaacacagataaatcacatatatcacacataaattttatgaatattagaaaataatttggaaaatattccacatgtagttaaaaatcagttattatatctgcatttcattttctgtgtcatatggaaattgtatgtctgagccaattttaatatttcaagttatttatattttaaatttatatttttaaaaggcattttaaatagattttttgatatttcgtagaaaattttttgacttctcactgaattgttaattttaaatcacgtacagaagtctaaagccatatttgtcaaaattatttttaagtcttaagagagggtaaatttatctaagatctttgggccattcagagagaggattgtttcactgatagattaaaggaggtcaatgaattctcctaattttatgcaaaattgtgtgtacttgtgcacagtgtgtgtgtgtttacagagacacaatcaaacttttgaacagcttctcaatgagttccagtcacaaaaaaggcccagtacttcagccctaaaggagccacacataaattagatgaacaaacagctcttcattccctatcttcatcattttagaagcagaatagattttagccttgaaactaaccaggaattttttttaatgaaatccatctctactaccttcttccttaacatagaaaataatcagtgtgtctaagctggaaaaccccttggctttgtcctctgcctctcgcattgtcatcctataatttttatttattctcttactatccaaagtgttacatattctacatcagctctttctattttcatcaccatttacttttccctaccatcaccactcctggaacactgtgttcttgaaggtcatcagtgacttacaaattagtaaatccaattgttatttcttatgcctcgttttctcagaatagtttgcaggatttgacattgctgacaactccttgttctttgaaactcattcctcctcttgtaataa

SEQ ID NO: 9333 - DNA, 1089 bp, Homo sapiens
atgaaaatgagtttattccttcatggtttctggattgcctggctttaagcaagatattctggaaaacctaatctctcttaaaaactatgaaataatgcatctattcaactgaagtagtgtttgcataaagtaaactcttagtaaatgattattatatttattgctttaatataattgaataattaaattactaaatataattccttaatatttggtgatgtgttgttttaatcttttttgaagtatttataaaagaatagctaaatacacgttgtggttaacttaagtaaatcatacatactggctttctttctttttttcaactttttaacctgatcattgttgtgccttgcatgaaacattatttaattctctcctttgtttgcttttgcttctgagcatctcctttgccatttttttaatgcttgttttggtcacgtttaaattatgaagttcttaagtatcttcctaaattaactaccttttatctctgtggggttttgcagcacacggtctgtgcatactctcaagatcactcagtatcttcatttgttcttgtggaagtgtgaatgggaggcatgaagtggttcctacaatggatttcctaattatatgtttaaatctgttcaaaatcacaacataactacacatattcagagccagttaaaatacacattctgtggacaagataattcaactcagaaaaatttttaattaagaaaaacaattatgtaccctgtgttggattttgtatgcacctagcaaggaaaaaaatatagcaaattaccatttacgaagataccctatatttaatctcctctggatttaatgtttattagaggttattatataacttactatggtgataaacacagtaagagatgataactaaaaaagttactggatgcctagaaattaaaaggcccaaagggagatgaagatatcaaagacgggcctaatccatttcatttgagaaaatggttttgaaaaatagctcaaaaagaaatgaactcgtttcttttcagtgtttttagttatacaagttattcttataaaatttcaaaatattaaaagaaaactaatatctcc

SEQ ID NO: 9334 - DNA, 1046 bp, Homo sapiens
tggcttttgcagtgcagagctttgtgaggttgtaactagcagatactgggaagcacgattatttcttactttgaagcttagtccatctccattgaaaaaccatcaagttcctgctggcagcttctgggccacaagtttttaattagtgcttatccttataccttagctaactcccttatctaggaccaccttctgctggtcctggcaggatccaagaatcatttgatttcattttcccttagtgtctatacttacatcttttttttcttcaacgtcatagacagaaagattgagagagtgagaagaaatgcaatgccttcccccttcttgatgctgtaacttttctgccttattggaaagggagaattccttgatttccatggcaactctcactgcttctgcctttagcaagtttactcttacctttcccttatgtttaataatttccattatttccttaacccggctcaaattcacttgctcacacaagctactcatttttgttttctttaaggaattgatagtgtttggacaaacttaatatttgaacagtcttcaaggtgtatgtgtttaaatttgctgtgtatggcttaacattttaattagtaatcagtcacttatatcctagtagaaattagccaactctgataggggtgcagtactcttaaaaagagggggagagagggtctgaatggggctgttgacatagaaaagatattcctgaagcaaacattccaaatgaagaattaggaatgtgcataaagctttcttaacaatatgcttacatccgtgatgaagatgttcaaataacagaaatatgtaaatatctgaaataaaaagatatgtgcatgctctcagaactttttaagagaacattcacccacccatgctgggtagtcattttcctgccaaggatggagaatgatctatgtgaccttttccagagattttttttttaaattcacatttcagattctgctcacttttaataaaggcaaagttattaaggaatcataatcaacttcaagaataaatatttaaactcc

SEQ ID NO: 9335 - DNA, 1058 bp, Homo sapiens
gagactgtggcaataatctagatgagaagatggttgaactggcactaggagtggtgagaagtggttgaactcagaatatgttttgaaggtacagacaacaggattctgaatgtgacagaaaggaaggagccaaaaaccgtgctaagctttttgactctagcaaccagaaaacagaattgtcattactgaaatgagaacagaggaaagaatattggtgggaagtcaggtagtgctcaggttttaacatattaattttgaagtgcttatcattaaacctcctactgaacatatgaagtaggcagttagatatgttggtatggaattcagaggaaagttattagtattaagatggtatttaactcatccccagagagtgttagttcatagataatgagagaacaacaagagaaatccaagttctaaactctgccctatggcactctgatccttagagatggttgagatgaaaaggaaccaacaaagaaaccgagaacaagagtagctagagtagctagcaaggtagaaggagaactaggtgagtatgtttagatgccaagtatcaaatggttttaagggaagagtgatcagtgtggtcaaatgctaaggaatggccactggatttaacagcatggtgatcactggtgaccttctcaagagcagtttcattgaatagagtaaaaacctaatctgaaggtgtgcaagaaagagcaaaaagaaagaaactgaggatggcaggaatagaggactctttcaagtagtttcgatgtcaagaggatgggaatgagtcagttgctggagggaaaatgggattaagatgggagaaattacaacgggtatagggtgatgcaataatcaacaaagaagatgatgatgctggagacagaggagagactatctggaaatgttctttagtagataatagcagatggaacccagggtagacataaaggatttggccttaggattcactcatagtaactgaatattattatattactattttattactatttagttactgtgtggaatatttgcatgaacagatatagtggtaggaa

SEQ ID NO: 9336 - DNA, 1040 bp, Homo sapiens
tcccctgaaatttaaaataactgcttttctaaaagtctgctaactaataaaaataaaacattaataacaaagcaggaacagaaagatctacagctaaattcctaacatgacggcaagtgtagaatttaatgaattccaaggaaaaacaaatagcttcacacatatttaaatttttttattcaggtaaccaaataaaaatgcagttaggtcagttagtcatcatttctaagtttttatttatttttgaatatagtatgaattttatttgataattatttgttaatagtggttcattaattgtgacaaatatacctcactgaggtaagatgttaaaatagggaaaactgggtgcagggtatttaggaactctctgtactgtctttgcaattttatgtaaatctaaaattttaaaataaaaaaatttaaagttaacctatattttattctaactcactttctaatctgtttttattttcatagctacataatagttttacatatttatggggtacatgtgatactttgatacaagcatacaaagtgtaatgatcaaatctaggtaactgggatatccatcacctcaaacacttatcatttatttgtgttggcaatattccagatttacccttctagttattttaaaatatgtaataaattactgttaactagaatctccctattgtgctactaatatggtttggctctgtgtccccactcaaatctcatctcgaattgtaattctcacatgtcaaaggagggacttgtaatccccacgtgttgagggagggagatgattggatcatggaggcagtttcccctatgctgtcgcgtgatagtgagtgagttctcacaatatctgatggttttataagggctcttcccctttacttcactctcctctctcttggtgaagaaggccttgcttcccctttgccttctgtcatgattttacgtgtcctgaggcctcccaaaccatgcagaactgtgagtcaattaaacctctttcctttataaattacccagtctcaggtaatatcttt

SEQ ID NO: 9337 - DNA, 1050 bp, Homo sapiens
taaacttttagctcatggcatattttgttgactgattgtctgatataacctaattttgactttctctctcactgacttctttaatgaaaagtacaggatatatttgaatcacattatttattcttaatttatttatcctgaattttaagatgccaggcatacggactctccactgaagcagtcatacaaaagaaggaaattgtcacaacattgttagtgagctctttatgtgttagaatttgatgtttacatggacatttgttatatcaggaagatttgttgtactttgaattcttataaaatacttcatagaaatctcactcagggaaacaattggtgggagttctacagtgacttagctcttttggataacagagcattgaaatgacagcaccacttctctgttttgttgcttagtaaagtgaaaagcattgatttatatacttgcattcaatttattaagtatatttaaaatagttcatgaaagtgtccaaactaatagcttaagatacccaacttctgacaagtagcaaataactgaatgactatgtaatatgtgtaatatgttccagtattaacaccaatagaagcaaatgtaggtgagactattttaagaatttaaattttttgtcactttttaaaatttgaattgtttaaacagtgggtgttagaatatatttctattttgaaatatgactataagccctgttgctttcaaaataagcagctttgtatcttcacttagaatctcataaacttaaaatatttacagactcatggattcagaattcttaggcttcaactattttcagagagtaacagaaaagctacaaattctcacagatgtgagcccccatgtatctgaactttgaataaaaagctcagcttcctttcattagcttgtaatctctgtttctataagaagcactcttagtttgtaatccctatttctataagcagcactgtttttactcaagtgtcttctctactttgtgttgctcatcagcctaaacaaaattcaggccaaaagctctggtaggttaagcaaga

SEQ ID NO: 9338 - DNA, 1063 bp, Homo sapiens
gattgttgtgaggattcaatgagaatcctctgtctggctaaataaaatataatacagttatactttaaaagagtatgtaagctgaattgttgagaaagcttgaatgtcagaaaagttagaataatatcttggaggcaatcatgaatttgtgaagatttttgacaaggcattctaaaaagcagtgaagcaaagttattctgactctgggtagcagagaatggattgagaaagccagtggatctggtcttgggtgataaaggcttcaactaaagtgatgccagtttaatagaaatgaaaatataaatatgagagtcacttgtcataaaaacagttcttaatggataattggctagaggaaaggaagggaaatgaaaattcaaagatgagactgagtttttgtggttgggccttgttattttggtattcatttttacagtcctatttcttctgtgtaaaatctcctaattcattatactgaagcttctatatggtactgttcttgggacccaagattacatgtctcaaaagattagaacttaaatcaataagaactttgtatgtatgaaaaaaaagacattttaactttggaagaaaatcttaccatctagttaaatcaagtcatttcatatagatattggtaatgcttttcaaagaaaattatctactacccttccttcttgggtatttaggctgtatctgttcagttgacaagaccacctgcctttcaagttttttctcagctcaaggagtatttagcctgagagaactgaaattgccatcttacaatggcttccaaaacttaatcaggcatagaccctaccaagcctgacaaacttcccaggaaaaagaaaatttcccacagagagccatagaaggatgaatatatagtttagctatacagggaagagtcatgataggaaaccaaaggtatcctggtactgtaggaagaacactggaccagaaggcagaagacctgtgccccagctggactttgatggacaagtcacctaactttcattaggccccagggactgcatcctagggcctaataagaaggatgggc

SEQ ID NO: 9339 - DNA, 1031 bp, Homo sapiens
actgagtttttcctttgagtataattttgatgctcaaaaagctttgagttttatagcattttggatttcaggttttcagattagggatcctcaatctctagctaagaagtgatggaccagcatttgaacatttgactgcagggacatagaattaaaactccgaagggtacgcgaatgtgtgtgcttatgtataatttaaattgtatccatgtgtatattagtttcttcaggctgcttaacaaagtacctcaaacatggtgtcttaaagtgaccgaaagctcttctgtaagttctggaaggctggaagttaaggtgtcagcagggccatggtctctctgaaggttctaagaaagaatccttccttgcttcttcctagtttctgctcattcctagcagtccttggcttgcagttgcatcactccaatttttgccttcaccttcaaatgaccttttctgtctcctctctgtgtgtctgtctctccttgtaaggaaaccaggcattggattcagggctcactttaattaggtatgacctgatcttaacttgattacatctataaagactctatttccaaataaggtcacattctaaggttctgggtggacatgaatttcaggagacacccttcaacccagtagagtccattctctggccccctgcaaaatttatatccatctaacatacaaagtaaattcaccccatcccagcattagcaattctcagcccattccagcattaactctaaatctcatgtaagtgttaatatcatcaacccaaaaagtggcagatctcatctcaatcatctaaatcagctatgtgtgaaactggagtatgatccttcttggggcaaaattcctctcatctgtggacttgtgaaagcagaaaacaagtcttctaaaaatcagtggtaggagaggcataggatagacattcccattccaaaaagaagttcgaagtaaaaaggggtcattgttctcaaacatgttccaaacccagcagagtaaattcattaggtttcaaagcctgaaaa

SEQ ID NO: 9340 - DNA, 1087 bp, Homo sapiens
cattgcttaactcccttccacttccctcaaaaatgaccagcccattttcctaaaggctgaggtagttatatgtatatatttgtgtatacatattggtgaccttgttttggagagggattaatgtcgtaggccctgaggttctggatttttttccgtaggcctgaaatagttgctcaaggcattggatctaaatgattttgttgtatgttactactgtgtttaaaataaaacattagttgctgggtggtcttgattagttaatcattccagaatacaatatctaacactgctctccctaatgatcaagctataagatggaagatcaggtttttctaaatttgactgatgattctctgtgtatgtaatggtattattagaacttgccaacgtatgtgcagtaattgtgctgtcttcaaatagtttaagggacaaattcactgttcttcctaccgatttttctttattccagtttcctaggtaaactgcacttaatacttaacacaatatttgcccactgtatatccaccataatgccacagtgtggcgctgctgtgctttggccgaatatttacgaaatcaccttttcctattgctgtcaaattttttattttgtggactaaataagatgctctaaagtatatgaaaacgcactcgtatcggatattttttggctgtacataatgagttatgtgattgctttctagtgattgtgccagattgattgccttttatgttaatcagttttttaatagcatgcttatttaaatttttttccttgattgccccatcttatttagttaaaaatcagaaggcttcttggaggttataaaaataaaatttgaagaaagcagcaagcagaatgacactatagatgacaaaatgcgtatctttttaaatgcagattttttggacattaatctgttaaaactacagtttcactcaaaatatataatgcaggcttccaaaccaaaaatagtttattcctcccattattgttacatatgctgtttgtgccaaaatccattcaacaagaaacagtttttgatttttgtagatatagtgttcccaatgtttaaaatttccagat

SEQ ID NO: 9341 - DNA, 1067 bp, Homo sapiens
ggtaactgcttcaatatatattacattttaaagtccccttcccctttgtctcatatgtagaggaaagtagaaaattgcatattggttatgttttacctataaatttccaccatgatttttcatacgtgatagtatgtagtttactaaatgcttacataccaatgttgcaacttgattttttttttttaaccttgtactttattatacatactaacatcaccagtgaaggacagatagctgtcaagtacctctagatagggcacatcacctgtgtagtattctggttgagaatgcataacctaatccactcattaaatatcaaacaaaccccaaatgagcaatattttattaataaaaagcagatttagggaatttgtactttaaaacgttaatgtcataaaaaacaaaagaaaggctaacaagacatgacaactgaatgcaatacttgtccctacttgcccattactgggctcctgttctggaggagggatatgccacaaaggatgctattggattaattcacagaatttggaatacagctaataaagtattgtttcaatgttaaacttactgacgttattaactgctgtggttatgtaagagaatgtgcctactaggaaatacatgttgaagtatttaagagtaaagggccagcacatatgtaacttctaaagtagtttagcggaggtggggaaatatatatatgcacgcgtgtgagtgtacgtatatgtatatatatatagagagagagagaatgagatttagaaaatgtaaacaaagttacatctaggtttacatattttataatctatatttatttaccttttatctttcaggaaagcaaaatagatgagcaccattttgttgcagttgctcttaggaaacccgatggatctagacatcaggatgtaagattttaggatttctcttttttctaaatagcatgaatcaatgttaagtttgctctttattgatggaaatagtcatttgccttatatcagtttagagagatttttttaagattatagatatagtagtactctttattagcaaatattaagatcact

SEQ ID NO: 9342 - DNA, 1092 bp, Homo sapiens
gtacagacagacacatgataagccaaactgttcctgcaaacatagctatgcttcatgaggcttacaagaagtaactttaggtaggagctgtttttgtttgaagtactgcaaaattatattgtaacttcccctcaccccagttgcaattgtgtcatagtcatctgtatatcaaactattttattcccataacttcattggcttggatgcctaagtgtatgatgcttgaagcctcagaaaagaaataagcatatttcaaaagctgcaaaaggtttttcactgcctgcctcttgcggaactgggttacaccctggcactgttctgatccaagcatatttgcttggggaactaagtgctgactagtttgttttctatgtcaaggggcaatattaaaaaacaatttgcaagaaaatgtgtttcaagagagcaacctaagctaagtcactctgcgatatttcttgaaaataacgaccttgtcttgtatcagtggaagaagtaagttgcttagaaagggaaaagtcaaattgttccagaactgctaaaaatcattttaaaaaccatgatttagtttggaattatgattgtagtctgttgaatagtatttaccatggcatttcatacccatggtattttataccttctgactatcaattttagtattattagatgtttgtgtaaccacttgcttatttaaatgaattttgagtactgcctaattgtcagttatatgaataaattacatgtcattctactgtaacgtatattggatttcatattaatatttttgtgctcgtacagcttctgaatatgcaaatatgtgagtgaatggaatgtcaaagacagacaacctggagctgactataaatcacaccatcattcagagtcagcaggttcacaacttcctaggaaacctggcttggctgttgctagataaagcagaaacattaactacccattgttttcttggcctttctctcccttctgcgtttgtattatcctttccttctgcgtttgtattatcctttccctttcagccatgtaccaggtggcagcattttgcattgcctttcttatggtcctgtgtcccttcttag

SEQ ID NO: 9343 - DNA, 1024 bp, Homo sapiens
tcagtttcccttttttctcctatgcctataagaaagttcatatgtcgcgtcatataaacttttcttttttttggagatggagtttcgctcttgttgcccaggctggagtgcagtggtgtggatctccactcactgcaacctccgcctcccaggttcaagcaattctcctgcctcaacctcctgagtagctgggattacaggcacacgccaccacacccagcttatttttgtatttttagtagagacgggattttaccatattggccaggatggtctcaaactcctgacctcaagcgatccgcctacctcggccacccaaagtgttgggattacaggcgtgagccactgcactctgcctcctcatacaaacttgtactctgcctctgcctcaaacttctgtttctcactgtcacagttcttggaaaagcagcccccatttgctgcctttataattctttgccctttaacttaatgatatggcttactcttctctcccacccaattgtatagaacctgtcagtcataaaagtattagcaacctcctgattatcaaatgagattcttctctgataatatttatcctcttttctggtattattgctcatttcctctgcttctcttttggtttttatgacattccctccttggtcttctctctctcaaatcacgtttgtttttcactgacttccctcccctgtccccaatagaattatttctcaggattttatcttcagcccttttctatctttgtatatttttttctgggacagtcttaactcccatgatttcactatttttatctcttagctctgatctgagctctagatcaaaatgcagttctcaccatatcactttcctgttcagatacctttgatgattcaaattatttgagatctttccagctgggtcttctcctgataactagtattctctctctctgtctcttgtctctctctctcatacatgtgtgcgtacacactcctacttagctggttacttgttggctcactagcatgccagaggt

SEQ ID NO: 9344 - DNA, 1996 bp, Homo sapiens
aaaaacaaatcacatggtcacatttaacttgaaaaggagtactaatgactaacacatatggggtctctctctctctctctctctgtttttggcaatgtaattgatcattatttttcctaatattgcactacttttacattccagagataaactgtatgattatgaggtctgattgttttgatatgacacttgtttgatttgataatatttatttagatttttgcatctttgttctctggtaagattggcctggagtttccatttcttacgcttttctcagcagttcagtgtcagggttttttgttagcattataaaaggagatgagtatttttctgttttttttttctcctcagttttcagagtttacatagatttccaatatactttttgtgagtttaggacaactacaaaattagatgatacagtctccatataagactattctcacttctgacaccaactgtaagcttgggggattcccaaaaccactctcaggtttgataattcattagaaaggctcatagcatttagtgaaagctgttgtacccatagttatgatttgttatagggaaaggattcagataaaatcagccaaaggaagagactcatagggctaagtttaggagagttccaaatgcgagcttatcttgccctctccccatgtggtcaggacacatttctctcccggcatcaatgtatgacagtatgcacgagtaccatcaaatagggaagctcacccaacctttactgttgagttttgatggagcttattcacataggtgtgattgattacttgctcacagggatttcagtctccgtgttgagtgaccccctgtgaccccaaacccgtatctcaagttgtattgttcgtcttcccagttggtgagcctctacataggattatataggtgtggacagtcccctccctgaattgcattattagccaatccagtatgacccaaggcctcccaaagacatactttttagacgtaactttctaagtgtccagagattatctactagaagccaagaagaaagaccagactgtctccttggacaaggccaaattcttcactaaacacatttgtacaatttttctcttttatgattgtcttcctgtgattcctcaataacggattaagcctgtagggattccattatggaaaactggttcatttaaatttgagcccttcatttctctagctgtctcataaaaattacaggatactttttatttaactgcatttaaattaaactcccttttatctttttttttttcaagaataaaggttctcttcagtttgaagacaaatgggattttatgcgcccgattgttttgaagcttttacgccaggaatctgttacaaaacagcagtggtttgatctgttttcgtaagtaccccactaattctgtttgctagcataaaggaaattttagtgatgtctttccatacccaaatggaatgtgtaactctaagtttatctgtttacctattaaaaagtattactagttacattgagggtctccaagacctctcccaggtatgatgatttgctagggggctcacaggactgaacatacaatcatactcacagctttgagtcattacagtgaagggatccaaagcaaaatcagcaaagggaaaaggtacatggggtgaagtgcaggaaaaaacaagcacatgcttccaagaagagtcctttcccaggggagtcacacaggacacacttaatttttccagcaatgattgacagcgtgtgatatgttgtctaccagagaagcttattggagactcagtactcaggatttttatgggggctggtcacataggcagtctctctcaacatgtaccaaaatcagtgtaaaccatattgtttatataaacagtttaggtacagtgagccactgttatttcaggaaagtgtaggaaactgttgaccattcaagttctcagatgccagccaaaggctaatcttacaagcaggcatttctag

SEQ ID NO: 9345 - DNA, 1005 bp, Homo sapiens
aacttttttgtaaactatgtcagctttataagttctgagtttttgtatatcaatttatgatagcttttgtttttgtttttttgtttaaaggagaaacagtaattgatgtgtaaatgggtaatatatggggaagctaggagatatgctttattgtgatttaagtgactaatttttttaaaaagacaaaataggctggcccacaatcccaccattttgggaggctgaggcaggagaattgcttgaggatttgagttcaagcccagactgggcaacatagcaaaaccccatctctaccaaaaatttaaaaaactagacaggtgcatgcttgtagtcccagctactcaggaggctgaggcagggggatcccttgagcacaggagtttgagactgcagtgagctatggttgtggcactgcactccagcctgggtgacagagtatataacaaagctgggcatggtggctaacacttttaattccagcactttggagactgaggcaggaggatcccttgaaacaaggagttcaagaccagcctggacaacatagcaagactgtttctacaacaaaatttaaaaaaaaattaggcgtggtggcatgctcctatagtaccagctcttagaaggctgaggagggaggatcgcctcaacccaggaggtcaaggctgcagtgagccgtgattgtgccagtgcacactagcctgggcaacatagtgagaccctgtctctaaaaaataaaaataaaaaaatttttaaaaataattaaaaaggacaaaatagtatacatctattgtgttaaagaattaaaaggatttgtagttgtttttgcacaggaaaatattaatagcagttaactttgggcagtgacattgggagatggagacatgctttcataactaaattttatgtggtaagtagcagagaattaaagaggaaaacaatggctaaagaaaataaaaatagaaacaaatgtgtatgtgaggcaattacaagcgtacttggtttata

SEQ ID NO: 9346 - DNA, 1077 bp, Homo sapiens
tttgggattagaccacacgcagtcgacccttctttaccattatgctaaatatactgcttccccgaagtattcaagtgaatgcaacctaagttattttgagacagggtcttactctgtcacccaggctggagggcagtggcgtggtctcggctcactgggactacaggcgtgcaccaccacactgggctattttttttgtatttttttgtagagacaggattttgccctgctgcccaggctggtcttgaactcatagactccagcgatccacctgcctcggcctcccaaattgttgggactacaggcgtgagccactgcacctggcccaggcctacaaatttgatttccttttttggtgtttgtacatgatactttgtatattaataattgaaaattatgttacaatttgttcttgttttcctagcttatgcttgatacatggaatgagtcaatcttttcaaacataaaaaacagactccaagatagtgcaatgaagctggtacatgctgagagattgggagaagcttttgattctcagctggttattggagtaagagaatcctatggtatgttctgaacttttatgatcataatttctgtttcatggaaattgtagaacaattatggaatagcacaatcaaagttaagtttattggcatacaaagttacatctactttttgtactagatactttttttgagagtaagcaaatgataattctgcttaaaagaatgtataaaaattcatattaatgtggttaatattttcttcatgccattaatttcttggcaagtcgttttagtgaactaaattagatatataaatttgaatgtgtagctcataaaaggtaactagttcattaaaaggttaggtatttatgttttcaggaagtaagttacttccatgaaaaggagagcatgtaggagtacattctctcttacttctaatttgtttcctgtgacttagagtatgcttcttccccacgcttcatcctcctcctggaggcctttcttaattcccagagtaagttaacttctctcatttagtgcttcacagtacctgtgcctccttggcata

SEQ ID NO: 9347 - DNA, 1034 bp, Homo sapiens
aaaaaccagagtatcattatttcatacccctgatttttaagacccttcataatttgaccctaacctatttttctaacttaatattgtccagcaagagtcactctactccaataagaaatatttttttattcatacaactcactctgttacttttttttttggattcattttagcagtgttttcttctgcctacccaaaatcttgcaaggattcttttaactcaccttgtaataaaattgtaataaagtagctcagatcatctagccttcatcagtttcttcctatttgaattcccgtggtaactattgtttctaccactaggtttaggagcaaattatagactgccttgtatttcttatcaagcaccagctgtgtgccaggacacagcacagtctttatagctgtggacagagcacaatctttgtccttaagtttatagtatagtaatgatgcattttccagttatttgcttattagtgaagatcttcttttcatacacatctgtacatatgaaccatacacatgtttttaggtatatagtttatgggtttccaactggattgtaagatcattgagggcatgaaccatgtttatacttctctattccttaaaacacgtaactcagttctgagcatgtagccatcactaagtatgtacatgctctacttctgtagtaagaaaagttggaggctatggagatacatacctggcctcaaattataactcaagaccttatgaaccaactgtgcaacatttggaagttatgtggctactctcagtctatgtcctcataaagtaagtatctgcctcatgaggttgccatgtgggttaaatgagatctatatgtaaagcatttagcataatgcctggtacaaagtaagtgcccattaaaggatacctgttataataatttgtttaacctctcaagctagaaatggattcaacatccttttatttccctaatccctttcatttaagcatttaccaaattcttctcagtttactttaattatgttgtcaatttagctctcctt

SEQ ID NO: 9348 - DNA, 1035 bp, Homo sapiens
gcctgggtaacagagtgggactccatttcaaaaaaaaaagaatataccatcaattatataaaataaagtgatatctaataaatgttcttaatactttcagtaaagtatctttgttcttgagttgtttctactgtttcactcccatttgtacctcaactctcatttaaactgaccttattaataaatagactacaggggctgggcacggtggctcacacctataatcccagcactttgggaggccaaggcaggtggatcacaaggtcaggagatcgagaccatcctggctaacacagtgaaacccagtctctattaaaaatacaaaaaaattaacgaggcgtggtggtggggggcctgtagtcccagctacttgggaggctgaggcaggagaatggcatgaaccctggggggcggagcttgcagtgagctgaaatcgagccactgaactccagcctgggtgacagagcaagactccatctcaagaaaaataaaataaataaatagactgcaggacaaattattatatctttaaggtattttcagtactaaatgcttaactttagagatgtttataaatgataacaataaatacttctgtatagcaaaaagaacctttaaatgatggcctatttagggtaatcaatgctgattataactaaattcccatataaagtattttgagttctttttttgttttaattattaaagtaaatatctttaatttctgtgtatgtatataactctctccacatatatatggagagagagagagtgcgagcaagcacacacgagagagacctacagatattttaacttatagctagcccttcgcatggaactttaggatagtaaaaattactgtgctaactgaaactgcttagtaggaaaaagaatgattattctgtgactttttaaaactattgtcaaaagactcaaaactcttactgtcacttataagtatataggaaaaaggggaaaatagcaaaactaatacatatttactacgagaaacctttagaattaaattttctttct

SEQ ID NO: 9349 - DNA, 1028 bp, Homo sapiens
aagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggac

SEQ ID NO: 9350 - DNA, 1029 bp, Homo sapiens
aaaaaaaattgtgaagctactttgtaagtttctctttttaagatggtaacataatagaggttatagttaacagattctagatgagtgtttacttgggatggtttaagtgaagcagggatacaaagggaggcacagactactaggcatcttgtacaacagttgcttgctgaatgactacttgttttgagcgattttacttaaaatatttttattttaggtcaaccagatgtagtggtgaaagaagatgaagaatataaacgtgttgattttagcaaagttccaaagctgaagacagttttccagaaagaaaatggttagtgttaagaaatgaagcataagaaaaaattgagccagtataccatatctagttcttagaattgcctaaggattttgaaaaattctagaaaacatctagatgttatttaacattttcagtatatcaggctcatgtaaaattgttttggtagtttataccttcaatatataaatcccagggaagatatgtataacatgactatagaattcagtttttcatatgtagcagtctatgatagggtcttcattggcattgaaaaaaacagatttattgatataatttatataccataataacattcttctatttaaagtggtttggtagtttttaacattcatttatatttatctccaggtgattctagataagaataaatatctgatttgaaaaatatgtagtgagtacctgctatatattgaataaggaaagttagaccctggagacaaaaatattaactggtccctatgtttcaagagttgtagacgagcatttatccagtgccatcatgcatgtttgtgatgtttgagaaaactgttttatgtacacaaaaaggcattcttacattgtcttgcagttagctgtgtacatgtttcctgagggcaggaattgtctccacccatatttgtaatttctttaaacatttagcagcccaggcaataggtatttgttgaattgaaccaaatacatttattgtgaaggaatgttttgacttc

SEQ ID NO: 9351 - DNA, 1031 bp, Homo sapiens
tcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgt

SEQ ID NO: 9352 - DNA, 1073 bp, Homo sapiens
ttagtagagacgagggttttgccatgttggccaggctggtctcaaactcctggcctcaagtgatctgcctgcctctgccttccaatatgctgggattataggtgtgagccaccacactcacacacccagcctactgttcatttcttttctttttttttttttgagacagagttttgctcttgttgctcaggctagagtgcaatggcgccatcttggctcactgcaacctccgcctcccgggctcaagcgattctcccgcctcagcttcccaagtaactgggattacaggcatgccccaccatgcccagctaattttgtatttttagtagagacggggtttcaccacattggtcaggcttgtctcgaactcctgacctcaagtgatccacctgccttgtcatcccaaactgctgggtttataggcgtgagccactgtgcccaccctgttcatttctttatgttagcatttgtctgcttttgtacaaagcttaaatagagtctagatagtgcaaaactcagctgcgaaaaatgttaagttccataagattcctgaaagtctctgtaagtaggctgggcacagtggctcatgcctctctaatcctagtactttgtgaggccaaggcaggcagattgcttgagcacaggattttgagaccagcctgggtaacatggtgagacctcatctctacaaaaacacaaaaattagccaggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagt

SEQ ID NO: 9353 - DNA, 1031 bp, Homo sapiens
aggaaacactatgaacatctattaatttaaatgggccagttcctcaaaaccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagta

SEQ ID NO: 9354 - DNA, 1049 bp, Homo sapiens
gacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccacgcccagctaatttttgtttttttagtagagactgggtttcaccatattggccagcctagtctcagactcctgaccttgtgatcctcctgcatcggcctcccatagtgctgggattacaggcgtgagccaccgtgcccagcccagaacttttttatcatcccaaaagaaacctcatccc

SEQ ID NO: 9355 - DNA, 1027 bp, Homo sapiens
atgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgagga

SEQ ID NO: 9356 - DNA, 1035 bp, Homo sapiens
atatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatcaatacctagcatagtagtgcctgcctttagtttctcaataaataatacatttaaaaattgggaacgaatcatccaggctcacagctatatctgcgcaacattgtaccaaaatttaaaataa

SEQ ID NO: 9357 - DNA, 1050 bp, Homo sapiens
attgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtgtggtgatagtgaatagtatatatgtatatgaaagcttatctgctcttttttttttttttttttttttgagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgtgaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagccg

SEQ ID NO: 9358 - DNA, 1031 bp, Homo sapiens
cacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctat

SEQ ID NO: 9359 - DNA, 1050 bp, Homo sapiens
ggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttg

SEQ ID NO: 9360 - DNA, 1030 bp, Homo sapiens
gatatattttataaatacattataactgacaggtactcagtgtcttttgttatgtagcagacataagaatgaagacttggagggctagattaaacttaaataattaaaaaccattcaagtcctttcctacagccatttgaggggaaacctaatgtaaaataagaagccaacatcatctctagtttaggtgtttagatttagtgaccacgggatggagaaatcacctggttaaagtcagcttgaagctctcgtgatggtttttgtttctaattagaaaaataggaataagtagtgtttcacagattctactatctttcttcaacagccttaacttctcattaggagcctaatatctacagtacttccttttttgtagattttaaaaaattgagatatatcctaatatagaaaagtatacagatcaaaaatatctagcttgaagaatgtttgcagagtacgcttgtacatgtagcacccagactaaaaaacagaatcttaccagaactgtagaagttttctttaaccaacatacttacctccttgtccatagtggcactgcttttatggacagacctgatttacaacagaagccctaagtggctttcctgtgtagcataaaattaatgtggtttgttctcacagctttccccctaagatcaggaatgagacaaggctgtccactttcactactgctgttcaacagtgtactggaagttctagccagagcaattaaacaagaaaaagaaattaaaagcatgccaattagaaaggaagtaaaactatctgtatttacagacgacatgatcttatgtatggaaaatcccagagaatccacaagaaagctactgtagtgctaataaatgaatttagcaaagttgcagggtacaagatcaacacataattagtggtgtttgtatatactagcagtgcacaatccagaaagaattagaaaagcaattccatttacgatagcatctaaaagaaataaatagccaggaataaatttaatcaaagaggtgaaaaacttata

SEQ ID NO: 9361 - DNA, 1032 bp, Homo sapiens
aaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacatac

SEQ ID NO: 9362 - DNA, 1035 bp, Homo sapiens
attaaaggcagaagtttaaggaagatcctgagtctcgtaataactaaaaggtgtaggtgtcaattgaaaatcattaggcatacctggaaccaggaaaatctcaactttaatgaaaaatggccacctgtaggtgccaacactgagatgacaatgatgttggaattatctaagattttaaagcagccatcataaaaacactgaaggaacaattacaaacatgcttgaaacaaattaaaatatagtaagtctcagcacagaaataagtagtctcagtatagaagtagatataaaggagaaccagatggaaattttagaacagaaaaatatagtaaataaaataaaaaatttcaactgcagaatgaggagacagaagaaattatcagtgaatagaagacagagccgtagaaattacccaagctgagcaacagaggaagaaaattaagaggaaaccttcagcatctagggctaaacagagttcctagacttgataccaaaagaacaatctttaagaactctcaaaacttaacaacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcat

SEQ ID NO: 9363 - DNA, 1617 bp, Homo sapiens
ggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctat

SEQ ID NO: 9364 - DNA, 1033 bp, Homo sapiens
ctgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagta

SEQ ID NO: 9365 - DNA, 1034 bp, Homo sapiens
aacagattttaacccccatattagagaaaataaaataatgctgaactcttttcagtctagtaatccatagtatccatttatgggtacaaaaagagaaccagaacaattagctctatatagtcccacacattgagatatatttacaatgtttttatttatgtctaacagttttttaaatcaaatcccaacatatttcttggtttgatcagttctgtattactaattattttaataattgctgagtctgagaggaaagttcagtcagcctatggccacaggaaattaaaataagttttttcttttgtagaaaatgagttatgataacatcaataaaaggctttcaagcttcaaacttaagatgcaattctgtgacgttaggaaatagaaatgtgaattaaaggagggaaggaaattaaattgcttgtgattaaataagagtttctttactttttttacttggttggaattgggtatcacattgctctgctgttgagactctgtgggatacgttgataagagaaaagctttattgctgccatctgccataagcaaacttattcttctgttgatgccccaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctgggtaagaaaacttcctatcatgaaatttctgtgattgtgtgaaatgtaatttgcttataaagtatattttgggaaatctgatagactcaaacacttgggtttcttttcttattttgtaagagaaaagtaagtagtaaattggtagcagttgactaacattaaggatgtatcagtgaaaatttccacagtatttgcatcttttttactatttcatgataatcacaccatagaatcctgaggaacctacaaaatcaaagggggttaaaagtttaaagatatgaaaacaattcccatt

SEQ ID NO: 9366 - DNA, 1047 bp, Homo sapiens
ggcaggagaatcacgtgaacccgggaggcggaggttgcagtgagccgagatcgcaccactgcattccagcctgggcgacagagtgatgctctgtctcaaaaacaacaaaacaaaacaaataaaaaaaaaccatagtaaagtcagtcatttggaattaagtggcatagaaaggtatatgaatgaatcaaaaaggattacacaatctgtcattgctgttaagctgtagcagcaaagctgggaggtatacattcttggtggaattgtaaatggttaacatttttctggatagcatatggtaatacttattaacaaccttacagttcttgtttttgtcttagtaattccacatccagaaatggatcttaagaaaatagagagctgaataaagtttcaatgtacatttgtcttgctgatgtttgtagtgtttaagaattggaatttattatgatctttagattatgattatggttagccacagatggactatttattcagttttacatttttgctctgttttctttctcatcaaaactggatgattgggtatttatcatatggattccaggattggtctaactggaccaatggttgcttccaatttcatgccacaaactcttctcaaaactttcccagggatgtgaggatctttaggcccgagcacagactgtcctgtttggcaggcttgctttaccacctgccctgtgtccacttcagcaagtggccccaagtatgaaagtgtacgctatcccttgcttacctaggaagtccccttggcgtttagttcttttagatttctatacatttatattttttgggtagctttgaagaaaatttttttgtttttgtttttatgtggtcactttttgtttcagctgaagtgaaggtttttatgtctttttatagcctagcaagaaatagatcttcttaaaattctatttaattttcataagatgtttgaatgtatgagtgtttaagtgttttttttttttgttttttttgattgattcatgtttatcctgtgggccatctttaaacgtggtttataat

SEQ ID NO: 9367 - DNA, 1028 bp, Homo sapiens
ctttgatgcagggagcagcctctgcttgtgacagtgcagctcgactgagcaaatatccttttctcagagtgaaaaaaacaaaacaaggaagaacaaaagaaattgttgcaggcctttttttttttcctccattaaacatatgatgcctgactggattttctactttgtacttaataactcacttgttaatactatacatcaggccaggcatagtggcccacacctgtaatccctctgaggtgggaggaccacttgagcccagaagtccagggctacagcaagccacgacactccagcctgagcaacagagagagaccctgtctctaaaacaaacaacacaatgcacgtcgttaatgtacaccagagaggagatttggtctgcaaattctttaatgatatctcttgtgaccattagaataccttcccaactactagtaagctgatgaatcattttgaacatctggaaacattcttctaaagtttgtttttttcccttgtcaatcacagttttgtctgatcgtggattctggatccattagttctaatggatcaattcaagtgggcatgaagttccactttggcaattcagagtaaaagcttaccttccatggctgatgctcttctgcctccattataattttaccaggaaaacaatagtccctctccactcttattcttggtatgaacaataggatgtatttcagtcagtaaattctgtggttctgaatttccttcagattgctttacttctaaacatttcgaaaagattagctgtatgtgtagctctgggttcagcttcacctcttagagatttctcaaccactaggacctagacaggttttcccttatgactgaaagtctcgtagaaaagtgacaactcgggctcccctaacacacatctcagtggtagggagctgtcttcctgggaaaacataatccagggctatcaaacaaaaggaaaatattgtcttactgatcagtgtgttttcagggcctggtacaatgactagtgcaaatttcacaaatat

SEQ ID NO: 9368 - DNA, 1022 bp, Homo sapiens
gtgcacaaacagtagagttgaatttcgtggttctccagttgaaatagaaaggctaattgccgtttcttttttttttttttgagacggagtctcgctgtgtcacccaggctggagtgcagtggccgatcttggctcactgaaacctctgcctcccaggctcaagtgattatcctgcctcagcctcccgagtagctgagattacaggcacgtgccaccacacccagctaatttttgtatttttagtagagacggggtttcaccatgttggccaggctggtctcaaactcctgacctcaggtcatccacctgcctcagcctctcaaagtgctaggattacaggtgtcagccaccatgcccagcccttttttgaactacctcacctagtcttaacttcacctgttacctactttcgaattttaaaaattaatacttattttcactcgtgttaatatcttttgattcttctccatgtttttaagcaattggttttgaatgtgaccctgcaaccgtgatctcaattgggtttcttttttttttttttgagacagagtctctctctgtcacccagattggagtgcaatggtgtcatcatggctcgctgcagcctcgaccttatgggctgaagtgatcttgaattgctggactcaaaccatcctcctgcctcagcctcccaaagttctgggattataggtataaatcactgcacccatcctggctttccattttatcctttacttttgcatttcatattttagtgttgtatgcatccatcagtcactggaggctgcttttttcctttattacctatttttaaggatagacgagatatagaaaaatcaaatcatacataaaatgggaataatactatcatttgcacatataaatgagtatattccctgtgggaagactaagcacttttccagacactgctgactttgttgaaatttttgttgctcatgttttagaattgtctttgtagacaccataccagacacagaagggaactggctttgttacttata

SEQ ID NO: 9369 - DNA, 1064 bp, Homo sapiens
ctggtctaacagccagattgccacatgccatgtggtagtaatttattgtggaataatcacagtggtatttatttgaggtggtttgtatttgtcatattcatattacatatactttgaaagttggatttttccaataccaaaccataaacgtagcctaatatttttgccattgtgaacaccttagattttaacaccttaggagataaaggaatataaagtgatttgattttatattcctcggagattaaattcctaggagatttgatgctagatttcgagccactgctatacagtgaatgtcatttgagcttcatttttctcctttggagcctgacatgtaatatgtgctaaataaatatttgctgaattgaattctgctagccaagctataatgttggaaaatgtaccactctttgtcataaattggaaatgtgctttgtatatatgaccagtgactattaggagtctttatttcagaagggagaactctataatgcataaaatttctgcaaaccaaatgtgtgtttaattgttttctacagatgaactaacagcaagactgagtgctcattaaaaatttatgtcttaatcctaaggcacaaaccttacataattacttgaatgcttatccttggttggataaaaactacttaaaaataaccactgttttgtgatttcacatttgcttagttttagattaaaataaataacagtccttttaaaataaagattgtttataaacatacagacaaatctacagaatgcagtcatccattccaatgtagataaatgtttaccaaaggaagcaacagcatggtacatattatgtacgtatgttgcttacaaggattaatgaaacaaaaaattttgataagcattaaagatactctcaaatggccgttctccctctgtccatcgtgttttcatgggttacacattttatatatcatgaatggaaaagattctctgttcacgaattcctggttcagaacaaaataggaaactaaagtaagcatttacgacatacagttcttgtggtgtatttttgtttgataattgaaaag

SEQ ID NO: 9370 - DNA, 1045 bp, Homo sapiens
gggtgtttgacaaatgcttatattatttatttttagaatctataccatctcagtctataagagatctgaagtagctcacaggaaatacataccaaatagtgaaataaacttagcagtaaaacttctggctttggtaaaacattaggacaggaggatctgtatcatggagaaaatggaataatacagggattgtattagttttctgtgtttgctgtaatacattgctatacacttagtggcttaaagcaacacaaagttatcttagagttctgtaggttagtagtcttaaatgaatctcactggagtaaaagcaacgggtcaataatgctgtttccctttctgggaggctctagaggtgttaccctttccttgtctttttccagaaaccacccacattggcctctttctgtatcttcaaagccaacaacagtgggtcaagtgccaaattcttgcatcacatcactctgatctccccttctgcctcctgtttccacttttaaggatccttttgacttttgattacattggactcatctggatgatccaggacagtctccttactttaaagttagctgattaactgccttaattcgtttttgccatgtaactatattcacaggatgccaggattagcatgtggacattttttggggtcgtttttctggctaccacagtaactgatgataaagctccattcagttgctctagttaagtcataattgtgcctctaagctgcctttatggtggccgaaaggaaaatgggaagtagtccttgttagcttttgtatctatgctaatgaaaataccacctatagtagtgctattatagtacaatccatatgatcacttcaattgttctgggttctgcactagtagaggttggcactagtatggctaataaaataaattggaaatggataatttaataattaacccatttatctcagatgctatttaaattatttttaattatttgattataacaacataaaactttgcttaagtttcttttacttatagctgtcatatacctatatgaccaaaa

SEQ ID NO: 9371 - DNA, 1050 bp, Homo sapiens
acttttaatttctattgtgatctaatagctgacaggaggaggttgaactagatctcttaactcccttccttgctctaaaattctgatgccttggggtatttttattctttatggtttgatatgattcccttgttattgaatgcagtgctcaaatacagcattgacaaaacaggcatctactagtgaggcagaaatagataagcggcccctatgtaggtaacatatttgaggaaattggcagttattcctcttggagttactttcccacttaggaccagtgtactgtcaggtaaatggtgtggctcatttatgtttggcttatgaaaacaaagcacacaccagggactacaggataataaataaatccttttccattgttgatatcactgaaatgatggtaattgggcattatcagtacagatcagcaacccaggtttaaaaactaggcaatagagaccaaaaaacctaagaaggagttcctgaaagcagaacataagttactagtcaactagaaattatcttctagatgaagggggaacttgatattgaaggtcctatgagacagaggttctccaaacatcttaattgtgtaggcaaggtggatcacattggggctaagtaaatgatcctgattaaagttaggggaatgcaaaagttaagtctagatcatggtctcaaagttttttcatttatgtaaaaattatatacatttttaccctcacatttataatatttttcttccacatccccatggagagtgcttgtctgtttggctgacagtgaatactcctttccttctttcctttctcggacaataatattgttttaagcatttcttaaaatgttgcccataggctgtgctggctttccttcgctgtatgtagaactctttgattccctttagtcagagtgtctttgaatttccctattatgcctcaaagaaattgcagccacaaagtgatggtagaacatatagatcctcttctcttgtaacttgttgctactccctgttctcattgatccttgagcaggcttcactacagtgcatac

SEQ ID NO: 9372 - DNA, 1058 bp, Homo sapiens
agacacatgaaaaaatgctcatcatcactggccatcagagaaatgcaaatcaaaaccacaatgggataccatctcacaccagttagaatggcaatcattaaaaagtcaggaaacaacaggtgctggagagaatgtggagaaataggaacccttttacactgttggtgggactgtaaactagttcaaccattgtggaagacagtgtggtgattcctcagggatctagaactagaaataccatttgacccagccatcccactactgggcatatacccaaaggattataaatcatgctgctataaagacacatgcacacgtatgtttattgcagcactattcacaatagcaaagacttggacccaacccaaatgtctatcaatgataaactggattaagaaaatgtggcacatataccctatggaatactatgcagccataaaaaaggatgagttcatgtcctttgcagggacatggatgaagccggaaaccataattctgagcagatatcacgaggacagaaaaccaaacaccacatgttctcactcataggtgggaattgaacaatgagaacacatggacacagggtggggaacatcacacactggggcctgccgggggtggtgggagggggaaggatagcattaggagatatacctaatgtaaatgcagcacaccaacgtggcacatgtatacatatgtaacaaacctgcacgttgtgcacatgtaccctagaacttaaagtaaaataaaaaaataaaaaataataaaaataaataaaattatttacatgggcttcatgttagttgcataacatttcattgttttggagtaccattttcctaatcttagctgttgggttgtttctgaatttcgctgcaaaaaagttgcagagagatccttgagagtctgttttttggctctgttgttttatttacttggaggtaaactggagcaaaattcctgggttaaagggattagaggaaataacaaaacctttggagtgagatgagttagtattttaccttccgttatgctacttaactgtccgtgagactgtg

SEQ ID NO: 9373 - DNA, 1047 bp, Homo sapiens
aaactcttgtgttctagttgattgtatacttctgttttatcctttcatcttccagcaaacatatgcttttggggacagatttattatttttcttccactgagtcttgaattaaattgtactcagtaatggtggatgaaggtcttggaaactgccataagttgatttattcttatgtctatcacaaatagaattcgatagctaaaatgacatagaaagatttttattatctgggatgacagacttgcctttttaatctaaaaactgtctttataatgttgtataaatatttgaactttattcacattcttaatatacttgaaattaattctggtctcatttcctttggtatgtaaagagagaatagcctttttaatgcatgctattgtttgaatgtgtcctccaaagttattgtgttggaaacttgatccctgatgtggagggaggggttggaggtgggacctttaagaggtgtttcagcgatgggggcactgccgtcatgaatggattaatgctactgttgtgtgagtgggtttcctaaaaaaggacaagtttggcctcttcttgctctctgtttcgtatgtgtgatgcctttcacggtgttataatgcagcaagaaggccctcatcagatgttggcaccttgatcttgtacttcccagtctctggaagtgtgaggaaataaacttctgttgttgttgttgttcttattcttctccctcttctaattttttttttttttagacaagatcttgctctgtcgccaggctggagtgcagtggcacgatcttggctcactgcagcctctgcctcctgggttgaagcaattctcctgcctcagcctcctgagtagctgagactacaggtgcatgccagcatgcccagctaatttttgtatttttagtagagacgaggtttcaccatgttggccaggatggtcttcatctcttgacctcatgatccgtctgcctcggcctcccaaagtgttgggattacaggcgtgagccaccgcgcccagcctaaacttttgttctttatacattagtctgt

SEQ ID NO: 9374 - DNA, 1030 bp, Homo sapiens
ttttgcatcttgttagtatctgtttaagaaattctcaaagtttaccattgttggtgtaattattctattttcctaacttaacgttgatggtttggggttctgttggtgggaaaagtggcttggcagtatggtgcaatgtttttgcaacacttgagaggagattgttttcatagagtttttgctcttccttgttccttcccttcttgtgactttgttttcaaattgcctttttttcatcactgtaactgtcttagctctgtacagctgcccttttccatgtctgttttgttatatacatgctatcttttggcccagagttatcactgaagcttgtcacagaactcttattacctttcctgttttttctccccagctttattttacctctacttgtaattactattgtctttttcctagagtaacagaagaaaatgcaatttgtctttactttcagtaccagcatagccctcttgagggtaatattagaacttgaagaaaacatttagattagcattttgaccaatataaattgcctatttcatttggaaatgacacattttttcgaaaaagtaaaaacagttttccgttgatataattatttttaaaatatacaagaaaaacaggaataggtgtcccagtacaacatgttttatttagtgaattttctgtcaaagggtttgttcaagtagaaaccatatgcctatttctttttttctttttttttgagacggagtctttctctgtcacccaggctggagtgcaatggtgcaatctcagctcactataacctccgcctcccaggttcaagcgattctcctgcctcagcctcccaagtagctgggattacaggtgcctgccaccacgcccagctgatctttgtatttttagtagagacgaggtttcaccatgttggtcaggctggtctcgaactcctgacctcaggtgatccacccgcctcggcctcccaaagtgctggagattacaggcatgagccaccgcgcccagccccatacgcctatttctgagggag

SEQ ID NO: 9375 - DNA, 1028 bp, Homo sapiens
atagaagagattgatgactaattgtattcaaagtcaattttacataattaattttccattaagtcgttatttgcattgaatatcctttaagatcattgtgttctatcttcctgtctataaaacaagcattttctttactatgtttggctatttcagagaaaagcaaattgatacaagcataaaatacttaagaaaacagccctcattcccttgaaattagcacttatgtaagtttgtgtaggggggtggaaggatgcgggtgtagtttataaaaagtattttaagttccacaaaatcagggatactttgagataatattctccccaggtttagacagctttggtttgcaaaacaaacttgttttaacagcaaaaataggagtccattttggttcagtgtgctagcttctcaactgacttttattatttctggcactagtatcatttgtttcttttagaagagtttgtaagtgaattgtggcacccagtgggatgtgtgtttgtgtttgaatttgtgaaaatatttgataatatttctctatagcagtgttttttggtgcagatacaaatatgttttcttaaaaatatggatgctaatttccgttccccccccctcccatttccctttctctcacggtcattctctttcccttccattctttcactttcccactcctcccacctcttctgctctcatcttataaagacttctgaaaactaggaattaccctcgttaaatatgggctgtgttgtgacttgagatcaggagccactgctcaggaggaggcctggaataaaatctgtgagtgtttatagaataaacatcatgggcataattcatatttaaatcatcctgagtgctcacacaattgtgtatgactgtcacatgaatcagtgcaagatcagcaaattttgcattgtcatcttgtgttagggtaatatggtatttaaatttggactaagtggcccttttattagagtaaaaaattgagtcatggtatattgtttttccaggtgggtagacaagga

SEQ ID NO: 9376 - DNA, 1047 bp, Homo sapiens
ttaaaaaaaaaaaaaaggcctctaccctgcataggggtaggttcagaaacccgtggagagctcctcattcattaaactacttttttcaacgtaatatgatcttaccctacaatcctgccagaaatttacttgtttattacactgagttctattccacagagaattgggggagcatgtgagaacatttataataaaataatgggtaaatatatttagaaatgagggaggaaccgtggaaatactgacataaagagctgaaggttgagactaaggaagaaatcccacctgtacatgccatgcctgtagcagctgaggttaaggtttagctctgaactgctagatgtgacctgattttctgcttcccctcccagcaggcttctgctctagtgcatgcagcctttctccctgctctccctctgtgttcgagaccatttttgtgtgtgtctactgactatctttccatctaccacttagtttttaaattttgtctcaaatccacgtcctgcctcttatgaagcccttgtggaactcctttgaccgctatagcagttacactgactgtgcagcaatgtggggtcttcattaagcattttggtgacaggaattatgttttaggccagcattctcaaaaagattttaagcattttgaggaatttttacatttttaaaaaactaatcttttggtttttccttcattctcatcatcctgcagtggttcctgtgctcccaactttcttccagacccttgaaagatcatgtttcactctcctcctgagcccttcacaggcgctgtgcagggctgaggttataacctagccaatgaaatcatgattggctggcagataattaagtctgtctatccagttgactcttacatgtgcagaaagcatttatgaatgaacaacacattctttcaataattagaactttccatcgtggaccttctcaaattatatatgactctgtggataacttagccaatatgcaaagaaaaagaagacttctcaaaaaagtgttccaattctgcactttcttgcctcaaagtat

SEQ ID NO: 9377 - DNA, 1031 bp, Homo sapiens
ctcgggcaacgccgtccccgccgggatttcgggcgaggtgaggccgggcttcccggccccgcggcctaaggcaccggtccccgcccgcccgggggcatagatcgcgaacatggaggcgggctcgggcgccgcggatggaaacggacacactgcgctgccccagcggctcagactcgcgcgcgctcgtggggcgagacatctcttggcatctcggatccagccctggccattcgcttaactatccatccctccatccagatcgccagcaaccccaggccgagcgtcacgaaagcccctcactcccccctcgtccctccttcacccccaggctccagtccagatcccttttacacgctgcgttcattttagctcggctgttcacatttttaactccgtattaagaagtgttacaaatataacttggagaaatgaatcccgcatttcttccctaagctgtctcatttcaagtccttaaaaacagccctaacatccaagtactgattactctgtctggggttcttgccatttggttatccgttaacaatctcggtttgtgttcggtgttttgtgataaagagatgaaagacgaatccagatttaggaaaagttttcctattggttgacaagactgtattggagtatcccaggcccatcaggcgcttattgattcagactttttttaaaccattttagaatagatgcagagataattggagctaagtattgtatgtttaggaatttggcaacgttgttcagtttttcacttgttacgtgcttgagtttttccacttttaaaatgcatattataaacggaaaacgagataaacctcaaacacaatttttgacttttcaagaaccacaagaagtcataaatacagtgtgttataaatgtttttgtcttaatggacttaggatttagagggtatgacttccattcatttaatcacatgtacaattaattttagtagcagtttcttaagtttagggttctctgtgtttgactacatgatagcttcatcaaacattggtaa

SEQ ID NO: 9378 - DNA, 1032 bp, Homo sapiens
tgtgattctcctcatcatatgctatattttatacttggtagtggctgatataaaagaaagttatttgtttttatgtaatcatctggctaccttactgaataaccctttaatgtactgttagatcaattgcaggacctagttccaacacttttcagttgagtctcgtgattttcaggttctataataatgacccaatactatcagggttttttcagtatttcaattcataccttttttcttcttgtcttattgcattggctgaaatcagagaacagtgctggttagtagtaggcattcagccttttcttttccaattttaataggacttcttgttttctaacacaggtatctcctgcttatatacacatgttctgaaaatacctgtaatggtcaaatgtgataaacttaaaaatagacttacatgccctagagggattcccttaaattattaaatccctaagtatcttttgtgaaacatcttcaacaatatattttcagtatttaagacgtggtctgtttttgaattgaacatattgttaatcagtttaaatccaggaaggctgaaattttaatgattctatccttgtgtcagtggtataaattttgagacctatttttatcactgttgttcgttttttatgtcatatctataaaatatgagtaaaggtaaatgatacagtgtgtacaaaaccatttattcaaatgaagtcttttttttgtttgtttttttctgagacaggatctcactctgtcactcaggctggagtacaatggcatgatctcagctcacggaagctctgtctcccaaatagctgggaccacaggcacacaccactatacccagctaatttttcctttttttttgtttttttttaagacggagttttgctcttgttgcctaggctggagtgcaatggtgcaatcttggctcactgcaacctccacctcccgggtttaagcaaatctcctgcctcagcctcctgagtagctgggattacaggcgcccgccaccatacctggctaatttttgta

SEQ ID NO: 9379 - DNA, 1026 bp, Homo sapiens
ccaggaacatactaggactgctgtccttataatatccattgtatttacatcccctcctcaaaaatccttcacatatgtagatgtttaattaccttagtcatgtaagcatcggaacaccttcactgatcttccttttggaacatatacatatatttttgagacagggtctggctttgttgcccaggatggagtgccgtggcactatcttggctcactgcagccttgacttcccgggctcaagcaatcttcccacctcagcctctcaaataactggaattacagatgtgcaccatcacacctggctaattttttgtagagatgggattttgccttgttgcccaggctggtctggaactcctgggctcaagcagtcttcctgcctccgcctcccaaagtgctgggattataggtgtgagccaccacacccgatcccttttggaattttgatttttggtggaagagataatggaaggagcaactaggaataaagtatttagattgccaaatggcagcactaagcgctgagaagggttaaagaaggactagaaaaggaggtagaagagccacagaagttaacctcctgcttccttctgataactgtcagttgcctgccagaggcccttttccttgcctttcactctccactcccagtcagtcctggctcactgggtgttgtagaggccaagaaggactgcagagttgagagtggttggttttggcagagaattatgggatggaaagccaatggttgcctgactgaaccaagtctgttgtttttccccatttcactgctattccttcttttttctgtaagttattctttctgttgttctaattgattcattaattcattcatacacagatgtgcatgcatatacccgtcatctctcctgccccactgaatccagtctcctggtttaaagttcttatcgcccccccctaccaaaaaaaaagatttaaaaaaaagtcttcttttgaaaccgttcctatccctccctgccatccccaaaataatccttctatatc

SEQ ID NO: 9380 - DNA, 1046 bp, Homo sapiens
agagacaagtttcagaataccagtaagccagatctctggaaatagtagtccctttataggaacaagtggtccagtctagcctagcttcctttggcactggccagttggtttgccattgagagcaagttctgaatggaataccataccacttttaaatcaacaaaatagtggtggctaattggtggcaaagcaaataggtttaaagaaagtgacaagccattcttatgattattgatgtaaaaattcttagtgaaatatcagcatatgtaatcctcctcaaagtaatcatatttctctattggctaatctattagtataattcacaatataagttaaaaatttgtgattgtctaatagatcattttaatgtaatccacatttctaaattttttctctaaatcttttatgtaggagaaaaatgtatttctgtaaatgatttttcaaaggctgtatgtagtgtggtatgtatatgtatagatgtatataaagttataattacatatagctaacatatgaatgcttgctatatgccttgcactgttctgagagttttatatttattagctcattaaatttcaaacaaccatattttatccttttttcaacaattgaggaaactaaggcatggggaggttaatttgtcccacatgagatatatatatatatacacacacacacacatatatatatattatatatatacacacacacatatatattatatatatacacacacacatatatatatacacacacatatatatattatatatacacacacacatatatatacacacacacatatatatattatatatacacacatatatatacacacacacatataatatatatatacacacacacatatatataatatatatacacacacatatatatattatatatatacacacacacatatatattatatatatacacacacacatatatatattatatatacacacacatatatacacacacatatatattatatatatacacacatatatattatatatatacacacacacatatatatt

SEQ ID NO: 9381 - DNA, 1045 bp, Homo sapiens
aaaactgaggtgatgggttgataggtgcagcacaccaccatggcacatgtatacctatgtaacaaacctgcacatttcagcccatgtatcccagaatttaaagtaaaattaaaaaaaaaaaagaaaagaaaagaaacaataagttggtttgtatgacactgtagtgtcagtctcattttgctgtttggtatccttactccttttgcctcccctttcatctaagttaccaacgcaaccatttgccaacctaataccttaattctaggacagtctgttatccaggttctcagactccttgttccttcttcttcatcatttctgcctccgtagctgtgttttgcatgttctgtttagggaagttttggagaatggaatccacattagaatattctaataaggctagcaattttcccccttccaaagggaagttatctccagaacctgtagccattgggaatcatccatccatccagaaggtcattgccccactcttctaggacctagatagaggcaaagaagggcaacaagaagcagaaaaagcagaaggagcaacagcagaaagaggtcaagaacctggaagaagagaaaggagctttcagttactttatctcttcctccagtttcttaattcattctttgtggctgcccacttcattccttcttttatttcctgagatccagagataccaataatccctttgagtggggtttttctgagaattcctgtaaatacatcaatttgtctacttcaaatgagccttcttttgaccgttgcaaagcaggatttttataagtatgcttatgccaaatgtgagagaataaaagaagccttttatttttaaaagagagacctactgacaatattctaggcatctcgtatttttctactgctaaagccagtgatgaatcagatgggaccttcaatgagttacccattttgctcagttgtaacttggaatttacagagaggctttggaattttccctgggaaccaaatcccactcagccaaagtagtcagagggagactttttggcaaacattcag

SEQ ID NO: 9382 - DNA, 1041 bp, Homo sapiens
aagtaggaacgtggaagaagctgtgtccatagtggtcgtgtgatgactccagctcttaagcaaaagcttcacataatgacagtcagaatttgcccagtcatggttcaattttatactgttcgtatttttttaactagttttaaagtctttattattaaaattcctgaaggaaaaatactattgagagttggaaatgatgctgtatctacaaattaaatcataatccctaattaaaggatttcatatatacagcttatgttttagagtttcacattgtatgaaagttgccatgtgtgttatctatgtatttactttctgccatcctaccgtcattattcttgcagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagtaagtaaaaccatttacttgccaatgatactgcttctgtaaaaatataactatccctggcagctgctacagaattctctttttgccactgtccagacttcacacaggtttctaacaactgatctccccactgatcctcagtgggagtcaggaaaactgcagaatcattgccagaggaggcccggtgtgagtggcaggccccacctttccctgtaagtcactcatagaacacctaaggtagaggaagtcttctaagactatgtctggagaacctgaggaaacagacactggggaaattcccatcttcaccctcaaaggactgccttttaaaatcaatttagagcactgatagcttactaaataagccatgcttggcttaacaacagggatacgttctgagaaattcatcttcaggcgatttcattgtgggtatgaacatcatagagtgtacttacacaaacc

SEQ ID NO: 9383 - DNA, 1041 bp, Homo sapiens
gtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaatgtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagtccctattggggcaccgcctagtggagctgtgcgaagagggccactgccctccaaacctcagaatggtagatccactgacagcttgcatgatatgcctggaaaagccacagacactcaatgccagcccatgaaagcagccaggagggaggctgtatcctgcaaagccacaggggtggagctgcccaagaccatgggaacccagctcttgcatcagtgtgacctggatgtgagacatgtagtcaaaggagatca

SEQ ID NO: 9384 - DNA, 1077 bp, Homo sapiens
cctctgcttttggctctacacgggtggctttggtccttaccatgatgctcaaaacatgaaagttggccctttgcaatattatcttatagaatttttatagttttgggtccaagatttaagtccctgatccatcttgagttgatttttgtataaggtgagagatgaggatccagttttattctcctgcatgtggtttgccaattatcctagcaccatttgttatatagggtgtcctttccccactttatgttttttgtttgctttgtcaaagatcagttgactgtaagtatttgggtttatttctgggttctctattctgtttcattgctctatgtgcctatttttataccagtaccatgctgttttggtgactatggccttatagtatagtttgaaatcaggtaatgtgatgcctccagattggttatttttgcttagccttgctttggctacgtggggtcttttttggtttcatgtgaattttaggggttttttttcttttttagttctgtgaagaattcaattcatgggaattgaattgtatttgtagattgcttttggcagtatggtcatcttcacaatattgattctacacatccacgggtgtgggatgtgtttccatttttttatgttgtctatgatttctttcagcagtgttttgtagttttcgttgtagttttcacctccttggttaggtattttcttaagtattttatttatttatttatttattttttgcagctgttgcaaaagaggttgagttcttgatttgattctcagcttggttgctgttggtgtataggagaactacttatttgtgtacattaattttgtatctggaaacattgctgaattattttatcagttctaggagctttttggaggagtcttgaggactttttagttatacaatcatatcatcagcaaacagcaaccctttcaatagtatttaaacagacacacaactaaaaaacgtttacaagcacacatttattactttataactttgcagatgactgctactgaaatcagcacatgccagataacattaaaaaatcccttttatggaaagatata

SEQ ID NO: 9385 - DNA, 1029 bp, Homo sapiens
tggctttccatcacttttgttaattatattctattattaatagctccatggtttaaatttttgcacttcctttaacagtttttgaaatgtgaggttttgaaatttgctttaatatccttttattttggacttggcaccttcttagaaaaaatcatattcttcattacttttgttattgcctatattagtcacactaagtcctggcaagaaaaagatggcacacacaaagggtttaatgaggaaagtgtaataaaagggacatttgctgaggtgtaggccaagagcaagagatggtaaaatatccagggactagctacaatggggaactgttatgtccaggcctgaaggaataaaaggagggaatggttttagcagaacccgggaaaagcttggggtcatgaaagaggacccgcccaacaggagctattaccacaaaatgcagctactatcaaaccatgctgacgtgggatgggggcatggggaataaatactgagacttctctttccttctatcctctgaccttctgcctttgcctctcattggctaagtccaatcagagaccaaagaacaagggaacaaggaagccccattgaaacagtttatagacctcaacctcccaaggcacagaggacagagaatggatccaacagagggaggtgggcacatggagaaaaactaacacactgcctgtttttggccacccatgcccagaatagtttacacaccttagcatgccagaagaggatcggcacaaccagacccttgccgacctgtccagctcaattctcaccactttaactcctctcctcatcctattccaacacctttgtaccaaatggaatttcccaagagctcttaatttctgtttcctgtgcttgaaacacccctttcccagccaactcattctcaccctttggcttcagattagacaacaccttctctcctaacagctaagtgcaaccagtgatcctgggttggatcctgaacatgatgtgatgatttcctataaatggcattattaggaaaat

SEQ ID NO: 9386 - DNA, 1047 bp, Homo sapiens
acttcagccttccaagtagctggaactacaggtgcacaccaccatgcctggctaatttttaaattttttgtaaagacaaggttttgccatgttgcccaagctgttcttgaactccttggctcaaacagccctcccaccttggcctcccaaagtgctgggattacaggcataagccaccatacccagccttcaaattaaatcctaatgagaatttattatttgaataattttaaaagccaaatttacattggaaaaaagtctcctttttatttattctgagagggtaactagagaattctctattttactactgacttttactgctttcagaaagtctttcattatagaccactcaatcacacttgcttttcaatcaaatgataggctagtaggttgtaattccaccaatgatttgttgtataagctgaaagttgtatttattttttaatttcaaaggtctaatgtatggtatgatagagctaatgttacttggtacttcagaaggacagtgtagaattagtatattagtaataggactggagtaaatattatctaagacaagaaacacatgttaatcccttgtaatttgttattagaagaatagctcttatttgtaacttctttataaaatctccaaaagctactttttttggctttaatctgtggatttatagaacccaaaagcaacttttgtatatgtggtttctttaaatgagattagtatttcttttatgagaagttaatttgtttttctaaaatcaaagagacaggataggccaggcatggtagctcacgcctgtaatcccagcactttggggggccgaggcgggtggattgcttgaggtgacgagtttgagaccagcctggccaacatggtgaaaccccatctctactaaaaatacagaaattagcctggcgtggtggtgcatgcctgtaatcccagctacttgggaggctgaggcaggagaatcactttgaaccctggaggcagaggttgcactgagctgagatcgcaccactgcactccagcagtgacagagcaagact

SEQ ID NO: 9387 - DNA, 1059 bp, Homo sapiens
tccttaaaaggaactattggaacacaacccttttgcaaattaaggactttcagtgcacctttggggaaatccccaaatacttttttttttgttggtaaaatgtgttcatcttcttcttacatacctattaaattgttgagggtaggaatcaaatctcattcatttttatatcccaggcataattcctggcacacaacagatgctgtgtaatgtattactacaagaccctttgaaatagtgaaaagattaaagttggagttagaaggcctagggtttttcttccttaattcattagagctttaagacctttgttgattatgtgacattatttgaacctcagtttcaactcatgagtgtactgcttgtttcatttacttcacagaattgggaaataaatgagataaaatatgctgaagtatctttaaaaatgctgtgcagttgtgaaagtcatcaccattgttagtattatacatatttctgggaagtacttgatagagagctccattgttaagaaattacttggatgagtttggcagactgctagctgatcattgaaaactctgctgtttcctcttctttctgggcctacagctggactgtttctatgccacccttgcatttaggtgtggtcatatgcggagttctaactaatggaatgaacagaagtaataggcaccacttccagccctggcccataaaatcacccatgaagatccctcagagttcttttttccttctgtctagctggaatggagaccgccttcaggttaaccttggaagccacacattaaagatattaaagcctctttgaatttcaaaagtctgcattcatctagttctgctacgtgagcaagaaataaacttctgttgagtttgaatcataagttttggggtgtatttggtaaagcagttagagttcccatgttacaaggaacatgttaactcatgctctgctttttctttagagaagcataatcctctcctgtaatagccttagaaacaagggatagcaatgggatatatatatatatatatatatatatatatatttatgatcat

SEQ ID NO: 9388 - DNA, 1052 bp, Homo sapiens
agtgctgggattacaggcgtgagccaccgcacccggcgtctgaaggattttctttagtgtttcttgtagcacagatctgctggtgatgaaatatttcagcttttatatgtctaaagtagtctttatttttgtctttgtttttgaaagatatttgtactaggtatagaattctaaatggactttttttctttcagtactttaaatatgttgcttcactgtcttcccatttgcactgtttctgacaaaaaaaccactgttatctttttctttattcctgtgtatataatgtgccttttttctctggctgcttttaaggctttctatttaccactggtttcaacaatttcattatgatgagcctttgtgtggttttcttcatgattcttatgtttggtgttcattgagctttttggatctgtgactatactcttttcatcaaatttggatatttttcagccattattttctaactaatttttctcttccaccccctctcttctccttcagatattccagtcaaatgtatattaaactgtttgaaattgccccacagctcactgatgctcttttccatttttaaaaaattcctttttttctatttcatgttgagtagttgctatttctgtctttaaattcacgaatcttttcttctgccattaatcccatccagtgtatttgtcatctcagacattgtagtattcttttctataaacttgactaggactgttttttaatgccttccatgtctttactgatctttctgaacatctagaatccagttatgataatttttaatgtccatgtctgctgatttccagcatctctgtcagttctaggttggttttgattggttgatgtttctcctcagttttggttacattttcctatttcattacatgtctggtagtctttgattggatgctagacattgccaattttaccttgagcaccacatatttttgtgttactttaggttttcttgaactttgttctgggatgcagttaagcctacttggaaacagtttgatccatttgggtcttgccttcataat

SEQ ID NO: 9389 - DNA, 1050 bp, Homo sapiens
attttaggctgtgaagcaactagaactctcatacattgctggtaggaatgtaaaatggtacaaccagttgggagaactgtttggcagtttcttatgaagttaaacatgcatataccccatcacgcaacaattcaattcctaggtatttgcccaagaaaaatgaaaacaagtgtccataaaacgattttgagaagaatgcaaatttttatagcagccttttttcacagtcacgcaaagtcggatcaacccaaatgtccatcagtgggaaaatgtatccagaacaaatcgtagtatagtaatacaaaggcagatgattcaaaaaggaaatgaactatttatgcatgcaacaacatgcatacatcttacagacatgtgctaagtaaaagaagctggacacaaaagagtacagattatatatggttctatttacgtgaaattctataacagtcaacactaatggatagtaatgaaagctggaaagttgcctccagggagaggggagaactgactggagagggacaagagagaactatcttgggtgatggaaatggaaatgttttatttttgttttgaatggtggttatacagaatatacaattacctcatatagttaaccatctaagagtttgcatcttattgtatataaatcatacttcagtaaatccttgtctctctcaaaaaaaaaaggagagtttagtaatagaagtatagatttgaggattacctgaatagaagtgatcaatgaagctgtaataatgagatttcagaattaagaaggctaagaagtgagttggttatgccttttattagaagcaggtggaagaaaggaattgatggagtagaagagtggcttgggaaatatggacagtttctttcctgattagccaaaggagcttggaatgaagtgggggtatttggtcattaagagatcaccagtcacttcaaagaaagtacttttcagtaaactggaagctacaaccagatttcaagaggttaaggatgcatgggtgataaagggagaaagatattataaaactaccttttgaagtt

SEQ ID NO: 9390 - DNA, 1066 bp, Homo sapiens
taaagaccagaatatgaaacatcttgaatgccatgtcaaagattttatagtttattctgtaggtaatggggagtctagcctactgaaaattatagggcatgggtaggggtaaagtggaattgggataacatgattagatttgcatgtcagaaatatgtctctggcagcagagttaagataggtgggagatgtgggtgaggtggaagacaggaagactaataaggaatctagtgcaatagtccatttaagaaaacatgagtctgaactagagcagcagcagtagaggttgaaggtatgtaagggagattttgtttgacttgggttttgaagagaaagagtgtgggttaaaagcttagcaaagttacacatggtggtgttttgttctaagattgttaaagaagagcagggagacatccagatgacagggactgaccaagaaattattaattgacctgttaggttggatactcattgaacttagtaagtttagggacaaagtagcttcctcggtttgctgtatatggtgtaaaatataaggtaaaaccctcatgtttgtacattgaactgatttgtttctgtgccatttcccattagtttttgtcttaggcaattaggggaaggcaaattatttttactcattttaaatgtcaatattacatatgttacaggatatgtaatggattttccattctatagtctgtgattttttttttctaatgggattgcctgaataagacaaaatgtttttaagttaatttgttatattcatttgtgtgtgtgtgtatgtgtatatatatatatatatcacacatatacacgtatatataaagatttatatcaatttgtcatttttgttgtgaaaatgtgatgcacaaaattagaatactttcatagtttatgtctgttcacttccatttgtttttttcccttcctctgcttttggcccttccatttggtgtcatttatttcactcttttttgccaaccttctgtgaggaacttcactgggatattttgtttaatgctccttgaaagcatcggctgccctaaaattgtctttttcagag

SEQ ID NO: 9391 - DNA, 1051 bp, Homo sapiens
atagagaaggagcagtctaataaagttgggaagtagaaatcaattcttcagttttatcctttgattgaaaagctattgatgggggtaagaagaatgtagcaaatatactttagtgggaagtgtaaattttacatattgactagataaaaattttacatagtagctagataatttaaaagcctgatatttgaaaagaaaaagttgtttaacatcagaagtggcacagaatataagcttgaggaatgacaacacaaggaaagctatttctttatcacactctgaatggtatgcagttgtttacttgtttgtttatttgttttggggcatccataccattctgacactttgctaatgctactttatcttatacagtatagccagtgatattaatattggaatataccaaatataaagtatgttgaaaatatattcagagtatattcaaatataaaatatatttctaacatatccccccatccttgaaaatcatcaatccaagattctaactaggaaccgttagtatttgagaacgagactgcattcattttgcaaactaattcttacattcttgtgatcatttgaaggctttaggaagaaggggaaaggaggaattaatgttactgagttaaggacattgcatgttaccttttacagtcctgacttcactgtgaagttggcattgtgctctcacagttgaagaagataagtttcagagaggttaggaaacctgattaaggtcacacaatttgtacgtgatggagccaggaatcaaactcaggtcttggtagaggagaagctagaatctcataccattttgtccctttgatttgtttgagtttaaaattcaccatcctgtatcccttgaaataactatagccggaaaaatacaggctgtccttctgcctttcatagtctagtatgatgattgttttctcagatgtggtgcagtgcctgttgtattcaaaacacatctaataaattattctggtagttttgaagggatggtgatgaaaggatcattcagcagcttcatctttaaaatcaatttttg

SEQ ID NO: 9392 - DNA, 1041 bp, Homo sapiens
aaagatgtgaggcacttgctatccaaaattaagaattagtgggcaaaccataggcctgcttctgtgggggaaaaatcttctggaaacttctctcctatatccttttaagcccagtggttgggaagtggcaccgtgccatgccagcaacaccttatttttgcccacagaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggtaaccctcttgctgtggtatctctcttaggcaagctcctgagaaagctgggttttaagaattttaattgagatgaaggcagtgtgaagagatacaagaccctgttaaaggttagagttgtttttctctattgttttttctctcagtggaactgactattcatcatggtatgacaatccagagaagaagttcatggtcatacttgctcccagcaactgtagctgtgtaaagattgtggctcttgaccccacagggtctccctttacgcttcttcccctcccacctacccctgattgagcttggccttggatgagaaaatatacggaaaatgcactggaaaccagaaagcctttcatatatattattattgttaggataaatatattagattttatatgttgtggaagagatggtagaaaagtatgtagtattttaagcacacttttatgatttaaatttcttggttaagttctctcattgatcataactcttgtgatttttgtgtggctccccaggttcgggtcaagtcacccagaactcaagtaggtagtgaataccgggagtcctggccccctaactcaagtaagtacccatttttgctcagtagggactcctagcatattagaccagaaatttagtatttttcacactacattttggggatgtaatttttcttgtagtacttcacttttatactattttgtttctgtag

SEQ ID NO: 9393 - DNA, 1032 bp, Homo sapiens
attcacaatattcgaaaggtagaaacaccccagatgtccatcaactgatgaatggatagacaaattctggtatatgcatacagtggaatattattcacctataaagaggaatgaagcactgatccatgctacaacgtggatgaacttggaaaacattatgctaagtggaagatgccagacacaaaagggcacatattgtgtaagtccatttatataaaatgtccagaataggcaaatccatagagaccaaaagtagagtgggttagccagatgccagggtcaggagcgagggaggaatagggaataaccactcagtgcatacaggttttcttttgggatgatgacagtgttctggaactggataatggtggttgtttgcacatcattttaaatgtactaaatgccattgaattgcacaccttaaaatggttaaaatggtgaattttactacaatttttaaaaagtgagattttgtaaaaaatagcagttctgccttctgcctaggatgtagaaagccagaaagagccttgcttctacccaaaaaacaagaaaaagttggataatctaaaaaatcgtaactttcttgaacccatcagagagatgaaatcatagtgcagtcaactagcctgaaaaagaaacaggcacctacaaggagagataggatacaagtactggctcacttgtggtagaccctgggaggaagatggggccactatacaacagataagaattcagctgagatttttttttttttttttttgagacggagtcttggttttgttgcccaggctggagtgcaatgacacgatctcagctcactgcagcctctgcctcccaggttcaagcaattctcctgcctcagcctcccaagtagctgggattatacatgcccaccaccacacctggctaatttttgtatttttggtagagacgggttttcaccatgttggccagactggtctcgaactcctgaccttaggtgatctgcccgcctcggcctcccaaagtgttgggattacaggggtgagccac

SEQ ID NO: 9394 - DNA, 1078 bp, Homo sapiens
cccaccaccaggggagcaagcactgttcaattaggagcagtggactgcttctgaggcaggaaacagcatacagagactgactgaggcacaggcatatgaggaaagcctacagctgagggaggggaaggaacattgaggaacgaccctccaacaagcagctgtccctaaacctaactctagaagacttggaaaatggtggtgcactgaaggtaaccttaacaaaaatctcaatcccagctcagcttctgaccaaattaactcaactgtccctaccgatggcctggaagaacaaacagtgtgcccatttctaaacagatacttttacctctgtctctcctgtcttaacatatgtctggcattcaataagaaattatgaggcatccacaagagcaagagaaaaacgaagccactgtgaagagcgaaagcagtcaacagaatcaaactcatatatgacaaggatgtcgaaaccatcagacaaggaatttaaagtaactgattcatatgttaaaggctgtagtgaaaatgttgataacatgcacatacaggtgaggaagactcaactactgtttataggaaacccactataaatataatgatataaatggatttaaaagtaaaaagatggataaagatataccatggaaacactaatcaaaaggaagtgtggttatattagtatctgataaagtatacttgagaacaaggaatcattccaggtataaagatgatacataataataaaaaggtcaattcaccgagaagacataataatcctaaatgtgtgtatacccaataacagctttgaaatacctgaagcagcccaggcactgtggctcatgcctgtaatcccagcattttgggaggctgagacaggaggatcacttgtgcccagaagtttgagacaagcctgggcaacatggtgagaccctgactcaacaaaaaaataaaaaaaattagccaggtgtggtggcatatgcctgaagtcctagctacttgggaggctgaggcaggaggatcacttgagtctgggagttggaggctgcagtgagctgtgatcacaccactgcactccagtctg

SEQ ID NO: 9395 - DNA, 1060 bp, Homo sapiens
atttccacatatttgagatttactggattggactgttcagccactttctagagaaaccaatttgttttccaggttcctgatcatagcccagtctgtagcccaataattagtcagattgtattttcagttagttgcttttttttttttttctttttttgttgatacagagtctcactccatcgcccaggctggagtgcagtggtgcaatctcggctcactgcaacctctgcctccagggttcaagcgattctcctgcctcagcctcctgagtagctgggattacaggtgcatgctaccacgcccggctaatttttgtatttttattagagacggggtttcaccatgttggtcaggctggtgtcaaactcttgacctcatgatctgcctgctttggcctcccaaagtgctgggattacaggtgtgagccactgtgcccggccagttagttacttttctgtaatgtaaagttatttttagtaacttatttttatttcctttttaaaaattctagattcaggaggaatcagatatgtggaaaataagagaactggaaaaacagatggaagatgcttaccgggggaccaaaaggaaaatgctacccagcagttcaaggtgaagttgcagctctgagaactaaaataattctcatctttttcagaatcatcaacttttgtttaaaaatactttggtatattaaggataaattcagttctgtgagtccttaagccttccttctttcgtaaatctagacccaggcataaagataatggctgtgacgcatatggccctgctctttgtacttatttacaatggagagttaaaaaattctacctgaacaattatgaatgtgtagggttctgtggattctaaccttacctgatagcttttaactgaagattttatactggaatcttgtggtcactaagctgatcagtcattctattctctattaatctttcattctttcaggcttttctttttgtagctggaactgcaggtgcatgccactatgcctagctactttttttttgtagaggtggtgtcttgctgtgttccccag

SEQ ID NO: 9396 - DNA, 1043 bp, Homo sapiens
tgggattacagacttgaaccaccgtgccccgctggaattttcttagaactagagaaaaggacattgggaaagacattcagggtgaaagagaattttatttgaaaaatcagtaaagaattaggtttgactcatttgttacatgtcatataggggagtagaatgtctcgtgtgcttcaagctgaatttttgaaagatttgaaagaaatgggatagtaacaacttgctaaaagaatgcaaatctcacttcttcagagtaatagtgtccctatatgttagctcatttttctagcctagatttctgaatcactcttaaacttttatgagataaagaattctattttatagcacttaattatttatttgaccacccctctatgttaggcagtactgccttgtgaacactcagtaatgttaaaataatagggagaagtttcagttccttattatacaactatgatttttacttcttgtgccttttgcactttaggtaatttcagactggatatcactgcataatttaatttttgacacccttctactggaaaatgccttgtattttcatgtatatgccattaaaataaaaggaattaaatttaagatcttattaaattcacaggaatcgctatgaagtctttggaatcacattctggtatatctaaattactggggtcaatataattggataatattgaatggtggtcatttttataacaacgaggttgctcttagcacatctggggttggcatgtagatttattcttgtaaaaagacaggtattgttcaactatgagaaatgataaaaatagtaattgaagtcctaagttagttcttaggcagattagtagtcctaagttagttcttaggcagattagtactacaaaaaatagaagaattgttgtgggttgaaaatggagaaccaaagcgttgatagtctgggaatgaggaaggagagagaagaaatttggagcctgtatttggtgttaggtttatgtttccctcaagctgccagttgataagattattgtctgtgggaaacaggcaag

SEQ ID NO: 9397 - DNA, 1071 bp, Homo sapiens
aagcagggtgggaaggaggactggctgagccctgggtgtgggacagagtgcatgtgtgtggtgtgtccccaagggcagaaaggtggcgaagggaggcgaatccaagtgggtggagggggggaagggcgggaggagaaaaaggtgggaggaggaccaggtgggagggtggtggcccactcaggacccagtgggggcagcgtgatgaggcggatgaccctgttcctgaacggcagccccaagaacggaaaggtagttgttgtatatggaactttatctgatttgctttctgtggccagcagtaaactcggcataaaagccaccagtgtgtataatgggaaaggtggactgattgatgatattgctttgaacagggatgatgatgttttgtttgtttgtgaaggagagccatttattgatcctcagacagattctaagcctcctgaaggattgttaggattccacacagagtggctgacattaaatgttggagggcggtactttacaactacacggagcactttagtgaataaagaacctgacagtatgctggcccacatgtttaaggacaaaggtgtctggggaagtaagcaagatgatagaggagctttctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggccgagctttcttaattgaccgaagtcctgagtactttgaacccattttgaactacttgcatcgtggacagctcattgtaaatgatagcattaatttattaggtgtgttagaagaagcaagattttttggtattgactcattgaacacctaaaagtggcaataaa

SEQ ID NO: 9398 - DNA, 1026 bp, Homo sapiens
ggtggacaaaggaaagtgaggaagctatttgcaaagctgttgcaggaatctagacgtgaagtgatgggtgcctggaccatgggggtggcagtggaaatagatggaagaaggagaatcgagctaattgtgcagtgcccattgtggtgtcaggcattttgctaaatacttcttatatgacctcatttcatccccataaccaccctgctgggtaaatgtattagttatctactgctgcataacaaattactcccaaacatagtggcttaaaacagcacacatttattatctcagttctgtgcaccagaaggccacctctggctcagagtcactcataagactgcagtcacctcagggcttgaccaggaaggattcgcctcccagctcattcccatacttggtggttggactgaggcctcagttcctccctctgtttcttgctgtgtaggcctcttcacagagcatctcccaacatgacggcctgcttcagcagagtgagcaggtaagagggcaagggagagtgccaccaagatcgaaggcacagtcatttgtaagtgaaacactttttctgtattttgctccttcgaagcaagtcactccatccagtccatactcacggagaggggattatacatatattgctgatgtgcacattttgatgtggagatatcaggtgataagactggagaggtaggcaaggagtgtatataatgccctttttgatgccagggaagtaaagcacatttcatttcacaggagtgaaatatcagagcagcagctgttgtttacagtgggaattgtggagtttgtgggtggtagaggaatatagaaatcttggaaacacaactcttgaaattaaaaccaattctaaggtgagaagttaaaaaatatcaccatatctctgtgaacataatgaccagagccgaacgatcatttgtattacctcaattgaggtaggaactaccagcgagttataaaaatagccagggtgctttgatcaattgcgtacacgtggccactaatacatta

SEQ ID NO: 9399 - DNA, 1051 bp, Homo sapiens
taattttttcaatagatgtcaaaaagtatttgataaaattcatccctttatcataaaaaccctcatcaaaatggatatagaaggaacatacctcaaattattaaaggccatctatgtcaaactcatggctaacatcagaccgaaaggggaaaatttgaaggccttttctctaaagactggtacaagataagaattgcccacttttaccacttttattcaacatgatactggaagtcctggtcagagcaactaggcaaagaaagaataaaagggcatccaaattgtaaaggaagaagtcaagttaaccttgtttgaagaggacatgatcttattacttagaaagacctaaaaactccaccaaaaaactgatagaacataaaacaaattcagtaaagttgcaggttacaaaatcaacatacaaaaatcagtagcatttatatgtgccaacagtgaacaatctgaaaaatcaagaaagtaatcccatttacaatagctgcaaaaaatataaaatacctaggaatcaatctaaccaaagaaataaaagttctgtacaaggaaataaaattctgatgaaagaaacagaagaggacaccaaaaagtggaaatatattccatgctcatggattggaagaataatattgttaaaatgacaatactactacaaactacttacagattcaatgcaatccctatcaaaataccgatgacattcttcacaaaaagagaaaaaaaaaaaacaaacctaacatttatatagaaccacaaaagaccctgaataggcaaagcaatcctgagcataaagaacaaagctgggttgggcatagtggcttatacctgtaatctcagcactttgggaggccaaaatgggagaactgcatgaggccaggagttcgagcctgcagtgagctatgagtgcaccactgcactccagcctgggcaacagagtgagacccttcacacacacacacacacacacacacacacacacacacaaaacagagtgagacccttcacacacacacacacaccacacacacaaacataccctgaa

SEQ ID NO: 9400 - DNA, 1022 bp, Homo sapiens
catcttgaattacaagattatcctccctgccctgtcaggacaatatccactgcctgagggagtgggacatagctggccccatcacaactgaagcacttagtgtcagtcctcatttaaaagtaagacaaaagataagcaaggtgagcgcgtgaaggcatgccatgattgttcacctgctgaagtctgagacctagactatgagtgtggagatcaccctggtggtctttgcaaaagttagacttttaagaaaggcagaataacacagtagataagaagaaaggttctgaagctggacagctggctggataaaaagctgtacgagttttggttgtgctatttagattcaaatcttagctaagttacttattagtgtaaatttttaacttctctgtgcctcagttcttgtctgtaaaatgataacaacatctacttctaaaacatgcccagcacatcgtaagaagggttagctctcactactataaggaagagtatatagtggttaaaggcagggtctctgaagctggaatgctggttcatatcttaccttcaccatttaagtagctccgggacctgagcaagagtcacttagcatctctgtctctgtttctcatctacaaaatgggaatgataatgatatctccctaataggtcactattacatgttaaacaccataggaagtgttattattatgaaatgaattagaaagcatattccttgacttttaggtttggctgattcaaaaagggctatataaaaaatatctactggacacctctaagaaaagcattggattaagaatgaacagactaagattcaagagccagttctatgacttactagaagggagactctgggcaggtcatttaatttcccttggtctcaggcttttcatacataaagtgggttagtaatacttcccctgtgttgtttattagatttttttcacccacggactaaatgcagtacacaattatccccagaggcatcatattgtcaaatagatatgaaaagattacacact

SEQ ID NO: 9401 - DNA, 1030 bp, Homo sapiens
ctcataggtatatacccaggagaattaaaaatgtatgtccacacaaaaacttgtacatgaatgtttataggagcattattcataatagctaaaaagtgggaacaatccaagtgtccatcaacttatgaatggataaacaaaatgtggtatgttcttacaatggactattgtttagctataaaaataaatcaagtaccgatacatgcgacaacatggatgaaccttgaaatgactgtgctcagtgaaaaaagccagacacaaaagaccacatattgtatgctttcatttctatgaaatgaaatgaaatatccagaagaagcaaatccacagagacagaaatatgaaaatccacagagacagaaatgtgaaatattgaaaaaatgaaatatccagaagaagcgaatccacagagacagaaagtgattgccagggactagggatggtgcggggaatgggaaatgactatgactgctcattgatttggggtttcttttggagatgatggaaatgttctggaagtagatagtggtgatggtttcacaaccttgtgaatatactaaaaactaccaaattgaatttgatggtatgtgaattatatctcaataaaatttttatttacataatatgctgtgtaggcaagttggggtagcagaaagaatgtgacagaactttagtattgggtcctgttcagagtccttgctttgggagagtttttaaactatctgagctttagtctccacttctaaaattaaggcagtaatatcagtcttacatacttttatgtatattaaatgaaaagtgtatgtaagctgttttgaactgggtctggtggtgtgcccctatagtctcagctacttgagaggctgggataggagaattacttgagcttaggagtttgagtctagcctgagcaacatattgagacccccatctcaaaaaagaaaacaaaacaaaccccaaaaccattttagggaacagggtgggcctgacatatagtataaatttttaacaaatgttaattagtttccta

SEQ ID NO: 9402 - DNA, 1016 bp, Homo sapiens
ctaacctcaggaagcctacactccaatgggaaaccaagggtgaccccagaccaatttatgcgactgctttatttccttatccacaaagtggggagaatgacagtgcccatctcataaggctgttgggaacttttaacgacataatacttgtggagcgtgatggctggcatagagaaagcactggataactgcttgttttccttcttcttgttatgattggagagattccgcggaggtggtgcctgggagctggccacacctcccccagagggaatttccgagtttcacaggtttctctcccttctgagcaacggcaggtgagtcagggtcgcttgtgctcccctccagctctgggatgtatgctgtccagctggttacgagtctccatggcatccgaggaaaagtggagctggctgaagggaggtggaaaagaagggcaacaaattccagtttcttgtgaaactttgtaaacgtaaggctcttatctcagtctgcagagcagaaacagggtgagggccatggatctgaatgtctccacctgtgcataaaacatatgattagagctgaagacctagaagtcccttccccaggcagggcatgaactcttctgtttctagaaccatttagggaggtgacaacttggcttcgtcccagagattcaggtgaggacagaacagagggcagggtgttcttgccctgagttccccgctaatgagctaatcctggcccttcacctttgtttggcatgaagtttaccagaaaagggcatcctgcctttatccttggttctctataccctcgctacttttcctgtgttttgtaaacacgggatggtgtatttagctttcttttgctggaattattttcaccccatgtcctgtgtcttccttgtccagaagaaatcatcttctagcctaagagctccagagaagggtgtgcaggggacggccatgttctgatgcatgcattcagctgtgtcgaacagtcttcctgttttgctactgtctgagaatatt

SEQ ID NO: 9403 - DNA, 1073 bp, Homo sapiens
tgggtgcatttattctctgatttctaacccattcattgaggttgccttctggggttgccgtcagactgccctgcatgctaagatcctggaatttcggataaaaagccctgagggaaacaaatagaccagcaggatgctggaggtggcccctgcaccattcatggggactgactcttgcagctgcagcagaaatcctggtggcctaaggggaagtggtgtgggggcacaaaacacatcccagtcactcctggagccaggaagtggggaggagagggttactgcatggttatcaagagtgacggtgcatgagtttggttgggatagggggcaccaatctcagtccccaaactcagatgggtaagaaatctccaattctgtccttgcccataagtaaacctaattttcactccatattcccatcatactgtgctagtcggaaatttaatctcatatgagactctcctccctgtgtgccaattttcttcccagctccatagttggttctaggtttctgtgagccactggaagactctgggcagatatctatagagaacagactattatgcttacattgtgcatgacttttttgtgtgtgtgaggtggtaattcttctggttaactagtcaggtcgaacaaactgagtattttctttttctcttttgccggtgtctttattttgcacactttgggggtcttctgtgaattactgtgcacagagaatgtccctttgtaagaagatggaatggtttttgtggctggttactgtcccactgtccttccaccagtggcttggtcccctgtcatctgggagctcatccttgtagccatctctaagtgacacagtggcctcagtgtgtgaatactgatatctagatgctggcagtgcctggaagaagttgctgtacgttccttgttagtttcatataaacagaactatgggtctgtttattttttgactactcagaaagaccttttaaaatttaattaaaattattctgtaaacttgaatttgtttgatgtctagttctataagttttaacacatatatacctttgtggaaccacaccaacaca

SEQ ID NO: 9404 - DNA, 1051 bp, Homo sapiens
ggaggtaaaatcagcaagacatggggggatggattgaattaggggttgtaggaggcataatctacataaactgggatgggcaagcacatttgataccctggtttaggaacctgtgctttagaggtaatgtcccttcttaatgcttcccaaggtgtctaggtatatcagtgatgatgacttcacttgcgtggtaagaaatcccccaactcaatggttgtaaataattagaaatcatctcacatggcaggaagtccacgggtgatagcacttgccctggtggtagaatcagctctgtgatgtcaccaagaacccaggctccctccctctcttcactctgctgactcccactggggccagcttgcctggtggtagcaaggtgaccttggcatttccaggcaccagacacccagtcacaaccacatccttctcaggctcacctggctagacagtcaagttatgtgctctgccaggaaaatgggatgactgtgaaggtgtagactgctaagaatttcaccatggactgcaaatggggccatcttctctgaaaagtggacaaatgaactaacccagggtcctgttaggggaactagacatgggggctcattgggtttgtcacactgtcctggacgaacacatctcagattttgaatttcttagatcaataaacacaatacaaagagtgggtgggggaactgacataggattgctgacttttcattttcacctagtaaatatttaaaaaattatcatctgttgtctctatcatttcattagaagcacatcttttgtttttttgagagaaaagtaattttattttttaaatttatttttatttttatttatatatatatatttttattatactttaagttctagggtacatgtgcacaacgtgcaggtttgttacatatgtatacatgtgccacgttggtgtgtattttacattaggtatatctcctaatgctctccctcccccatccctccaccccacaacaggccccggggtgtgatgttccccttcctgtgtccaagtgttctcattgttcaattc

SEQ ID NO: 9405 - DNA, 1053 bp, Homo sapiens
attgcctgggaaccagagggtggttacagctgtacattctattagtagacatgtagctgaaaattatataaaaatcaaattttgtgtactgccagaggtccttgttagattaaagaaacccaactgtggtatattttttaaagcagataattttggaaagacacacttgtaatgactttggataaggataaaaggggcatagctgagatgttagaaataacaaagcaaccagcaagggtggatgatggatcccaaatggtagacgacggagagagagaaagctctttaaagttataagcttgagggaatgaaataaatatgcagacactggagaattcacacaactttaggtgagagttgaaggagactttgaaggaagaatttatctccgctgagaggaagggttgatgaggtaagtatgtgtgttccctgtttgggaggtgaatggaggaatcccagttaaagagactaggaagactcaaagatggtagtaatctatatttttatatgttcagtggagagaaaaacaccatgagttatggtcagtactttgcggggtttttatcacgcccacaagtatttatgtggcagtgtttatgtagcacacagaatgatatcttgcctataattcagaaggtaatagtgaacaaatgaagagaaccagagcttagtggcacaaaagcctaggttagaaaagtataataaagtgaagtgaaagaaagttggaaacaaataatatatataggtataatcccaatcttgttaaaaaacgtctttcactcaccctgtaatcaagactggaagacggtaaatcactatttatgttgtctgagtttttgataatgagcacatattgctttgcaaaacaaatagtgcagtaaaaacaagggcagcagtactaagggtggttaaaagtataaagtaggtgagaattaagtagaaacttgggatttgtgtcagaggagagtagtgatgtcagagggatttcagttgaatggtgaaattcaagttctttatttagagtcaaagactgaggaagagctgatgtccagg

SEQ ID NO: 9406 - DNA, 1041 bp, Homo sapiens
ttaaatgaccagatcttgtgagaactcactatcatgaagatggcaccaagccatgagggatctgctccatgatccaagcatcttccactagaccccacctccagcattggggaatataattcaacataagatttgggcagggacaaatatccaaagtatatcagttgtcaactgtagatgatgtctcttgattcctcattttgtgagatgaggattaatagcatccctgtactcccttcagctctcctttttgtcattcttcttccaattgttaacatttgtttttaaaatttttatattattgatgtcaataacatctacattttgttctttatccataattaagttatcagtgattatagtttaaaaagttgaaaactgtactttttacattatgatgaacaagtaaatattgttcactgaggagccaagtggtatacgattattgtatttcctttcctatgaagaattattacagtttctactagtcttttttgccctttcattgtctgcctatgtgaccttctgaagtttttttagtgtctgcactctctgatacccaaagagagtatcaaatcttgaaatcccttattaaagaggaatccatgattcttctgcctgtctgctactctcttctgggttgattgaccctggatcagctgcacagctgtcaccctgggatgacctttcattgatcttcttgcctgaatccagttttggcaatataatgcctttttctttctgctttgccatctagctttgagcaaaatttcaagttattcccaaaggaagagtgaatgaaaggtaaactttatgcattattagtcaatacatttataataatgtctattcttcccatagatatctgatagtatctttattctgtcctgctgattacagggttaacaaggtgtgacttctagactgagaagaatttccacattgtaactggaaggcattactcatgatcttttagcctctatgattctgatgagaagtctgatgccaatctgatttttcattttttgtagatgactattt

SEQ ID NO: 9407 - DNA, 1031 bp, Homo sapiens
tgaatgaataagatgtttcaaatagtaagaattcctatgaagaaaataaaatgctgtatgctccagagagtaagtgagcagagaagggggtgggtgaacaaagaaagtgccctctgattcagcccaggaggcagaggctgcagtgagccaagatcgcaccactgcactccagcctgggtgatagagtgagaccacatctcacaaaaaaaaaaaaaagctctctctgatattggaaatgagattggaacgacacagggagccgagagagagagagagagagagagagagagagagagagagagagagggagagagagaactgtaaacatgtaagcataaagtaagaaaaatcagcgtgggttggctgctttatggaaactttttttgagttattttgtggttgtgcccaccacactatacatcttgatgtagtttgcatatatttttaaagtgggttagcatcatcagctaatgcttattgaactgtcagcaaatatttatggagagcctcctgtgctcaagaacccttattaagtgcagagccctgaattatgagttacaaggattttcagaaggtagaattctagggtttaagggaaatatttcaaaggaattacaaattaatttgaaaaaactccagggccttcttagagaagcactgtacattccagacatagcatctaaagccaaaagattaaaccagatgggcaatcattttctttctcattacccaactaatggggactgtgaagatgggcagggactcatgtctagagcccacctgaagtcacagtggacctagaatgaagttaacgtcgcagttaagattttcaccggctactttgcttccccaggattttatattttttgaggaaacggaatgtctctgtcatacacagagaggtgctgacttccctgcatgccgtgtagacacaggaggagtggtcacagaggggacatgtgccatcagccttcttcttgagctagtggcacccttaaggatgcaggcggggaatatcaatatattatttt

SEQ ID NO: 9408 - DNA, 1021 bp, Homo sapiens
taaaaattgcccattaaactaccacctaaaaaaaataagattaacattttggtgtctatccttcacgtcttttgtttatgtacaaacatatatactttataaactatatttttcatattgtagtataaactattttgtaacattttgctcactatagcatcatttctctgtgtcatcatatattttctactgtattatttttaatgcctgaagatacctataaaatatttaattgtataatttaaccaatagctaacactgagcagtagtttgcttcagtttttctctcataagcaacattacaatgaccatcctttcagctttttacattaatttgattttcatagtctaaattaattcatataaatggaatagctgggcctaaagttgtaaatgtttttgagactttgatacctgttacagtttgcccacctaaaaggtgtgcttagcgtaagttctaggtaccgcactggtcttccagatgcaatgctcctgtggccgcatgaactctgagtactgtgtagcatccaggtgcaactttaggcaagagagtcttttaagtttcccttcatagggaagtgttcaataacatgaggatttcatttggaactgaatctgtgtgggtagtaagttgtttacctgacagtaatcgaatccaatccttagctgaattggatgtgctggtgatacctacctaagggaattgctgcaagtcgagtcaataaagcaatttcaaatgggagaaaacttgaacttcctttttaataataaatagacaaaggacttttcttttgaaacattgttaattacaatggagtttgaagaacccttgagctgtgagaagcagatttggtatttctcagaaatcatcttttatgaaatgtgacttgaatttctattttctgcctaatctgaacagaagcctagcagcagtccctccccacccccgcacctccacccctctagagaagtgggtttcacatgggactcaaggtaaatggggaaaccatgagtacataag

SEQ ID NO: 9409 - DNA, 1033 bp, Homo sapiens
ggaaaaaactgttggttgtttgtttcaggtaacattcatgatgactttgtcttgcatgaattattacttagagtattactgacccatattaatgggatcaagacaaatacatcttctgtaagggagaagttttgcatcactgaacaataaagcaggacagcatagtttatggaaaagaagatttagaactacatagcgcattatttcactttctgcgacataatttgtagtgaaatgcaatgaatgaactcttgaacttgtaggggatatatgcaacattaaggccaaagaagtaatgatattttcctccatagatgcaatgcctaatgtcacaatgccaccgcatcaccacatcagctgaaaaaacatttggggaaagtcaggtctgcatgtctgacttgtgaattacattaactaagcctaaacctaatagcccaagtatgctagagggaaaggataaaagggagacttaaaattgctttgaattaaaattgggaaaaaatgagaacgtttgtagaaacttaaattatcccaaaaacatgtctaccaaaaagtagcacttctaggcatagtttgatatctatttcatcatgactgtcatttgtttgttcagcaaatgcttactagcacctactgtgagtcagctattgtgttaggcacttgggatatggcagtaaaaggtatgggaaagagtcattctcttgagctcacatcctagtagaagttttgaacaatagacagtaaacataataaatgagcaaatgctatagtatgttagaaagtggtaatagggaaaagaaagtatagaacagaataatagtgacttggagtatgtgtgggatgagctagtgtgtgggcagttgtcacaagtttgatttcctagaagatccaatccatatcatggcatctctcccccgccacacacactttgtagaataaatctattttaagatataagccaactgcttctcaaaaaggttaagtaacttgccctagatcaagcatctggtaagagagaaatctgtttacccta

SEQ ID NO: 9410 - DNA, 1133 bp, Homo sapiens
cattggcagcaagcacccagcatgacaatggaaacgtgtctgtggggagaacagaagttagaaaaaggtggctgtgaagtagcctgtggcattgtggaacccacctttccattattcaggaccctccacaaggtagaaagtgacttagaaagtcacttagaaagaaaaggaaatttaagtaaaaccaccccatccacttagatgaatttggaaaaggccaatcgctttctgatgcacctgttcaaaaagataatttctaagtcctctttagagctaagatccagaatctccactgtggtctctgggctccgagtagactcacttagtctgttttgattcagcctcaggccttctgcttgtcttacaagcagagaatgggaagtactaagaatctccacttctcagactaagtcagggcctgtagttcattttaaaagcaggttcaagacttgcagtttaaacctttgagacatctggtcgtagctgggatctatatagcctttgcttcccccacccccgatgggaccattatgagagtagaatgttttcctgcacccttacgaccctattgtccatgcctgagtgaagaaacctctggtttctctggttggggaaggctctggctgtctgtactcctctgtggtagctcagccccagtgtagagaagaccaccactggctctctcctggcttctcgcctggtccggtttctcttgctcctaaatagcaaaaccgactgatttttttttttttgaaatggagtctcgctctgtcacccaggctggagtgcagtggcgtgatctcggctcactgcaagctctgcctcccgggttcatgccattctcctttctcctgcctcagcctcccaagtagctgggactacaggcgcctaccaccatgcccggctaattttttttttatttttacttatttttagtagagacggggtttcaccgtgttagccagggtggtcccgatctcctgacctcgtgatctgcctgcctcggcctcccaaagtgctgggattacaggcgtgagccaccgcgcccgggcaaaattgactgatttctttccacgcctgtttatatttcccgccttctccctgggaaatgtgataatgatcagaaaaatagc

SEQ ID NO: 9411 - DNA, 1022 bp, Homo sapiens
ttctgcctgcctaaaggaaatctctagagagagtaaactcaaataaagcccgaaaggatagtgtgaaattccagagttaaatttgggatttgcatttgaggagctgatttctgtcccactaatagaaaacaaaactgcatcaaatggaacagaaattgctcttccaaataacctattattttttgcaacttttacctgcagagttaaattcaccttaacaaaaagtcaactgaggaactgctaaatatttttgaaacccacatatgctgtttgaaactgtgaaaaccagctagattaagagatgtggtgtttacttggatactttctttatcaacattagaattaaacccttagctaagatttcagccccactcatgtgtgttatgtggatttaatgtacatttcagggcttaaaccacaaggctgctgcttggcagatctttctacatcagcttaaaagtagatttttgtccagagtgacccagtgtatatctttgacctacagtgaaggacagaaataatatctatctcagatgaatgatgcttttgaattctatatcttttctaggaatagctcaacagccaagctagaccagaaaggttattaagatttgtgcctactgaggttctttaataggttggcacttctggcttgtagctatgatttcattttttttttttttttttttttgagacggagtctcgctgtcgcccaggctggagtgcagtggcgcgatctcggctcactgcaggctccgccccctggggttcccgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccaaagtgctgggattacaggcgtgagccaccgcgcccggccgatttcatttttatagaatgagaataatagccaggaactaaaacacat

SEQ ID NO: 9412 - DNA, 1033 bp, Homo sapiens
cctgcctgtgctgcaaagccttttgccctggtccaggggaaacacagcagcgccctccaactgcctcattatccggtgttctcagacaggcggggctcagtctgctcccaggactcacgggaggccagctgaccaggctcacccctgttccccaatctgtgagatgatgttgtcatccctccctctggaaggtatagaaagaccctgttttctcaattctggggcatagaaggtccccaggaaggtgtcactctgggcatgaatgccatgactctgtcctctgggccctccccacccgcaggggcttttgctggcagggtctggaggtctcgcatctcagtctgttaaccaccagccatctctctcccactcaagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgtgagtgcagacctgtccaccttgctgaggtttgggctctgctccagcccagggacccagcagctgcaccaccctgcgccatcagctggtgcctttcctttcattgcacgttctccatttggaaccctgatgggggaaaaacattagagaaaagtttctcaaagcatggtctttgggggttacctgtttgaaatgtagactcttgagcccaatcccagatctcttgtattagaatctccccagagtgtgaaaatccctgtgtaggtcaaaatgagggaaattgtcagaactaaacctggggaggagctgccatggggtagggcagcattagagggacacacttaccttgctttcgtacattgtttattcattcattcatccatcactcaacaaatatttatcaagcagctgctgcaggcaaggcactgttcccaggcacataggtacaac

SEQ ID NO: 9413 - DNA, 1025 bp, Homo sapiens
tttgagctgcctgtacttacatgtttgtctcccacacaagttcataaactcttcaaaaaaggatctttttttattcatcattgttatctatagcatcagcataatatctaactcataatgagctctccataaattattgttgaattgaataatggcttaaaactctgttccttaaagctaatagctatactcacctgcaactttttctaggcaaaaaaaaaaaaaaaaaaacctgttgttaattttttctcattggttctgcttgctctattttgctttctattgctctatttttttctttaagatctttcccatgcattttatgcaccatcctttctagtgaatagagtcttttgaatatcttgtttgattaagtcacacctgatttcttctctagccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaaggtttctttttctattgagaagttatataagtacttacagtgagaagacctacacctaggcagtagtttaatctcaaactgtccagcaaggctgaaatggtcttttgtttcttagatttattttttataagaaagtataaaatttgattttttttttcctttgatctttctgggttatctttaaacaaccctttggatctattttaatggaaatttcccctctccaccccctgagcttgtgtgatatatttaagctgtacctttaaggtaatgtattctaactcatttccaactcataagccacagctgaggtcccttgacctgggcagccttgttttgcagactcggtcccatagcaattgtgcccatactcagatctcctgatttaaagcaagccccatgaattctgagcccttcagttttgatggttaaaagaaatgacctcttgtttgtaattgatttgcc

SEQ ID NO: 9414 - DNA, 1066 bp, Homo sapiens
atttaattatcctctttctgctgtactcagagagctgctggtgttctgagccggaccctttcttcctctctgaaaattgttgaggaggccttgcgagcaggagtggtaaagaaaatgatgaaattcctgaaggtaagatcactttattggttacaacccctgaaatgtacagaagtctcctattttattcggggaacagaattaaggtgggctttgtttggttaatgtgctgccatttcttccttgctagattttaaacttcttggatagggatttgcttctgcctgtctacccagaccatactctgaacatcaacaacagattgttgaataaataagaaaattgttcattagatacatctataaaacctgcttacccctcaagcctgacttaaaaatatatggccactgttcttgataaaaatgatctgagtggctttctgtaacgtttctcaggcacattgttctgctcaggttttgctactcatgatgctttatacagttatctggagagtgttggatggaactccatctatgagacatgtagcctgcagaattaccatgtgaccaaaggatgttgggatttccctgtgagatgagtgtggtgaatctaagcaagccagtagagcagttatctggattcacctgcaagggcgaaggggattaatacactaggctgccatctcagaatcccacctatgatgtgtgtgcccatgaggtccatacacccatgttagtgtggtgacacatggcttttattcataaagcatcaggctgagtggcgcagggaagcatgctctgcgggctgctgctagggcaggggtgacactgagggggcagcacagggggtctgagtttagattgccacttgaacaatgactgtcattcattataacttttgcaaacccaccaaaagctcctgatggcatgcatacccatgcatcacacgtgcatacgtgcacacatgccttttaaagaccccacatgggtgattgcaagggctgtgtttgacagttgtcatctcttaaaatgatgtaggttcctgaagttcctcatgcaggactgtc

SEQ ID NO: 9415 - DNA, 1112 bp, Homo sapiens
aaggtgtacacagtggtgcaagccagctccagggcaccgtggcttctgaacgcaagtgtggaagcgctaggagtcctagttgctaggctctagagtggaagttgaatccttggtggggctgccagtaaggtggggaggtcattttctcaccaaatcaaaacacaaaaccctggctgtgtcgtctttcttattctcatgcctggttcttgattgtggctagcaccatggctatttcaggatcccactcatactgctgccattggttgaatgcttacatccattatctcatttagtcatgacagtaatcccatgacatagggactggtattatctccattttgcaggtgaggaaactgaggcacagagtgggtcagtaatttgcacagggttctacagcctttgagtggtagaactggaatttgaaatcatgactgtctgatcccagatcccaaatccttgcccagtatattatactcgcagttttgtagcttttcacagacatttccaaattctgagtctactctcaatgcagggtcttctagcataacctttgttcctgttggcaacacttcattttggactgtcaagatgcatttcctgagatgtgagatgtcatgaccctgtgtttggtaagtttggctgcaaggtactggctgtcctctaagacacttcctgagtcccaagtccacagattttactgaggactgaaatggctgcattcttcatagacactgagtttgcctgttccaaaaatggtgatttctatagcaaccatttattctagcagatgtgtgcctggtatggttggcagagagggtgggaccaaaaatggaaacggccttttattcttcacttcctgaatgcacgccctgtatgtgaggcatataggaggaaaaacatggcatccttagaatctgtaatagatctatggctcaggaaagaaatacgtgttgcttcagactgctttttatctggagcttgagttgggctgtgtttggtttgtggcgtgttctttggcagatgtacctgttggtttcaattcaatggatgtttgtcatttggtctctgcagaatatgcacatttactgtgggggtaggtggctaataaacag

SEQ ID NO: 9416 - DNA, 1025 bp, Homo sapiens
ccttagtcacatgtcctatactcacacttcctatcccattttcctgcctcaccaagatcaccacaatgatcccaggttctatatagcatttcttttctggaggtctttaaaaatattctgggagatctgtctggaatgcttgagtacattcatttattcctgtatgcatagagggcccagggacctcccaggctctctgagccctctgattcttagagggttaaactattatggaaacagacattgcatctgtgtcttctcttgtttcctgcatgcagcagtgacctttggagtacattgttcaggagaccgacccttttctaccatttgaagtctgctattctcatctctctaccaaaagagaaactaaacttcattgtcgtgattaaggtcacagccaacagcagttaaagaagccgttggtcttcccactcataccgctgccctctccctagctctcaggaggaagagctctccaaaatggaagtgtcttgggaaagaaatggaagtggaaagagaaagatgaaaaggccaccaatggcacttcccgtgtctcagcctcaccagagaaggaacttggccacacactggttgggtataccaaagtgacacaatgtggatgttccagtggcaattaagtatttatatgactagacttgaggagttccaggccatgacacttccaaatccttccagcccgcttgtggagagaggcccggaggcttccagcgagacaattagagtgtgaattagattgtgtcttctggaagggagatgaagttacctgcctactctattacagtttatttcattaaggttgaccatgcccttttttttgggcagagggaataggatggattctctggagaaaacagtgtagcaaggcaatggagaaatgtccacactggagtaaggggctttctgggacctggatggagtctccttcctcccctagggaataggacagaggtgggaaaggtgctgcctgactgctctgtgcacatctgcatgttggtgatgagtgt

SEQ ID NO: 9417 - DNA, 1028 bp, Homo sapiens
ggggctccaggggcttgtccagagaagatttcagagccaggttggtgaatagctgctgatactgacatattggttcgatggcagatttttctgctcccctcaacaaaacaatcactcatctttaaattagaggaacaaggtggggtgtgcatgtgtgcgttcatgtatgtgcacgtgtggtactgtgtgtctttatgaatgtgagactcactttacacaagataaatggcccccaaataactgtacatccaattccagtaaaatcagtcatactttaattgcatgaagggagctctttctttaaaggaaaagtgactggagaagatggtagctgcgacttactggttctgtatatctacccaccagctgtaggatggagcactttccccaccttgtcgcaactctccaagggacctccccttactgcttccattttacagctgaggcaacaggctccctgagactggcagcttgctgagggtcacagctggcgactagcttgcctgggatttgacctctgatctgtctgacccaaatgttgagttcttaaccacactgcactgcctcctgaggtataaatggcaccaaggacctctgctatccacagaatgttttgtgattgacaaggagttttgtattcacttatgtctattatcctgtttgctcctcacagcagcctcagggaggcagacagataggcttatgcccattttacagattgggaaatcagttcatcaaggtgtgatgactagtgtgatgcccacagctgtgagtggccaagttaggcgtgggatctcgtgcctgcacctctagatcctgctatttttctcggtttgcttggatctgtgattgctgtggttagcaagggtctagcgcactttatcttctgctattctccctctgctatttaatttctttcccgcaatctatcccttaacttcccccagccccgcatctcccacctccatgtcactccatcccgtgcagctggcctccttgctcctcttgccttgcctggcgagggtgtt

SEQ ID NO: 9418 - DNA, 1050 bp, Homo sapiens
ctggaaaaggataaggagtagagaataatagggagaaaagaaatattgtggatatttagggagaaatgttgtggataaaatggttagggaaggcctctccaagaaggtggtatctgggcagagtcttaaaaagtgaaggagtgagccactcaaaaatttctgggaagaatgtctaagcaaagggagtgagcatttgcagaagccctgaggctggatcaagcctgacaagtttaaggacccacacgcagagcagtggtggccagagagctgggagtgacgtgtagagagtggtgagggatgaggacaggatctgtcaagtctctcagccctggtaaaagatttgggttttactctgcatgtgctgagtcctttggagggtgacaaaatatttgcaaatcatatatttgatgaggaacttatagctagaaatagaaagaggtcttataattcaaaaaacataaacaaataatcaaattaaataatgggcaaaggttctgaacagacatgtctccaaagatagacaaatagccaatgagcacatgaaaaagatgctcaactgcattcaccatcagagagatgcaaatcaaaaccacagtgagatactgcttcacacccactacaatgtggctacaataaaaaatacagatagttacaagtgttatcaaagatgtggaaaaaccagaactctcatgggagtgtaaaatggtgtagccactttggaaaacattctggcaattcctcaagaggttagctgaggcaggcagatcatgaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctcaaaaaaaaaaaaaaaaggttaaacacagaattatcatacgatgcagcagttcttcttttaggta

SEQ ID NO: 9419 - DNA, 1031 bp, Homo sapiens
attctgcttgaaagacttcctgtggtatttcccatagggcagctttgcaggtgatgaaatcttttagcttttgtatatctaaaaaagtctctttcagcattttgaaatatattttgaagaatattttgaaatatatatttaaataaattctaggtatagaattctaaattgatgaggttcttttctttcaattcataaaaatagttggtccattgttctcttgattatttcccataaggaaatcttacacataatgtgtcatttttctctagctggttttgagcaattgattactatgtgccttgacatagttttcttcatgtttcttgtgcttggggtgcattgagctgcatgaatctggagttttcacctgatttgaaaacaactttagacatttgaattttttaataccaattttcctctcctttggaaactccaatgcatttatatgaggctgcgtgattttgttatatagctctctggtaagtataaaatgttattttatttatcttttgaaatttcatttatttatagacaacgtctcactctgtcacccaggctgagtgcagtggtgcgatcacagctcactgcagcttcaacttcctgggctcaagtgatcctcccacctcagcctccccagtagctgggactacaggcacataccaccacgcctggctaattttttatttttagtagtgtagagatggggtcttgctatgtcacccaggctggttttgaactcctggactcgcataagcaatgtgatccacctcagcctcccagtgttgggattacaagcgtgagccaccacaactggcctatttatctttttcttagagacaggatctccctctgttgctaggctgaagtgcagtggcacaatcatagctcactgcggcctcaaacacctgggcttaagtgatcctgctgcctcagcctccccggtcgctaggactacaggaacacaccatcattcctggctaattttttctaaaaaaaatttgttgcctggctggtcactaactcctggc

SEQ ID NO: 9420 - DNA, 1049 bp, Homo sapiens
tacacagtgagtctcactgtgaatttttccattgtctgtggtttaggcatgaaaaggaggggattggagctggtttgggttaccttcagatgccactaacctcctgcaaaatgattctgatctaatatggtgcctcccttacttacctgcatttaacaagatcacttcgataccccatcaccttccagaagctgctaccagaagtcccagttagaaaagttgggtgactatcactttggtgatacaggggaaaacttcggtgatatcaaaccagtcataagggccaggaggatgtctgtgtctacacttagagaacctctggagttaattcagatctttccactgccatgaagcttttctgaacaactcacagtgaacggatctctctcttctctgatgagtgacagaagtactttcttaacctgtatttgtccctacaatttcaaataaccacagcaggccaggtggctcatgcctgtaatcctagcactttgggagaccgaagcaggtagaccgcttgaacccaggagtttgggaccagcctggacaacatgacaaaatgctctctgtacaaaaaatacaagaattagcagggcatggtgacatatacctgtggccccagctcttgggaggctgaggttgggcaattgcttgagatgggcaggaggaggctgcagtgaactgagattttgccactgcactccagcctaggtgacggagccagacgctatctcaaaaataaaataaaatgaaataaccatatcaaatacttctatggtgcttactatgtgccatgcatggcaatacgcactttatagatattattaacccatttaatcctacaacaaccctttgaagtagggtctattaatattatccttatttttttagaaaaagaaactgggcacagagaggtgaattaacttacctagagaaacagcactagtaaggggtggtgcctgaatttgaagctggaagtctggctctaaaactcaggtctcataagccccagaatcaaattatttctgtgacaacctgccttagtccat

SEQ ID NO: 9421 - DNA, 1049 bp, Homo sapiens
tcaactttcttcatctgttttcctggttcagactaaaacatctaactcagctggagaagttataacgctttgttgttggacgtggtttctcattaaatacattgcactatgctggtataagcacttggaaattctagtgctgtattgtcatagtaagtagagaatatagaaaaggcaggaaaatcgtgcaagtcggttactcctcgtcttcccagagaactcactttaatggacaacaaagcttcccctggagtacagtctgttgtggcaaattaacaaaacttgttcttcagaccttttatttgcattctgcttggtctttctttctttttttttttttttttttgtgtgtgtgacggagtctcagtctgtcgcccaggctggagtgcagtggcgcgatctctactcactacaacctctgcctcccggttcaagcttataggcatgtgccaccacacccagctaattttgtattttttttttttagtagagacggggtttcgccacgttggccaggcaggtcttgaactcccgacctcaagtgatccacccgcctcggcctcccaaagtgctgggataacaggcgcaggaaacccaaagtcactcagaagtttgcgtcttaccactgggtagctcttagttcgttcttattttatgtgtccataagagcagataattcttcgtttcaattggaaagaatacaacagctggagcctgagcaacatggcaagacctcgtctctacgaaatttaaaaattagccatgtgtggtggcgtgggcctgcagtaccagttactctggaaggaagaaatgggaggatcacttgagcccaggagatcaaggctgcagtgagctgtgttacgccacttcactccagctaacgactgactgagaccctgtcggggtaaaaaacaaaaaacaaaacacagccggctgggtgctgtgactcattcctgtaattccagcactttgggaggccaaggcagcaggatcacttgagcctaggagttcaagatcagcctgaacaatatggtgagatccccatctat

SEQ ID NO: 9422 - DNA, 1037 bp, Homo sapiens
gaaggaaaaaaaaccaaatccaatttcattcctctgaaaataaactccagatagattaaagaatttaacattaaaataaaactacaggaaaaatagaatattttcatgatcttatattgaagaagacctccctaacaaaccctagaaggtaaacaaacccaaaaactggatggatttgatgacttaaatatttaaaacttctgtagaatcagaagtattccaataccaccagtgttctaattctggttcaattagtaactgggagagcccactctggttacttactttttgagtccttttttttttttttgaaacagtctcactttatcacccaggctggagtgcagtggcttcatctcagctcactgcaacctcctcctcctgggttcaagcgattcttgtgcctcagcctcctgagtagctgggattacaagcgcacaccaccatgcctggctaattttttttttttttgagacggagtctccctctgtcacccaggctggaatgcagtggcatgatctcagctcactgaaacctctgcctcctcaagcgattctcctgcctcagcctcccaagtagctgggactacgggcacgcgccagcacgcccagctaatttttgtatttttagtggagacgggaattcaccatgttagccaggctggtctctaactccttacctcaagttatctgcctgcctcagcctcccaaagtgatgagattacaggcgtgagccaacttgcctggcccctttttgagacttgattttatcatttgtaaaatggagataatgatattaatagttcaaacctcaaaaggtaagaattcgatgagacaatccatgtaaagcatttagaatggtgtccagcatattgtaagtgctcaataaaggtcagctattaggattattactgttgcaactactgagaaaactgacatttacaaagttaaaagatcagtcacagattaagaaacaacatttatcacacaatagagacaaagggctaatgtttataatgtgcaaagagcttctacaaa

SEQ ID NO: 9423 - DNA, 1034 bp, Homo sapiens
gcagaaggcagacttgagataccagggaacatttttttagaacctgattattggcttactattagaccttctaatagttaagaattatctaactatggaattgaaaatagaatctgtaatactagctaaatttgtgtaacttttctgtatacagggactgtgctaggcactttataagtgttgtttcattttactttcaggctttttgatttttgttaagattgttttaattatacacatgcagttattgaggctgagagaggtgaagcaccttgcctaaggtcatacagctgctaagtgagagagctgggatttgaatccaggtcttctgtctccaaagctggtactttgaccactatgccgcctgtcactggaagcacagagaggaaaattttggcatgggaaggaaggtggaccaaaactactgcgggtcttcctagcttctgagattgctggtgtattttttttttttttcagatagggtctcactctgttgcccaggctggagtatggtggtacaatcatagctcactgcagcctcgaactcctggtctcaagtgatcctcccacctctgcctccccactttacactctttatgtaactctgtcttcctttccatctgatcacatagctcctgcctcagccttccgagtagctgggaccacaggtgcacgccaccatgcctggctaatatatatatatatatatatatttgtggagacagggtcttactatattgctcaggctggtcttgagcttctaggctcaagtgatcctaggccttggtcccccatagtattgggattaccggtgtgagccacaacacccggcctattccttggttttatattagcagttacagcagtaactgagctccgacagcttacataggcttattttaggctttgttggaaaattccagaggaggagacatggccctcagaagtttgtggtttaacaggagaggtaagaagacacattttcataaaaaaagtaatattggccaggcacggtggctcacgcctgtaatccc

SEQ ID NO: 9424 - DNA, 1032 bp, Homo sapiens
tctggcctccgctttagggtgtactcctagtagcttctggagtagtttttcaaaatgtgtatctggaaaaactatttcctggcttccattcctctctcttttttgagacagggtcttgctctgtcactgagcctggagtgtggtggcacaatcaaggctcactgcagccttgaccacctgggctcaagtgatcctcccgcctcagtctcccctgtagctgggactacaggtatacaccaccatacctggctaatttttaattttttttgtacagggtaagacagggtcgtcttatgttgctcacggtggtcttgaactcctgggctcaagcgatcctcctgctttggcctcccaaagtgctgagattgcaggtgtgagccactgtgcccagccctagttctgttatgataaagggcaagtctgcatggcctggctcccactggcctccccagcatcctatccaactgtgctgcttcttgcctcgtgttgccttctgctgaaggacttttgcatgcatctgttagaacacgctttcctttttttctttgtctagtgaatacctactcatcattcagttctcagtgtaggcatcatctaaatcaggcttatttccttcagagcacttccctcggttctaattatacatttctctgtgactgattggtttgtctccctcccttcccagacgagctcaagagtagcagcagctgaatctgtttttaatcacgattgcatctctagcgcctagaaataaatgcacgtggtaggtgcccaataaatattcctcgagtgagtagatgatctttagtagccatcctgctactacatacagacaaatagatatgacttctgttcccacgttccttttttctttaactcattggccttttggacctgtccttgcccacatcttttctagagcctgataaggtaaggaaagaaggtagaatacaacccacccatattttaatttttttctggcagaacatttatttgaatttggatgatccatgaattcagatttcccagagt

SEQ ID NO: 9425 - DNA, 1058 bp, Homo sapiens
tttttttaaatgtctctaggacatatttaccctgtagaaaaatgtaatctgcaaataaggacaattttttattcaattttctgtactgaagttggtttgttgttgttgttgttgttgttgttgtttttgagatagagtcttgctctgtcgcccaggctggagtacagtggtatgatcatgactcacggcaccctctacctcccgggttcaagcgatcctcccacctcagcttcccgagtagctgggactacaggtgtatgtcaccatgcctggctaatttttgtattttttttgtagagatggggttatgccatgttgctcagggtggtcttgaactcctaagctcaagcaatttgcctgccttgatctcctagagtgttggggttacaggcatgagccacagcgcccagcctagaaatattatcaattaaaaaattgtcaattaaaaaaaatcgtcaatccaagggcaaaaaataacaacggatcattttaaattgcatttcccaagttgtttgtagagttgaattggccatctgttgatcttttgtgatttacctgtttatatctcttgcctttttgtctagtagactgcttatcttttatttttgttaaggtggcagaactctttgattattctgggtattctgggtaatagtagtggtatcttaccactatttccactattttatcccagtcacatgtcttttaatttggtttatactttcttttgtcatactgaagtcaataaatttgtatttttcttaattgtggtaaaatatatataacatgaaatttaccattttaagcatttttgagtggacatttcagcagcattaagtacattcacaatgttgcatggctatcactaccatccatctccagaatgttttcatccccaaactgaaactctatagccattaaatattaattccccattttcccctctccttaatctctggcagtcaccattcagctttctggctcaatgaatttgcctattctaggtacttcatataagtggaattatgcaatatttgtccttttgtgtctgacttctt

SEQ ID NO: 9426 - DNA, 1031 bp, Homo sapiens
ttggattattacttcttttttttgtttgtttttttgagatggagtttcgctcttattgcccaggctggagtgcaatggcacaatcttggctcactgcaacctccgactcccaggttcaagcgattctcctgcctcagcctcctgagtagctgggattacaggcatgcaccaccaccccggctaattttgtatttttagtagagacagggtttctccatgttggtcaggctggccttgaactcccgacctcggcctcccaaagtgctgggattacaggtgtgagccactgctcccggcaggattattacttcttatgagtttagagtcttctgtaaaaccagagctctcacaatgcattattcttccttagactgtttattaaaatattaagatttatcctagcacttacgttcaacataccatagtttttatacttctccatctaaataaaaccaagtttgttcctacactagtccagcctgcattctcaagaactccagtgattatacatcaacatctagagattaggtatcccaatcctttcttcctatatctaagctaactccttcttagccaaatggtaccctttgattttgtgttaatcctttccttccctccactcttaacccctctcattccatcttctccctcccttttccaccccactctcttcctcctctttcacctcctctccctttttctttttttcccctcttttttttttcttcttttgtatctgagcagggactaacttctgaactctgcccatccccagccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggtgagtcagtggatgcctcctcccagagaggccagggctgaaatctggagggatgtt

SEQ ID NO: 9427 - DNA, 1031 bp, Homo sapiens
gctggattttccaatgtcatgtgtttgaatggcaaaaggtggccacagggcttttcatggacccaggattatttgaagtggtagtcaggcatctgggcaggctgtggcttgacgaaaggcaggagacggaatgaagtgagggttctggggtggagagctgggtaaaggaccgagatgtagatgtgtgattggattcttagagccctctgttaaaaagagttccctccgtggtttcaggaaatgaagaaaatgggacagccctgggctgtcagtctggttcttagggctcaggacaggtgcctcaaatgtgagtttgtccaggggacagctctgagccaggcaggcagcctggatgcaagtggtttggactgtctggaggtgtgcactcacagtcaggtggggttcagtgtgaatgtttgtagaggagtggttgattttttagaagtttttctagctcagagggtctgtgaccatgtggcggtctctcaagcaataccaactggttcctttggtagacaatgctagactgagttttcaagtctcgggtcatttgttatgcttctcttcgcgccctgttaaaaaatttccgggtgtccttggtaaggttggtggacttttcttcttctccttcttcttcttcttcttcttttttttttttgagacagcatcttgctttgttgcccaggctggagtgcagtggcacgatcttggatcactgcaacctccgccccctgggttcaagcaattctcgtccctcagccttccgaggagcagggactacaggcgcccaccaccgtgcccggctaattttttgtatttttagtagacatggggtttcaccatgatggccaggctggtctcgaactcctgacctcaagtgatccgcccgccgcagcctcctaaagtgctgggattacaggtgtgagccaccacacacggctcaaggttggtgcattttataaaactaatcaatcacagaatctgagagctggatagtatcttagggataatctggttggcgagtttcagac

SEQ ID NO: 9428 - DNA, 1034 bp, Homo sapiens
tagacagaatcggtggagtcctcagagttcgtaatccagttgggaaaatgtaattcgcacctgtatgaatgtggactctgggctgtggaggatagacccatgctgtagggacatcagtgctgatttccaagtctctgcagccaaggcagtaggagtaggcaaagggagtcattgatgtgagctgcagtcgccaggtcagcttcatggacatggtggcacttgatctgggagacattgacatagagagtggggaggagcattctaaaggtcattccaaaggtcttccaagtgagtcctttgactgtccttctctattttgaagccttcacagggtctcaagacctctgcttatacaaagggtctcttgggctccatatatgaggacaagactgctctcagcctcttgggtttaggagaagaaaccaatgaggaggatgaggaggaaagtgacaaccaggtaatgatgaagtcctctccctggcctggaaaccctctgtgccatattttttccttttgaaaatgtttttgctgtgatagaaaaaatatgtaacataaaatttgcccttttaaccattttaaagttaaaattcagtggtattaattaccttcacaatgtgtgcacccaacaccactatccatttctttttttttctgcactcccccgccgccactattcatttctagaacttgttcatcatcccaaatagaaactgtgtacctattgaatgataacttcctattccctctccctccatccctggaaacctaatctgcttactgtgtctatgaatttacctattctaggtacttcatataagtggaattatacaatgtttgtccttttgtgtctggcttatttcacttagcataatgtttcaagcttcatctatgttgtagcatgtattagaactttggtcctttttaaggctgaataatattccatggtatggatatgccacattttgtttatctactcatctgtcgatgaatatatatgggttgtttccacctttggctgatctctgtgctacttt

SEQ ID NO: 9429 - DNA, 1050 bp, Homo sapiens
gacaaacatataaaccacagcactttaaaaatcaaaacagtgcgttgtaccttgcaggtgcctgagtaacattaaaagaataaaagtttggtaggaaagacagttgacagcttgcagtttaacttcacatttggagtatctttatataagtctgaatgagatcagcaatcacacagaatagtagatttcacatctaagtttaatcactgatctcagcaccattcaacaaatagtcttttaatgcctactctatgctggggctatactagacacttgaggcttgatttaggataactttatatatgccataattttctaaaattttctaaagtaaaaatatacagggccctttttttctccttcactctacattcaaatctgtgattcttgctaataacctgtgtcagaattaccttttacatcttaatgttctcagattaattttgcaatagtttagtatttttgtttggttttctttataggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagaggtaaaggaataatccccattgaatactgtattgtcctcttgggtatgacttcagcatgtgggccagagttggatcagtctttatttcaatttatatatgtcatagtatgtctagaagtgaatatcagggacactaaagcttttatatcaatttatatatgtcatagtatgtttagaacactggatatcagatgcactaaagctttagtctcctttccgtatcttggggtccacccttctccccagttaaccaatgcctcctattctctctaaaacctctttagaaatcacatccttaaaaaaatctcatgaggctgggcacagtggctcactcctgtaatcccagcactttgggaggccgatgcaggcggatcacatgaggccaggagttcgagaccagcctggccaacatggca

SEQ ID NO: 9430 - DNA, 1082 bp, Homo sapiens
tcaaaaatcagaaaagggctcatgaattcatttccactgagatgtaaatattagagtaggctaagccggatatttccaggtttggaattttaaataggcagatagatgattccttaagccaaggaaggaatctctaattaattttcaagcatccacaggagaccagtatgtctcttctattgtattcactatgtctactttcgttccagattacagagttagactattccctcttttcttcatgctgtttgcagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctgtaagcttctacattttgattttcagatttaaaatttcactaattgcattagaaagtctcagagccattatggttctggtataaattaaggaggagggctcacatcttgatctttgaggttgagtaccaatagaataaagctgggcatggtagcacacccctgtagtcccatctactctggaggctgaggcagaaggatcccttgagcccaggagtttgaggctgtagtgtgctataatcacacctgtgaatagccactacactccaggctgagcaaaaaaacaagacccccagctctaaaaaaaaaaaaaaaagaattattgaaagtaaagagctagtgtgtaaaggcatataaaaattcttgtgccctcctttctctctcatttgtcttctgttagattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtaggtctgaaagatgatatgtattcagttgagctagatgtgtaat

SEQ ID NO: 9431 - DNA, 1050 bp, Homo sapiens
taaaaacaagaccctaaaatagcccagagaagtcaggtaatgttaccatagtttaagtatcaaaatggctttgcacttccaacagtgtcatttgaagctgagacacatttctgagggaaagtaaacctaggaggaggaaggtggaattcaacacaagggagacgcaaaggagattcccaggatgacggtgaaaggagcttgtgtggccactacatagcaggcctgtagagcaagcagtccaggttggagcaaaggatggaaacatccagaaagaatgtttccaaaaattaatcagcagctggaaatgaccatgttgagagttttaaattccaatggagagtttggaaaggatttagtgataagaggctctgaaaataagcaaataagcaaaaagttatactaaaaaggaactatatactcattaggacagcacatggctctgctgtgaataatatttacataatcttaataacaaactaaattatttaagcaaaaatttgactatatattgagggcatctgtgataatgactaaaactgaaaaatcaagaactatcagtaccaaccaaacatagcattatgatactgtctgacttgttaaatttggcatgtataaattttttttaatttttggaattcatgccctataacatagcagttccttacagatttgttaagaagaagcgataggccaggcacggtggctcacgcctgtaatcccagcactttgggaggtcgaggcaagcagatcacaaggtcaggagttcgagaccagcctggccaacatagtgaaaccccgtctatactaaaattacagaaattagccaggtgtggtggcatgtgcctgtagtcccagctgcttgagagactgaggtaggagaatcacttgaacttaggaggcggaggttgcagtgagcagagatcacgccactgcgctccagcctaggcaacagaatgagactctatctcaaaaaaaaaaaaaagaagcgatgagtctacaagatgtatccacaatgaagttcattgataagtgtaggaaaaaactgaaaat

SEQ ID NO: 9432 - DNA, 1034 bp, Homo sapiens
gtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccaga

SEQ ID NO: 9433 - DNA, 1016 bp, Homo sapiens
taggagagctaagaaaaggaagggcagaaacgtgaaagtaaatcaattcggcctcattacatgtggtgttgttctcagtggagtatttggaagtcaacagaaatgtttaaggatgggtgagcttttttgaacgttgactttgctttctgtcctagacggattctaagatacttccgctttaatccgagggaaattttaggtggaaatggacttcatggatgagtatccatgccccgagaagcataggacgggatccgtataaacaataatctttgttacgaagcttagcattcgtggaattttttcagcttgaagagcctcactggtagaccgctgtatttcacaacaaccctgaataatcacagcctctgagtactagtttatttggccagtaaatatttcagttgtcttctcagtggcaagctattcattttattcctgaagtgagataagctaaattgacgtaagtttttcctagatgtgctgtattccagtaagtgactgaaggtcggatctcttaacttttgcctacgtttatgaaatgtgaatagaaagcagaacttcaaaaaaaatgtaatactttctagcctattttgctgtgtttgagtttggtttgggtattttctttttctttctttcttttttttttttttttttcctagaagacagggactcactctgtcgcccaggctggagtgcagtgcagatcacagctcactgcagcctccacctcctaggctcaagcgatcctcccacctcagcctcctgagtagctgggatcacaggcacgcaccaccacacccagctaatttttgtatgttttaagagacgggatttcaccatgttgcccaggctagtctcttaactcctgggctcaagggatcctcccgcctcggtctcctaaagtgccagagttacaggtgtgagccacagcgccagccgggtaatttatccattctctcctcccttccctccatcaccagccaaactatgagttattgaaggctgtcctgcag

SEQ ID NO: 9434 - DNA, 1028 bp, Homo sapiens
atagccatcctatctaaatgcgccagctatatccaggatgtggattgttttagggctcataaagtgtctcataaacttataatgaaagggttaagtcagttcaggtctttaaagaatgctttgaaagaatttatataagctttgactacttaccttacaaaattgaaagttcaagggttctcagcagttgaagagaagtaatgttagtaattctcaactttgactaaaactgccttctagtttgaatagcatcttttatgttctttgtctccttaattctggaaaagaatagtttcaaatatatatatatatatataattatatatatatataaaaggtaccttaaaatgtatgcttcttttttcaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaac

SEQ ID NO: 9435 - DNA, 1083 bp, Homo sapiens
atagagtgagactgtgtctcaaaagaaagaaaagaaaagaaaagaaaagatttgctaacatactcagtacaccatcagaaaccatcaatacacctcagaaactgaggcacagacaagttaaacagttttccttaagttatatggctagtaagtggcagggctagaatttaaatctgaacctacatctgtttgaaagttgattcttgctctctacactgtgctgtctttaagtcctttctcttcccactcacatccaatcaatttctgagtcttgtccattatattattgtagtgtttctttcatttgtccctgctgttctgttcctgctgtcctagtttaaatttccattacttttggatagtttattgtggtaatcttctcattggtcttcccacctatcttttcaccctacacagtgcttcacaatatgatagttttcttaaatacagatcagagtatgtcactttattcctaaaattctttggcttctcactgaatatgaaataaaatttcagattctcagcgctgcatgatcttgctagcctgtatttctaaattttgaaccgtgtctcctgaatgtacatcgttactgcttcaaccacattggactactgaactattaggtgttctccacagtctttgtttatctgcctttgtacctttgctaaagcctctcctttgccttaaagtctttcccattttgacctgtcttgggcttattattcgtctcccatggttcaactcagatccccagatcctaactcttccatgaagttttcacagattgtactgctagttgaaactgaacttctttcctgttttctttttgtgttttgtatgttatccttaaaaaatttaaccccgtataccttatgtcgtggtacttttgaaatgtgtctgtctttgtcccattagatagtgactcccttaagacacgggccatttctaagtcatcatttatgttttatgttttttataatggtgactttttatatagtatttgttgaattgaaaatttgatgtccatacaacttttaggaatactttgctgggacacattacataaactaggagaacttaag

SEQ ID NO: 9436 - DNA, 1050 bp, Homo sapiens
ccactgcacccggcctgactacttattttttatttccttattccaagtacaagaccagaaggaaaacgaattaatgcttcctgtcattttggaaagtacttagaaactttaaatattggcagttaaactgcctgacagctcagtggaactcttgttttggaatacattgcagttaggattatatagttacattttgtaaaagtttgaaatatataaaaatgactcattaggttgttaataatgaacctaacagtgtgtatctcttacatttatctttattttttttttttaaataaagatggggtcttgctatgttgcccaggctggtcttgcactcctggggtcaagcaatcctcctaccttgtcctcccaaagtgctgggattacaggcatgagccactgcacccagcccatttcttttaaagattaataactttttattacctgttgaatactttacctattgattattatatgtatagttgcttgagctgtcaatcattgtagcatttggaacataaaatgcgtgtatttagcaatgtagtcccctagtaagtgttgggaaatccccagatgtctttgtgaaatgcatagattagcaggttgttccacgagtataattcaggaaaagaatgaattaatcagaaatttgaaggatctgaaaatggccatcatgtgacttttacagtagctaaaagaatagcaatttttgtactttagacaacttattcaattcctttaaatatttattgttttatattgtatctattatggtaggaaaactattctacagccagtttagacacttaggttctttgtagctaactgtgtgatcttgggcaagtcatttggccttttagagcttcattttcttcaaacacaacaataagaactactatgtgaggggacttcaaagaaaactcatggaaaaatacatattatgaaaaaactgcagaatttcaaaattttgtatgcaccaaaataaacttgcactaacttgtcataacatatctgaacaggatgtagtttgaggcactaagaaggataaga

SEQ ID NO: 9437 - DNA, 1047 bp, Homo sapiens
aggaaaaaattcatcttgttcatgccgtaattgaagaggaatgatgattaacagcacaaataatagccaacaccatagacatctcaattggttcagcttacacaattctgactgaaaaactaaagttggctgggcgtggtggctcacgcctgttatcccagcactttcagaggccaaggtgggtggatcacctgaggtgaggagttcgagaccagcctggccaacatgacgaaaccccatctccactaaaaatacaaaaataaccaggtgtagtagtgcatgcctgtagtcccagctacttgggaggttgagacaggagaatcacttgaacccaagaggcagaggttgcagtgagtgagccaagattgtgccattgcactccagcatgggtggcaagagggaaactctgtctcaaaaaaaaaaaaaaaaaacctaaagttgagcaactttctaccaaatgggtgccaaaaccattgcacccaaatcagctgcagacaagtgtagagcattcaatggaaattttaaacaagtggcagcaagatcctgaagcatgtctttgaagaattgtaacaggagatgaaacatggctttaccaatacgatcctgaaaacaaagcacaatcaaagtaatggctaccaggaggtagaagtggtccagtcaaagcaaaagcagactgtttaagagcaaaggtcatggcaacagttttttggggatgctcaaggcattttgcttgttgactttctggaggaccaaagaatgatagcatcagcttatttgaaagtgttttgagaaagttaaccaaagctttagtagaaaaatgcccaggaaagcttcaccagagtcctgctccatcatggcaatgtccctgctcattcctctcatcaaacaagggcaactttgtgagaattttcatgagaagtcattcagtatcattaagtatgctgatttgtctcctttgccttttttgtttcccaatcttaaaaatctatgaaggaggcggagcatctaggctgaggcaggagaatcgcttgaacccaggagacggag

SEQ ID NO: 9438 - DNA, 1235 bp, Homo sapiens
aaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaa

SEQ ID NO: 9439 - DNA, 1033 bp, Homo sapiens
tgggtttcaccattttggccaggatggtcttgatctcttgacctggtgatccgcctgcctcaccctcccaaaagtgctgggattacaggcatgagccaccatgcccggcctcttttgagtttttgatagggttatcatttgtttcagcaagtttaaccaagagtcatatgttgagatattttttaaaatattgagttctgtgtacttcagcaattttcaaacgctgtgacttgttcttatattctgtgaatggctcctacatggggcaacaggtgatatcaagaatttattttatacagttctaggtatactgtaggagttcaataaatgcttgttgaatcaattattttcagcagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtaagccaccaaaaggagagtcgtcacccatttccctctagatgcagatgattgacttcgtgaatccaattcactaaaattagatatacttggatatcagaaaggaattttcaggtcatccttaaatgtaataccatcattaattttgcttcacttgaggtgttaatgaggacttgatataaatactctggagtattgtaacatagatgatgaggtagcgtaactctgaacactttttgaaaagtggttattttataggctgtgggctatgtaagctgaattatttcttttttccttgaaatcagacatagtattgccaattttaactggatctcaaggtattgatgggagtcttttggatttcaaggtactgataggagtcgagaagacagtccagagctgaacccacccccaggcatagaagacaatagacagtgtgcgttatgtttgacttatggtgatgacagtgctaatgtaagtactttg

SEQ ID NO: 9440 - DNA, 1054 bp, Homo sapiens
tccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaa

SEQ ID NO: 9441 - DNA, 1033 bp, Homo sapiens
ggcccagtaaaaatacagaatccactctgaggattagtacagaaagttgctcttagaaggtttgtctgagtggctcctagtatcagaagcaaatagctatacaagttttaggtttctctctcctgcagagacattagaaacctctagactagtggcctgtaatctaggaaatcctcgtggaagcatcttgaaagatagtactgggagaaatctggaaattttactagaagaaactttctcagccgctataggtaacatcaagagaagattgggacatgttcttaaagctgagtttataagaaatgacaagttcttctcccttcttctgcatgtgcagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatgg

SEQ ID NO: 9442 - DNA, 1029 bp, Homo sapiens
ttttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaa

SEQ ID NO: 9443 - DNA, 2052 bp, Homo sapiens
ggcagggagataggttctttgcccagggacccccagcacccaccaggcaggtggtccgcaggacatttagcagacacttaagcactttgcaaatatgaactcatttgatcctctgagtaaccccatgaggtcattactattgtcgtcaccattttacaaataagaaaactgaggcagaaagaggtaagcaatctgcccagggtgatgatcccgctggtaagaagcagagccaggattcacatctgggcatttggctctagtatttacactcataatcactccgaaatgctgcctctctggcagacccagccatcctgttcctcagcatcccctctgaggagaggcccaggcccctggctcccatctgggtttgggaagaaagggctagaagtatgaggggctgtggtgagagcatattggcctctgctttgtaccagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggtgagcatggccagcaagcggccctgcaaagcttcaggtgggctcaggggtcccgtccccatacagaaatgggaatacttgttgccctgtggttgggtcttgtggatgaactgtccccagccaccctgggcaaggagggcagagtagtacctatggcatgttggggctggggcactacccacttgggacctgacacagaggacatcctccagggcttctggctacccgggtggaagtgccactgctgggcattgttgtggctgctgggcttgcactgggcaccctcgtggggttcagcaccttggtggcctgcctggtctgcagaaaagagaagaaaaccaaaggtaggccagggacactgggggcagtgtggatgaggtcaggctgagcagcagccaagacagcaagtgcagctgggcagaaccagtcatctctgacggtggcagagcacttccagggggtggccatgggtacggtgacatgcatcccaggtagcagggtcaagcactgggaacccagtctctggccccagggccaggcctgggcatttgagagaccccttgcctgagggtcctgggtctgaaagggtaggacagcccagcgtgggagggcacactgagaattagggacatggtttctttctccacaggcccctcccggcacccatctctgatatcaaggtaactcttccttgggctgggtggacaagcctaaccgaaatgcaggatggggacaggagggagcctggggtttctggtagaggcagccatgagtgcctgtgccgggactcatatccatcccgaactttgtcctccctgtagtgactccaacaacctaaaactcaacaacgtgcgcctgccacgggagaacatgtccctcccgtccaaccttcagctcaatgacctcactccagattccagaggtatatctagggccctgctctttgcccctgcttaatctccagaagtgcttctgagaaaaagaacttggtgcttgggaggggcgaggcctcatcaggcacactcctcgtcctgaacactgccctctttgtcaaccagcagtgaaaccagcagaccggcagatggctcagaacaacagccggccagagcttctggacccggagcccggcggcctcctcaccagccaaggtactggggaaggggcctgccaccctcctcctctgccccccagccctgtgcttatgccagaggcctccaagtgcccaggaggcagagagagctctccaaattccaaggaacaagcgttactgagtccccgcgggcttctttgatcccgcaggtttcatccgcctcccagtgctggg

SEQ ID NO: 9444 - DNA, 1050 bp, Homo sapiens
caacatacgtttgttgaaacagagagtgtaagatatgtctaccagcctatggagaaactgtatatggtactgatcactaccaaaaacagcaacattttagaagatttggagaccctaaggctcttctcaagagtggtaagagtactgctataatactgggttccactttttgttttacattttatgtgaaactagtttttcctccaaagcagctgatgctaaccagtttgcaggttcctactccgcaccccagcgacttattgctgcagcaccttgtttattcagcagacatttattgggtgtcctcttagactatagatgtctcaaaagaatatgggaactactgtttcatttcccagttcttaagcagttgttctaatctgccgttctagttctgacacttgtttggctatgctttttaggtaatgttttttaggtaagacttactgatccagagacagacacacacacacacacccctcttctaagactttatgccaaagtcttgcttaaaatgaagacttaggtaagacttactgatccagagacagacagacagacagacacacacacacacacacacacacacacaccttttaagactttatgccaaagtcttgcttaaaatgaaggctaaggccaggtgcggtagcatgtgcctgtagtccaagctactcaggaggctgaggcagaaggattgcttgaggccaggagttcaagtgcacaggcattatactttagtgtgggcaacacagcaagaccctgattcttttttttttaaagacggagtctcgctcttgccctggctggagtgcagtggtgcaatggtgcaatctcggctcactgcaacctccacctcccaggttcaagcaattttctggcctcagcctcccgagtagttgagattacagatgtgcatcgccatgcctggctaatttttgtacggggtttcaccatgttggccaggctggtctcgaactcctgacctcaggtgatctgcctatcttggcgtcccgaagtgctgggattacaggcatgagccgctgcacc

SEQ ID NO: 9445 - DNA, 1076 bp, Homo sapiens
ttatttatttttttgagatggggtttcactctgtcacccaggctggagtacagtggtgcaatctcagcttgttgcaacctctgcctcccaggttcaagtgattctcccacctcagcctcccaagtagctgggactacaggcatgcaccaccacgctgggctaatttctgtattttggtagagatggggttttgccttgttgcccaggctggtctcgaactcctggactcaagcaatctgcctgcctcggcctcacaaagtactgggattacaggcgtcagccaccatgcccagccatcttttgcagtttaaatatttgaagccagtatggaatattttgattcatctcttatctcagggctgtggtactggttggtgacatttttaagtggtagttatcaagttcacatattcgtgactcagatttctcgtcttgaagccagaccttctactgttgctgatggttttgaggtcaagtgaaagataataccaggaggatacctttatcaggtgtgcataaaagaggagtatttactctttttctttcttctttcctttctttcttcctttctttctttcttgacagagtcttgctctgtctcccagactggagtgcaatggcacgatcttgcaacctccacctcccggggtcaagcaattctcctgcctcagcctcccaagtggctgggattacaggtgcacgccatcacacccggctaattttcttatttttagtagagacagagttttgccgtgttggccaggtgggtctcgaactcctgacctcaagtgatctgcctgcctctgcctcccaaaagtgcttggattataggcgtgagccaccgtgcccagccaagtatttactctttatatgccctgttctgtatgaaatgaacagggttacattgggataaatttcttgattcactaaagccgctgtgctcttcctagtggttgctttgagtgagacagaggcttcacacttttaaaaagatattcctgagtgcagtggcccacacctgtaatcttagcactttgggaggctgaggtgggcggattgcctgagctcaggagttc

SEQ ID NO: 9446 - DNA, 1033 bp, Homo sapiens
caaaaagctaaaaaaactatcagtgtaaatttgtgaagttaataatggtactgtgattgattatgtaagagaatatccctaatcttataaaataagcactgaagtatttaggggtaaagtgccgtgttgtatataatctgcttcttaatggttcagggaaaaaaaatcaaatgtataacatacatatataatgtttagagagagagaaacacaagtgcaaattataaaacaaatgaggtaaatattaacaataggtgaatctggaaaagggtatatatgtcttccttgtataattttaatttttttaagcttgaaaatacttacaaatagaaagttttttcagttgtttgttttctcaccattgcctactattcattcgggtggatatgcctttattttttattttttatttttttgagacagagtctcactctgttgcccaggctggagtgcagtggcaccatctcggctcactgcaagctccgcctcctgagttcacgtcattctcccacctcagcctcctgagtaggcgcccgtcaccacacccggctaattttgtttttgtatttttagtagaggtggggtttcaccatgttagccaggatggtctcgatcttctgacctcgtgatctacccgccttggcctcccaaagtgctgggattacaggcgtgagccaccacgcccgtgaatatgcctttatttgagcagccccctattggcagacatgtttctaaacttttgccattacaaacaattcttcagtgaataacttagcagattgttttgcacaggtgagaatttatctgtaggatagagtctgttgaagaattgctgtatcaaagggtatcgccttttaaatgttgatagctatagcagtagcacctttaaaaaaacgttgttgatggctaatcattagaccttggagaaagggagttctgatttctacctttcttttttcttttcttttcttttttattttttgagacagagtttcactcttgttgcccaggctggagtgcagtgggacaatct

SEQ ID NO: 9447 - DNA, 1049 bp, Homo sapiens
aagagggaggggagctgcaaagggttcgggagccccgaatgcctggtaaggagtttgtgctttatcctgtgtgtaatgaggagccactgaaagattttgaggagaggcatgatctgaccttacttgtggatttttaaaaaattattcaagtaatattcctttttagaaagtaatttttctttttagaaagattagaaaattcagataagcaaacaaacctcaaagtcatcttaggaagatatttgtgacagtgtggagtggatcaggaagttgagagagtggaagcaaaggctggtgagaaggtccagaccagggaagcagagggcctggatttgggtggtggcaagtggggttgggacagggagaatgaggcagatggagtgtctctaggctttgggacccattggttgtagggtaagggaagggagatttgaggatctgagtggtgtgcctaatggcacaggggtcattggtcaagggagggagggaggcccgagggaaggagcccacatggcagcctgttttcttagggtgagttgaggccaagcagaagagctggttgatccccttcacctgagccttgagtgtctgggcaggagagccagctagttctcaccttgggctcagccctgtctccccagggcctgatcaaccaccccatctcctttaggagcgcctggccatcctggacagtcaggctgggcagatccgggctcaggccgtgcaggaatcagaacgcctggcccgggacaagaatgcctccttacagctgctgcaaaaggtagggtccctgaggttgggccgggagatttggagtagggtaagtgggaggggagtgcagaaggactggggtgtaaatgtgctggggtggagcacagggcccccctcacacagtctcctggctcccactcctctttgactctgccattctgggctcgcaggagaaggagaagctgactgtgctggaaaggagataccactcactcacagggggcaggcctttcccgaagaccacatcgaccctcaaagaggtatcatgattggattag

SEQ ID NO: 9448 - DNA, 1440 bp, Homo sapiens
acaggcatgcgccaccatgccttgataattttttttttaatggtgaaaagatatacatatatttagaattagccaactggactcagttgagatgatccctattttgttggcaacatccaaagcattgtaatcaggagccagtcgaacatgttccttctctccatcaggccgaatcagggtgttgaccttggccacatcagtgtcatagagcttctctggtgctgtggcttaacattcacagtgaacacaagtgcgtgtgtcttctgtcttcttcatggagactcagtggtcagaggaaacttgatgatgcatagtggtcaagcttgtttctcctgggggtgctcttaagatatttgcactgcctccggagtcgcaatgtcttgggccgccagaaggctagtgatacgcggatcttcttttttttgtggctgtggacacctttcaacactgccttcttggccttcagagccttgctttggctttaggaggggcaggagcttccttcttagcttttggtgccatcttgtgaaaaggggctgatttttgtatttttcgtagagatagggtgtcaccatgttggccaaactggtctcgaactcctgacctcaaatgatctacccaccttggcttcccaaagtgctgggattacaggcgtgagccactgcacccggccaataattagaaatatttctctctcttttttttttttttttttgggagacagagtcttgttctgttgcccaggctggagtggcatgatcttggctcactgcaacctccacctcctgagttcaagcgattctcctgcctcagccttccgagtagctggaactacaggtgcatgccaccacacctggctaatttttgtaattgtagtagagatggggttttaccatattggtcaggctggtctcgaactcccgacctcaggtgatccgcctgccttggcctcccaaagtgctgggattataggcgtgagccaccgagcccggcccaaattagaaatatttctaatcagatatttccatggttatagatatttggttgcttggttcatatgcatagaaacagttgtcataactgtaaaaagcagtacttagcaagtatttctaagtgattggaatagctttcctttaatgttacaatactgcctattgatttggaaattagatcacgctctatgatgtttcgattttactcaaaggcatcatgagtactctgctcattctttcattctttatagttttctagttgagttaggaactattttatcagaaatcattttagcattataataagggtagatgacataccataatgattttcagattttttttttttgagacagagtcttgctctgttgcccaggctggagtgcagtggcacgatctcagcttactgcaacctccgcctcctgggttcaagtgattcttctgcctc

SEQ ID NO: 9449 - DNA, 1116 bp, Homo sapiens
accttgtcctcccaaagtgctgcaattacaggtgtgagccactggtcccagcctgattttcagatttttaataaaaagggtatctggattagctgggcatatagtcctacctactctggaggctagcctatagtcctacttactctggaggctaaggcagggggatcacctgagcctgagggatcacttgagcccaggaggttgaacctgcagtgagctgtgatcccaccactacactccagctgggcagcatagcaagaatgtctctttaaaaaaaaaaaggcaattcagttgcagtggctcatgactgtaattccagcacttttggaggctgagacagaggatcatttgagcccaggagtttaagaccagcctgaacaacatagtgaaaccccatctctaaaaaaaaaaaattatattagccaagcatggtgacatttgcctgtagtgctagctactggggaggctgaggcaggaggattgcttaagctcacaaggttgaggcaggagtgagctgtgatcacaccactgcactctagcctgggcaacagagcaaaataccctgtctcaaaaacagcaagaaaaaaaaagccaatacctggaaactttgaacagggtgaaaagaagaaaacacggaggagtctgctaaagcacaaaacttctctctggtcctcaaataaataaaaatttttggccgggcacgatggctcatgcctgtaatcccagcactttgggaggccaaggccagcagatcacgaggtcaggagatcgagaccatcctggctaacacggtgaaaccccgtctctactaaatatacaaaaaattacccagacgaggtggtgggtgtgtgtagtcccagctacttgggaggctgaggcaggagaatggcgtgaacccaggaggtggagcttgcagtgagccgagatcatgccactgcactccagcctggcgacatagagtgagaccccgtctcaaaaaaaaaaaaaattttttttttttacaattccacattgtcattttcttttcctctggtctcaaactcctggtctcaggcaatcctcccacctcagcctcccaaagtgctgggactacagacaagccactgtgcccagcca

SEQ ID NO: 9450 - DNA, 1052 bp, Homo sapiens
tagaaatttctggacttcaaccacactgtaattttttttttttaatcagtttcttctatttccttgaactcagtttccaggaacttctggtttggaaattagagacctgccttccaggttagtctacagaaagtctagttgtgttccactgtgtcttcattgtcctgcacactcatgtgatacactcaggtgttgtggattatgagacccagagagaaacttcctggtgataatcgcacaaagtataggaaagaaacctggcagtctgtacagtccattattattatgtgcttagtccatttggttaaataatttgagatgcttttttttttttttttttgagatggggtcttgctctgtcacccagactggagtgcagcggtacaatcatggctcactgcagcctcaaactcctgagggctcaagcaatcctcctgccttggccttcagagtaggcaggattttttttttttttttttttttttttttttgagatggaatcttgctctgtcgccaggctggagtacagtggcgtgatctcagttgactgcaacctctgcctcccaggttcaagcgattctcttgagtagctgggactacaggcacaggccaccacacccaacctttttttttttttttgagatggagtcttgttctgtcacccaagctggagtgcagtggtacgatctcggctcactgcaagctccgcctcctgggttcacgccattctcctgcctcagcctccctgagtagctgggactacaggcgcccgccaccatgcctggctaattttttgtatttttagtagagacggggtttcaccttgttagccaggatggtcttgatctcctgacctcgtgatccgcctgcctcggcctcccaaagtctgggattacaggcgtaagccaccatgcccggcctaatttttgtatttttagtagagatggggtttcaccgtgttggccaggatggtctcgatctcttgacctcgtgatccacccgcctcggcctcccaaagtactgggattacaggcgtgagccactgcgcctgg

SEQ ID NO: 9451 - DNA, 1025 bp, Homo sapiens
tattttgagatggagtcttgctctgttgtccaagctggagtgccatgatacaatgacagctcactacagcctcaacctcccaggctcaagcaatcctcccaccccagccttccaagtatctagggctataagtgtgcaccatcacacctggctatttctgtattttttgtagagacagggtcactatgttgcctgagctggtctcaaactcctgggctcaagcagtccttccactttggcatcccaaagtgttgagattacaggcatgagccactgtgcccagcctaatttttacttttgaaccttgtaaattgtcaaacatacacacacaaggcaattccaaggtttggttgatttgactggtaaagataggaggaggcacttttagatttagatggtttcttacatagacagtgaaaagaaaaggaagaccaaagagccagcttctcaggtccttgtttcatacaccaaaaaggacaacactgaaacaaaaaggactggatgaccccagtgtgagttgtgggatattctgttgctggggaatcaaatctagactgtagtagctaagtggcttttttgttgtttttaaattttacttattgaaggggtggcctgcccctccacacctgtgggtatttctagtcgggtgggatgagagacggagaaaagaaataagacacagagacaaagtataaagaaacaacggtgggtccaggggactggtgctcagcacaccaaggacctgcaccggcaccggcctctgagttccctcagtttttattgattattatttttcattatttcagcaaaaaggaatgtagtaggacagcagggtgataataaggagaaggtcaacaaattacatgtgagcaaaagaatgtatatcacgattaagttcaagggaaagtactatgcctggacgtgcacgtaggccagacttatgtttctctccacccaaacatctcagtggagtaaagactacaaggcagtatcactgtaaacatgtctcgcctcccgccacaggg

SEQ ID NO: 9452 - DNA, 1047 bp, Homo sapiens
gggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcagggaagaaggggtgtgcagagaaaggatggaagagacaggaggctctggagtatgaaattgtagcaaaaaactcaatcaactagtacaggttagtcttcattcccctttctggaacaggctgctccttctaggatgtaatggagatcaaagcttggaccctgtaactagactgcctgcctgggtttgagtcccagctcttctaattacttgtgtgaccttgggcaagttatgtaacctctaagtgcctcagttttctcatctgtaaaatgggaacttcaatcatcatggctatcattt

SEQ ID NO: 9453 - DNA, 1039 bp, Homo sapiens
tagatcacctgaggtcaggagtttgagaccaacctggccaacatggttaaccaagtgtggtgccgggtgcctgtaatcccagctacttgggaggctgagacgggagaattgcttgagcctgggaggcagaggttgcagtgagccaagattgcgccactgcactccagcctgagcaacagagactccctctcaaaaataaaaaaataataataacaaaattaaattaaattaaaaaataaaaaatttttaattttgtagagatggggtctcactagtgatcctctcactttggcctcccaaagtgctgggctacaggtgtgaaccactgtgcccagccaactttttatttttataggcaccaaagcataagggctaagaacagggatttggtaactcagctatttgagttcaaatccaggctctgctacttattagctgtgagactttggacaggttacttagttctgtgcctcagattccttatctgtgaaatggagataatactagaacttatatcactggcctaatatgaagatgaaatgaactcatcctcagggtctaggacatggtaagtgctatttaattgttttttgtttgtttgtttttttgagatggagtctcgctctgtcgcccaggctggagtgcagtggcaccgtctctgctcactgcaacctccacctcccggatttaagtgattctcccagctcagcctcccaagtagctgggactacaggcacctgccaccatgcccggcttatttttgtatttttagtagagacagggtttctccatgttggccagactggtcttgaactcctgacctcaggtgatccacccacctcagcctcccacagtgctgggattacaggagtgagccaccacgcccggcctatgctgtttaattgtttgtcacacatagaaacagacttagttccagaccagcctggccaacatggtgaaaccccatctctactaaaaatacaaaaattagccgggtgtggtggcacgtgtctgtaatcccagctactcgggaggctga

SEQ ID NO: 9454 - DNA, 1029 bp, Homo sapiens
gaattctcagcctaggtaatggagaaatactacacaaataattatgcaggtctgtgactgcctgaatgggtaacacatagaagtagttgagttggttttaattttatgttagtaggaatggaaagttgacatttgatttaaaggtatagtttatataaaaggttgccatggatgacgttgtactatccctaactctgattgatttgcttacctctgaaaaatcatttactgatagtaatgaaaatgagttggaggcagtaggtcctttggagaacctgaagatcatgaaagtttgtgggcaggtgggagtttggaagaaagaagactggggttaagtggagtttgggagtaaataagaggccgatcttgccaaaagctgtagcatattaggtaaatttatatgtgggataataggggaaaaagccactagtttaactttttaaaacatgaagcaaagtgaaatgacattttctttataggtaaaagtaacttttcaaataaaataggtagaggtgaatgcagttaattcaataaatatttgaaggatcactatgtattcttttatattaattttattattatttttttgagacagagtctggctctgtcgcccaggctggagtgcagtggtgcgatctcagcctccaggttcaagtgattctcctgtctcagcctcctgactagctgggattatagatgtgcaccaccatgcctgattaatttttgtgtttttagtagagatggggtttcaccatcttggccaggctggtctcgaactcctgacttcaggtgatctgcccgctttggcctcacaaggtgctgggattacagatgtgagccatcacgcctggccctcttttgtgttaattaaataccagaaactataggctatcctgcatattgttagcttagctgtcgtaaattacatactgggagagaaataagttaactgtatgtgtggatgtaattgtgttttattttgttcaatttgaactaaatattaactcatctagaatgagtaataaaata

SEQ ID NO: 9455 - DNA, 1040 bp, Homo sapiens
agtctcgtcctgtcgcccaggctggaatgcagtggtgccatcttggctcacggcagcctccgcctcccaggttcaagcaattctcctgcctcagactcctgagtagctgggattacaggtgtgcaccaccacgcccagctaatttttgtatttttagtagagacggggttttgccatgttggccaggctggtctgaaactcctgacctcaggtgatcctcccacctcagcctcccaaagtgctgggattacaggtgtgagccaccacgtctggctgcgagtattttttgagaacttgttctcagtagattcatggtgagcatcagtgacatcatttagactggaattcatgggtagaagtaggagcaggtacacagttctcctattctcttggtgtcctgtggagtggcgtgcttggattggggcataggtggatgtaccatgagactgggctccatgaaagaattctgcctgccttcccctaaccttctttatgggattgagcgtgataagtgaagttaaaaagcgtgagtttgggtactgactttacaggagttgctgacaactagtgccctggtacctagagactgtgtggagcttcgggaaggtgctttggagaaactcctggccagagggagggaggagccaggagccccagatcctcattagctctttgctaagcaatccagaaagaacaaaaagatcagttggccaaatttggtaatccaggtgagatcatgatggcttggactaaggtaacaactcgactaagatggagataaaaagctgttggcactgtgagatgattatatgttttttccctgtattatgttactgcagtgaattgttcataaatttgcaaagttaaaccatccttgcataaattctagtctgtaattatatatttataattatataaaaatacatattttactatttctctggattctagtaatcatttaggactttttccatctatattggtaagtcaagctagtacatataaattttttcatggtctttgtctcattacggaagtaa

SEQ ID NO: 9456 - DNA, 1100 bp, Homo sapiens
tgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatactt

SEQ ID NO: 9457 - DNA, 1063 bp, Homo sapiens
ctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgca

SEQ ID NO: 9458 - DNA, 1038 bp, Homo sapiens
attcactccgacacctgtgcaacgtggctctcaagggcctggtgctgtgtaggggattgggggaaccatagggatgaaaaagactttgcccctgcattccagaagctgagaactaatgggagagacaggaataatcctacgtgaaacaaagttaaataacaaagatgagacaaagcacaagaggtgtgggcaggctgccggtgataaatgcccagcgagcaggacagataggaagtgcttccagccccgccagagaagcagtgggctgtgtggtccagggaggtcactgccaggcttggggccaggaggcaggcagaggtcatggccgtggctgtggaggtaaccagcctgcaatgaggcccgctgcgcctctttcccccactgatgtcctctccccatggcctggtcttgggctggtttccagaggctgctcctgactgtgatccagggttcaggcttttgaaaggaagggtgggctggagggtgtctgccgcctgcctgggactgggactggggctggcaccagccgaggccccctggaatctgacctggcccttgaccagagaaggttccagggatggtgctgtgcatggacatcgcagagcgggaaggtgccctgagccaagggcacctggacccactgagcattggttggggtggggatgggggagctcgtaccactgggatgggaggtcctcccctgggaacaggggtcagttaggacacttctgctggactctgaagatggggagcatgatgacggacgtcaccaccctgcccggcaaagtcctagtgtaacttctgggaaacaaaactgccaagagcctgtgaaagccgctacatctaggggatgagaaaaaatgcagaggtcgtgggcacagtttcctggtgagacctccagcaccatgtccaatcaacctgtggcccactttcctccaatgcattttccaggttatgcccaggcaggaagctgtcaggatcttgggttagcatgggatgagtcttggggagggtggaatggctccaacaccctccaac

SEQ ID NO: 9459 - DNA, 1052 bp, Homo sapiens
cagacgaggcaccccagggccaggcgtcgggggagatgggaggtgtgggtgtgcagggaagcatatgagagagaagggaaccatggagtggtcaggcggatggggggagagagagacgcagaacaccaattactcagtgacaacagaggaaacaggtttagaaaaggtgtttacaaaaattagtcacaaaacatttacctgctgtgctaagctgtgtcctcttaggccatgggcatgggtggacagaggcagggtgggtcctactcctgaaccccctgtatttgcctccgagacgttatttgtgctaaccctttcattttgcagagggaagagagatgcctggagaggggacatgctgtgcaggggggcatggggaggctcctggggcataaaacagaacttggagtcaaagggcctggctttaaagttttgccggacccccctgctgtggcttgacaggcagatggctcaacccatctgagctgagtttttcttttgtgaaatgggaaaatagaacttataagcatatcactatggttagaacccagggctccaactcccacctctagctattcagcggcactgcagttctttgactcttagtgtgatttgcaaattattagaataagagtgctccaaggacaggggctgacatgaagttgagtagcagaggctctccctccctctgctgggagttgcagatgtgcgaatggggacccaggagacagggagctgggagagggaatgggagtggctggtgggaagaactggggtagagaaaatgctgtggtccagaagcaagggtgggtagctactgacaactcaccctgtggctgtgccaagctcctttccctcccagggcctcagtttccccttcagcaaaataggagggtggcttgatgatccctgaggtccttccagctcttctctctagatctatcctcacaagctcctcctcctcagctcaatgctcagtgccagtgtgcaggcagatagatcatctgtccacagagcaggggctgagggagaggagggctcccgcacgccgggag

SEQ ID NO: 9460 - DNA, 1035 bp, Homo sapiens
tgaccagcactggacagtggtggctggaagcagggtgtggagggaaggggcagtctgctgccctggccccctttgctttccattctcctgcaggcgggcctccccccaaaccccagggctttctggggaggggctgaggaagagcgcctggagagtggggccagctagggaccgtgatgggaaggcagggtgccagaggagaccgggcaggctggagcaaggtgatgacatgcggtaagagtgtgtgcctgcacatgcacgcatgtacacgtgtgtgtgtgtgtgtacacacgttatgagaagtggcatcgggaggaggcgtgtgaggagaatcgagcaagtgaggagggtgatgcggggtgtgccctgacgctgggcatgagatggggaattcacagggggggtgggcgtggggactgcggagaggggtgtgatgagacggtggggagccgcctctgccggcaacagggagactgagggaggagacaggcccagatgcacccctgtggagggaatgggaatgtggaacaggagccactgggagaccttgcgggaaggagactgagacccagcttgtctgtgaaagaggacggtgtgcgcgaatggggaagccgtgtgagcctgtgcatcagttgagattaggctcagccgtgagcaacataaacccccaggaacagcggctgaggccgtggcaaaacagcctgtttcattcttcccagtgttatctgagtctggaagccagtcagggctggtgtgacagccccgctatcccctgggatccaggggctccctccccaccctcagtgctgagcacaggatgtctgcccaggggtgctctgccgtctctcagcgcattcccccagtgcagctgaaccagagcagccttccctctggagacacaggtggatcccagtcagacagcatggctgggatgggcacagggaggaattgagtatctggacaagggctacggaggggagccaggacaagcatgaagatcactggactcagagtcaggaggtctaggcttctggc

SEQ ID NO: 9461 - DNA, 1258 bp, Homo sapiens
atttcagatgaaagctgtacagaacttgaccttcatgaagccctctctggatagcattcttgggaagtggcttgtgtattgacgtccacagataactatttcactggtcagaataaggttaagcaataagcatagccatgcagaaaatgtctgctgagatgaagtagatatctgatatgtttttgactttttatttgtacgtttcaatggaggagctaatgaatactaactaataacaacatcttgctcatttagattttagtcctgtgtgactaaattgactcagttatagttgttcttgtcctaacgtatttgtcaccagtaaaagttccaaggtacagctttctggcttcatttcatttttaactgaataattgccttaaggatatttttagatctcaacaaaaactcccctcctcttgaaccttagaatccttctgcttcactcttggcaaatctttgggtcggatttcagaactgaataaagccaggatttccccccaacctccaagatgtctggactctttgtttagttctgtatttaagtttatcccaagttttgtttttgactgatgaacctgtgacccaaatccaaacctcagctgaatttagtatcagcttaaaaccacattaaactgccatgtgtcatgtgacctctagcagaaaccaacgtggcagtgttctgttttttcatgagtgcgtttcattggggtttttgaactgtgaagacattatttaatacatgtgctttattttctgtgtattattgcccaaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattg

SEQ ID NO: 9462 - DNA, 1997 bp, Homo sapiens
cccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgctt

SEQ ID NO: 9463 - DNA, 1033 bp, Homo sapiens
gacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatc

SEQ ID NO: 9464 - DNA, 1034 bp, Homo sapiens
aaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgc

SEQ ID NO: 9465 - DNA, 1049 bp, Homo sapiens
aatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaa

SEQ ID NO: 9466 - DNA, 2038 bp, Homo sapiens
tccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaaca

SEQ ID NO: 9467 - DNA, 1919 bp, Homo sapiens
gttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgactt

SEQ ID NO: 9468 - DNA, 1042 bp, Homo sapiens
gactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaag

SEQ ID NO: 9469 - DNA, 1053 bp, Homo sapiens
gcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcaga

SEQ ID NO: 9470 - DNA, 1032 bp, Homo sapiens
ttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgct

SEQ ID NO: 9471 - DNA, 1513 bp, Homo sapiens
tgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgt

SEQ ID NO: 9472 - DNA, 1053 bp, Homo sapiens
ggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggt

SEQ ID NO: 9473 - DNA, 1011 bp, Homo sapiens
ttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtagga

SEQ ID NO: 9474 - DNA, 1044 bp, Homo sapiens
tccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataa

SEQ ID NO: 9475 - DNA, 1065 bp, Homo sapiens
tagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccag

SEQ ID NO: 9476 - DNA, 1051 bp, Homo sapiens
gtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctct

SEQ ID NO: 9477 - DNA, 1050 bp, Homo sapiens
accaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaag

SEQ ID NO: 9478 - DNA, 1048 bp, Homo sapiens
tatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgt

SEQ ID NO: 9479 - DNA, 1044 bp, Homo sapiens
tctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcat

SEQ ID NO: 9480 - DNA, 1052 bp, Homo sapiens
cccactttggtgacaccggcagcacggaggatggattgcacttggacagaagaggactcccaggccatgagtacctgtgtgccaggcacttctcatggattacctgtgcaaggtagatgctcttacccgcactttacaggtgaacacatcgaaagttcagagatccgcctgaaatcagccagccagtatgtggccaaatgagggtttgaaaccaggactgtcttatttcaaaacttgtgctctttctaatacatgctactgtttcctgatgagattgccacattgcacaatgtggcaccaaggggcaccattcacatggtcatcagtataaatggcacctgggaattgaacagcatagtggctaggtatcctaagatcagaggcacgatctccattaaatagcagctattgcagaggagaaatgacgaggacctaacctggaggggttggaaaggaagggacaacttcgagagacatttaagagatagatttgacagaattggcagttgactgggtgtggagttaagaaataagggagttgaggctgtctctgaagtttctagcttaggtgcctgggagaatagtaatgcccttattggttaggaaggcaaaggggaaggggctgttgggcagaaaacatcacggaatgccacttcccctgcttacccatttgacctgggttaggagatgaacttgatttaagggtaccacctggacctgtgctttggtttcttgcttttctacttaaggtcaaactcagaaacaatctgggccattaaaagttcttgtgcttttagctgtagttgactaacctggtcctgtcctcaggattgactaaatcccacccccagtgatgggacttgcctgcttagcccagctgaacatgtccccggggccctgcttcccctagacctcccttgcagaagctgcccacaaggtctgcccaacctttcccttatccctccatgttcccagacaccagacactaaagctctacatttcttggcactggaccctgtgtggtataaggcatggtcggccccttgcagcca

SEQ ID NO: 9481 - DNA, 1049 bp, Homo sapiens
ccttgtcctgcggctcggcccagatctggcagcacggcaccagcctcatgaactacctgcgcatggtgaggagcggctgaggccctgcagggctgtgcccaggctagtggggtgggacacttggttcaaggtacaagagtccctcaactccaggcttgctcgaaatgtgtctgttattacagccccagataaatcagtgatctctggtgaccccagttgaatggatcatgagccacatttgttccctaaaccccaataaccactgagaattcatggaagtttgttcagaaggcaacagccctcgagccttacactattagtgggcccctgaattccagacttagcacctggcctctctgctcagcggtgttctcagcaaagctccacacagctgggaaagggtggtgctgctggagactggcatccctctgggagttgcaggctcaagacttctagcttggctgggtttcccattgttgtcctccccagccatgcttcctctggtgggtgaatgaggatctctaccctacacagaagacttctgtcagagaagcctgctgcagcacagtgtcttggactttgcatttagagttaggtggagagtcatcctgacttcctgtggacctgggggtgggtgagtgcctgcccggagaggatgaatgctgtggacagccaagggcctggaggaggggctgaggggaatctgagctcaagttagcaccatgactgggttggtttttgcagttggtatggggttattgggggagcattcttctcctactccaggccaagccaagtctgaattgtctccacagacatcacatttgtcatctcaagatgccttggctgtgtgtgggcaggagaaggatcttaactgctttgcctcttctgggcatccttaaatagcccctgtgtagaaatcttgcttgggggcaagtgtaacctggggcctgtttggtgctgtaactcactctctcttggacaggtagaattggaaggtcttaccggccacattgaattcaacagcaaaggccagaggtccaactacg

SEQ ID NO: 9482 - DNA, 1045 bp, Homo sapiens
gtggtaaactactgtgtaccaggcactgtgcgaggctctgaaattaccaaaaggattacaacctggccttgcccttaagaggtttagaagctagagagagacacagatagttgctgtaatggttgcagtatgggagagttttaatagcggtataaagagaatgtctggaagcccggaagaggaagtgatgaattctgtggaatggtcagggaaggctttaagggcacatggcctggacctggaagcatcccttaggaatcgctgctttaggactgttgtgaggcacaggtgttacactgagaactcggtttgaataggtaggatgaggttggacttaagggactgttgaaaaccgggtaaaggtacttggactgcaaccaatctgtctcacgctttttcacaggaggaaccaaaagcagaggagactaaatgggagctgctggggatctaggacattgtgtagagcagcctacttgttcagaatttcctggaagtcttctgttctgtcctaaaaatacatgtgaattttgcatcttactctgtaatacaggcatatttatttaatgtaagaatttttttcccacccaagccctaagtaaaatcagtgtcccaggaagatgccccatcatcatgccacagctttgtcagactcctcggcacaccaacagtgccctggactgggtttgggagcattggcaatagccgtcaaaggttctggggtgagatgtggcacacggaaagctggtgtggtgggatggaattctgagctcttggcggcattcatggtcccaggggatagttattgcctcaggagaaatcaagtcaaattattggctttaagttccaaaataagttcttaaagctcacagcagagataatgtccttggagagcgaggtttttgatttgccagagaagtattttggaatacagaaggttaattcctaataggatctggtcaaaaagttaatgctagaagttagagtgaaaaaaaagagaaagaaatagaagaaccaggccaccaagtctgcaaatcagataaaagga

SEQ ID NO: 9483 - DNA, 1050 bp, Homo sapiens
gatgattttcagaggcacaaaagataaagatacacatcagatagagagaaaagagccatccagaatactttggaactaaatttcaaaaagaaagaattgaggcctataagaaagtactggtagtccacacatgaatttcatggatctcttgttcagatgataagatgatagcgtggatgagggctctgttgttggtaattgagataaacaatcctgctatgagttaaagcctagaggactttttttggtggtacgggtgcagtacttctgaactcctcctgggcaataactggctgtctcctcttaggattcagtaccctttggtcccattatatcctgtattttctagatccttatgtaatttcacacagtttgatttttgtttcttgacacttcctgggggctgaacatatgtagacaagaatttggctgatatagaaaacattttgtgtctctcatcattcagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtgaagtttttatattgctacattttagtgaaaagcagcaataaccattgtgtcattgtttatgttattatatgttctgctaaattctgttctcacttgatgtctgtatgacttcttgttgtctgtatatcttattgtctgtatgtctttatatcaagataaataaggcctataatcccagtgctaaggaggctgaggcaggaggatcacttgagcccaggaattcaagaccagtctgggcaacatagcaagaacccatctttaatttaaaaaaaaaaaaaaaaaaaaaaggcaaataactgactctatctatggtgatttttcgttagctttgttattgttattgttgctttgttattgttaatttatttttcattgttcatttgttttcatcaatcactaaggaaatttaggcatcaagaggttgattagtctttgtcagct

SEQ ID NO: 9484 - DNA, 1050 bp, Homo sapiens
catatcatgtatctttgggaactcaatgatttctttttgtttttgagggcagtggtaggaagtaaatgcattgatttagggtgccttttcagactttaaaattttgcttatcataaggaggagtcttaaaatagctccagtgaacaattatttgatggaaagaggaagtaccattgtcagagacggtggcaatgccagaaacaggttttcttagaggcttttctttgccttttcttttctttggtaccttattttctgtttgtcccaagtaatccctaaactatgtcctgggaaatcctttatgatggcaaggattacattaggaattcctcaaatgctgatttgattgtcattagtggtatgctttttaaaatatggagagtatgtttttccctgcttaagactaatggcttttctaaatagagctgattgtatctccatgttattgtgagagcaggcagcagcctgtatttggacaccacctcaatgaaggcttattttgtcttggatgctggagaaatcttagtgtgctgtgtccgttacctcatattccttccagacagaggacctgctgttgtgaaggaacatttctatactggacatgagtctcctggggttctccatattgccatgctccatcatcctctgacaagggccgtgacacagcactcctagcactcctcacattcagccgtgagtctgaggagaaacaaaaggggcattctccttcgtgcaccatggagagcctctgaaatgttagctttccctgttgcttacagcctttgtcattccagttaccttggactttattttgacttcttgccactttcccagcccagcagaaggcaaactaccttcctaatcttgattggagtcatatacaagtatttggatatacttggaaaggaaagagagagtgagagccagtcctcccaaatcatgggcttggaggaaattttctttgctgtctgaacttttgttttggccagggcaaggggccagttttatctttttcgtttttgtttgctttttgtcagtaaaacaatacta

SEQ ID NO: 9485 - DNA, 1030 bp, Homo sapiens
aagtcagtgaacagagtagactggccctgaatctggtcaatacttcaaaatgatggatcggctccattctatggagaaggtgatggcagactctaaattctcctagctgtagaacacattgtgttttaaccaacttttgtttgattctgatggaaagctgtagtgaaaattaggaaatccaggtctcactggggtgtggtttctgctgcagagacacaacccgggacctgcatgcatctttagcgttgggtcctagttttcagcgctttatttgatgcagaggggatacctttcctttacgcataccactctcactgatcctaaataattacttgacagtttgaatgatctcattacacttccagactggcttcttctgggcatctaatttgttcatgaagtgttgaacttcggaggacctgccagcattcaggggatttcagcccgactcagcactgttgatgttgttatgtgaatttgttctatgacggttttgatggtcttgggattagccactaaacacacctggtgttctgtttactctggcaagctggggatttttttttcattttctttttaaaattccaggatgaattattcatcattccttagaatttgggtctctttcatcttcgcacttgtacagcaccaaggtgagtactacagaattccataaagctctcagttagcatgctcttgaattgataaagagacacttttattggaaccacaattgtaagggcaggtgcatgtgtgtctacagatacaagagaaaaatgtaattaaattctattatcaagggtaaaattcattaactttaaatgaggtttacttatattcccacttttttcttatttaacttcaaatactatttgtatgtaccagcttgccctgtgctagtggagtagatctttaaaattacgcaaaattatttccattaaaagtagataagataggggtatgtgcacttcatgtctgatcactgatttccattaaggcatttaatttgtggtggagactttaaagaatc

SEQ ID NO: 9486 - DNA, 1032 bp, Homo sapiens
ttgcccagattaacctattaataacatttgttcatttgttttatcattccctccctttccctgtctcttccttcctccctccctgcccttcatgtgagagtgagttgcagacttcatgcctcattacccgtaaaacttcagtatgtatttccttagagtaggggcatttatatacataaccacagtacagttttcaaccttaggaaatttaacattgatatagtaatttaacatccatattccaattttgtcagttgactgagcaatgttctttacggttcttttggggtgccaggatggggaactcagtacagacctaatttagaatcacacgttgcatttcattgtcgtgtctctttagtctcctttaatctggaacaatgacttagttttctttgtcttttctgatatgggcatttttgaagaacacagcctccctgccttttgaaacagaatgatcctccataaacagaatgaccctccattggggttgatgttccatcctgaggatcttcagctgtgcatctccactcagcctcccgggcaggtgccatgtggtttttctcatggaatcacagcacacacggaagcacgatcttgtccagcctcccctcattggtgatgtgcatgttgattccctggtcaaggtgttagcaaatgtctctgctgcagagtcactgtgagctttcccttgcaactaataagcaacccatggggaaatactttaagagtgtgcaaatatcctgtctgtcagtctatctgtctgtctatcggtcatcttatcaatctggacatggatgcctgttttttccagtggtctatatttcatctatatttcatcttccatgtattaattatttttggtgttaaaattgctctggattggcctgtaggatctccttcaagctggctcctgtgtcccttcagcatgcctctgtcattttttttgagcactttcttccttttggcataacagggtgcttcgcgctcatcttttaatcttccctgccccatgctggaatcagcttgact

SEQ ID NO: 9487 - DNA, 1082 bp, Homo sapiens
ctaagcagatttttatcaaagatagagaaaatgatcttaattctgagatatttggaaaatactatcagaaagaaaacaatgaatctctcagatttaattcagtgagtaaaaatctactggaatcaagaactaagaaataaaatataaacacaggattgccctgaggaaaaaagtttgaatttaacaaagtaattccttgtagacactaaaccaatgtaaagcaagcaaccaagggctttgatgccactgcctttaaataaacacatgatttcataaatggaaaaaaagctaaactgattaccttgaaaaatgagtaaataaatattagagcaaatccatagatgtattagctcgttcttgcactgctgtaaagaactacctgagactgggtaatttataaagagaaggtgtctaattggctcacagtttagcaggctgtacaggaagtatggttgggaggccgcaggaaacttacaattgtggcagaaggcaaagcaggcatttcttcacatggccagagcaagaggaagagagagagcgggaggtgctactcacttttaaacaactagatctcatgagaacttactatcatgagaacagcaagggggaaatctgcccctatgatccaatcccctcccaccaggtccctcctccaacactggggattacaattccacatgagatttgggcggggacacagacccaaaccacatcaataggatactaagaaacaccagtaatttcccccgaggatgctgcgaaacaagttccttggccattcctttagctataaagtcccagttattaaggacattaaggttccattttatttttgcatttttgtgtgtatgcgtgtgtgtgtaacttaaagcttcagggtaaaagttgatgaatcttaaaatttttagtatttagctctaaaattttattctccaaaacacatcaatatttagcaaaggttctattttattttcccaaagttagatggcactagagttttgttattcaaaatccattcatctccatttattaggctttcagattctgagaacttcttcggcttcctctgccagcttgtctac

SEQ ID NO: 9488 - DNA, 1188 bp, Homo sapiens
aagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatc

SEQ ID NO: 9489 - DNA, 1047 bp, Homo sapiens
tttcttaaacatttgataagagatttaatattttgatccaactaccaaaaaagcagacttgtgtacttgacagatttttctaaacacttcacaactcacgattcaaacaaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacttgcccccctgacatgtggtatgaaacaaatagaaacctagaaatttagtgcatattcaaatattaagacagacactggtgtggtgacttttgtctgtcgcttcattgggacgttttttctttctgatcaacttaatgaaattataatttactataattaagtgtagccatttttactgtagagttcaatgatctttgatgaacgtgtacacccatgtaaccaccacccccaatcaaagtaaagaacattttcttaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtatacaagtctttgtgtggctatatgttgttatttctcgttggtaaatatctattagatttgctgggtcatagggaagagatatatatgtatacgtttaattttata

SEQ ID NO: 9490 - DNA, 1022 bp, Homo sapiens
tagtccaagttctaccatcataccatttccttatctaatatccatggagtgtctagtgtctgttgcaaaccgggtatctaagatgaagcagtacaacccaaactgcccagtgatggcagacattgcaaaaacatgaatttgcaatcacagtctctattttgtgtttccagtagaactggaagaatctgactcttctatttttatttttgctgcttttgaatgactgtaatgtggcaccattaatttttttttctcctcttccttggcagcatctcttgggcagtgaacagcagtcttctgtccagctctgggtctcctttggccggaagcccatgagagcagcccagtttgtcacaagacatcctattaatgtgagtggggtctgcttgaggatgggaagaagtatcattgtctttatgcagaggtcagaggaaggttgttgcagggatggcctgctggagtggatattttatggcgcctccctgaagtcaggtctctagagagtgcagctatgctttgggcatcgtggtctgtggttcccacttcactgaagcagagctgaacgagagacttagtttgctttaagtggagcagcactggcagagagaggttcgagccagagtcagtgccatctgagcaacgtgccagtactgaagcaatgggaagtttgtgcatgataggatctttttttattaagtaactgctggattgcttgcaggggatgaattccagcagaggataggatttgggtcccaccttttagaaacaggctggagagactaaaaactgagtagcagaagaaaccagacataagcaaatgcttaaatatgcagctttataacatgaagatggataggaaaagtctgcatgggatgggtcattagaggagctgccacagggagacggtcacagtgaaacgtcttgacattggcaggtggtttggtgaaaggtaagtagctcacttacttaccttccaccaaatgagtgggatcatacggagaacagtcatgccagtcctttgc

SEQ ID NO: 9491 - DNA, 1050 bp, Homo sapiens
agtccgcatcaggcttggagaagcaagagatgaccagcctggctgacgggaaggagcaagaatatgagtcccacctgtggactcttcattgcaaggctgtgacattgagaatttgttttatgggagtgtggagtcatcgattgccttggaacgtggagtgacacgggatggtgaaataagtaaatgctcatttgcttatttacttatttgagtaatttacttattgatactgctttgtccagatcatcatgccctggaaactggggcttacatggttctagctcctctttcagaccacttgaaaattgtcccatgagtcagaggaaggaacagcgcattgtgactagaagttggggcaggtttcgcagatgggtcaggtcagggaaataggcaggcatggagggggcatgtctgtagcagaagctgagtagccatctttggcaatgggggtctttaaggagctccgatccatctcagcctcttttccccctgtttttgtcaggtagctaatccagatggcgacttccgactcacaatcgtcaattcctctgtgcttgatcgtcccagggctctggtcctcgtgccccaagaggggtaagtgttgccccaaaaggaaatcagtcttgcgtccaatgctacactaatagattctcatggaaacacagactgcgggacaaaaactctgtttctcatgatggtggttgaaatggtctattaactgagaagtttgagaccacagcttagtcatcgtggtcaggtaactccgttcgctttttgttagccagtgtcagagtctctttaggcatccagatgtcttgcatctgtgggttgtttctctagaaaagttgatgttaaaagagagcttctgtagacatagacaggcctgcttggatattgtgagaactttctcttgagtttcatgcatggtacaaacatttaattcattccatctttcccctgccttcccagcatgtgtaggttttcttacgtacaatcagtgtgcacttggggaaggcaaaggtgctttttattaactcattaactgaagga

SEQ ID NO: 9492 - DNA, 1060 bp, Homo sapiens
gtctctctctgtcactcaggctggagtgcaatgacacgatcttggctcactgcaacctccgcctcccaagttcaagtgattctcctgcctcagccccctgagtagctgggattacaggcacccaccaccacagccggctaatttttgtatttttagtagagatggggtttcaccatgttggccaggctggtctcgaactcctgacctcaagtgatccatccgcctcggcctcccaaagtgctgggattacaggcgtgagccaccatgcccaaccaattattttaaccatttaaaaatgtgaaaaccatcttagctcacaggctgtacaaaagcaggaggtgggctggtttggcccctgggctgtagtttgctggctcttgatctgtgggtttctgtatcttcagcttcaaataaaacctcctgaactatatgcttcagagagtgattgtgaaaatcaaaggcacggggaaggacacctacactaagtccttattttcagatcaggaaatagagactcagagtgggacagtgacttgctgagagtagcacagcttgttactggttaggacttcaatgcaggtctgctgccttcctatcaagtgctctccctttatttttgtttttgaaacggagtttcgctcttgttgcccaggctggagtgcaatggcgcgatcttggctcaccgcaacctctgacacctgggttcaagcgattctcctgcctcagccttctgagtagctgggattacaggcatgtgccaccatgcctggctaattttgtatttttagtagagacggagtttctccatgttggtcaggctggtcttgaactcccgacctcaagtgatccacccgcctcagcctcccaaagtgctgggattacaggcgtgagccaccgtgcctgtctgtgctcttcctttattctatgcataactgatttgaaaggagaaccagagtcctgtcttttctcctctacaacagagcagagtaaaggatgcgtaaaaggcaaattaaccttttttctgatatgttgcaaatggttagttaagggctttttaatg

SEQ ID NO: 9493 - DNA, 1027 bp, Homo sapiens
ctcccgataggtgacccacctgcatgctttaaatgactgggggagcacgtatatcacagcattacgattatttgctctgtgtttgttttctgtctcagctgagctccttgaggccagagactttgttttgtctatcactgaagttcccagagcctggcacgggacctcgtccttcttagatgttcaacatgtgtgggatggatgaacggatgggtgggtgggcagacggataattagatgaaggctccgtgcccgcccttgtgtcatgaaagatatacactacaaagatggcaacctaggactgagctaaggcccagggaccatgcaaaggatagtgtttcaacagtggctggcattgagtagggcagcttttacgtttttataaataacctgaaaaaggaagttcagactgaaactcacacgtctatgggtgacacagagctctttcggtagggaggttccatgccaaaagggtagaggaggggaggatcccctaagatatgagtgggcggacaagtggaaggttgcttcagcgtgaacaaactcaaaccactgtattgacgcggaagttatctgaggtataagatggtgcctccgggtgattaagtttgacaagaaagcgtcacttcattcaatcaataaattaaacacctactatgtgctgggctttgtgctcaggcctttacctcctacccttgaagatctcagagtctaatggagaagaatgcttccaatgtagtgggaaaaatagacatagaaggaaataattagagataagactggaagggctaatagaagaatggtagagagtgctatgagacttccgaagagagctgctctgctatctgtggtggggaagtcgggaggatttattcattctgtacttatttcatgaatagttcagggcatttaccgtgtgctcagttttgaaggcaccaagttaaacagatatggagtcttatctccaaagagcttacagtccactgggagtgatggataggtaaagtgtgggaggggccgtgagggg

SEQ ID NO: 9494 - DNA, 1044 bp, Homo sapiens
ttctttttcttttttttttttatggatatatagtctctctctgtcactcaggctggagtgcagtggcgtgatcttggctcactgcaacctctgcttcccgggttcaagtgattctcctgcctcagcctcccaagtagctgggattataggcgtccgccaccatgtctggctaatttttgtatttttagtagagatggggtttcactatgttggtcaggctggtctcaaactccagtcctcaagtgatctgcccgcctcagcctcccaaagtgctgggattacaggcatgagccactgcgcccagcctgatttttttctaattgataaaaattatatacatttatggcgtataacatgatggttgaatatatgtatgcattgtggagtgcctaaatcaagctaattgtacatgcattacctcgcatgcttatcaggcatttgtggtgagaacacttaaactctactctcttagtaattttcaagcatataatatgttatgatgaactatagtcactgtgctgtacaataggtctcttgaacttatttctcctaagtgaagttttacgtcctttgaccaatatctccccaatctcgctcccctttcttgctttcggctcaaccagtcctgcagcattttggctgggttcacgggggccacttcacagcaaggaaaggagggaagaggtcatgtgttccccacattaatccaccagttgggtaatctgtgtctgaataattggaagtctgcagttcctctctccccacagacaggggtagtggttaagtaattgcattatcagcctcctccagtctctggggagaggatgccaatgttaagtagcagcagacttccatctccccttgtctctgagtgaagactgcctgttttccctgccagtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcgga

SEQ ID NO: 9495 - DNA, 1050 bp, Homo sapiens
ctttttacatgctgttccctcagcctggcatagacttcctgcccttctcagccttagttctgagtcacgccagcacttcctccagaaggctttccctgacctcccaagataggactggatgtccctctgtgtccctatggcccggtgctcctcatcagagcacagatcactccaaagtgtcaattactgtttcctggtctgtatcccctactaggctgtgtgtccgctgcttcaccatctaccactattcctgtagcttcgtaagggctcgataaataaatacctgctgaatcaatgaatgagcaaattgaattaagaaagttaaattcagtttttttctttcatcacagcataaatatgggaaaatagcacctttctttacaaaaaaaaatctgtatttacttgaagacaataattgagctttcttccccacctgaacaaccacagttgaaacttatgtttaattcagcacaagataagccctaaaaatcattccctaatttggtctaatgcaagaagcctttacatgtttagattcgaatttattactattgatttttaaaaataaatatttatgctgtatttgtgttgactagaatatttttagaaaaggagttatttattcaagaagtatttattgactcttctgtccatagcacagtgcagcatactagggcagaagttaggaaacgaaagatcacttgcagtccccgctgcctgggaatttgtctagtgaggagacaagattatcacagtgaaaaattaagtaagcacaaacatagagcactttaagacacattctctcatgttgatcctcattcagtcctgagaaataaaacaaatagaatttatcccgatttatagatgagaaaaactgaatcagagatgactgatttgccaaccaatgcagaacaggtagtgacagatggagaacgtgagcccaggtctgtgccctgccggacactgctggaccccatgtcccatatccctgccccatgatgcttaagggtcaagtgaaaggcagggacaggaaacactgtgagttcctag

SEQ ID NO: 9496 - DNA, 1035 bp, Homo sapiens
gctatgaacctttcagtgagccgtgatctggtctgatttgaagcctcggggatctttctgtagtacattagatacacgctacaaagacaaaatgaagtgaaaagcaaaatcactgaaaagaagaatgaatctacgtaggtatgcagtcaagataaaaccgtgctttcccccaaaaaggagcagtctgaagcaaatgttgtctaggcaacaattcacagttctctttctaaacagcagatgtctatacagtcatgcattgcctgatgacaggggtacgttctgagaaatttttggttaggtgatttcatcattgtgggaacatcatagagtgcacttacacaaacctagatagtacagcctactacacacaatttgtgcaatgtgttactatactaaacactgtagggaattataataccttggtaagtatttgtgcatctaaacatagaaaaggtacagtaaaaataaagcataaaagttttttaaatggtacacctatataggcactcaccatgaatggaggttgtaggactgtacatttctctgggtgaggcagtgcgtgagcaggagtgaatttcaaggcctaggacattactgtaagctactgtggacttcagaaacactgtacacttagactcctctaaatttatttttaaaaatatttcttcattaataaattgaccttagctactgtaacttttttattttatatacttttaatttttttttttactttttaactcttttgtaataacacagcttaaaacacaaatacattgtacagctgtataaaaattctttatatccttattctgtaagtaagcttttttctattaaaaaattttttttggctgggcgcggtggctcacgcctgtaatcccagcacttttggaggctgaggcaggcagatcacgaggtcaggagatcgagaccatcctggctaacacggtgaaaccctgtctctactaaaaatacaaaaaattagccaggcgcggtggcaggtgcctgtagtcccagctactcgggaggctgagg

SEQ ID NO: 9497 - DNA, 1001 bp, Homo sapiens
caggcattactctgagttgtccaatgagcagatccatggatagaggcagaagagctgggttttggtcctcaagccattgctgccttcccaggtgacctcctgcagctcagtttccctctgtgtggaatgaacttagcctcccaggcctgctaatgagctgcaatgattgccagatcaaagggtgtttgggaacatttccagccttaccagtgaggtggagaaaaagcaggcaaagcaaggtgatttagaaaatgccactttacctgttgaaccaaagagccagaagtggaactcacagaaatacaactgagattaccccgaggtgcacagtaaatagtacaattcatttctcacctaggccaccaactcttgtccctaggagaatccagattgcatccaaattttgttctgatttccttccatctgtgataacttcgttgttctgaaatacaacgatggtttttcatatcattggtcgtggttgtagcccgtgcgagaataatgatgtatgctttccctggaaatcagctagatccagagttcccaaatggtggtctatggaccaatgctgacacatgacaaggtttttattaattaaatgagaacaataaggacactgtaaagaatctctcgagtttaatttatttcatttaaagggcttttcttctgagatgatagtgttggaatgtaagctccaagagggtaaggactttgatgatattcttgttctctgttttccaatacccagaagaatacctgtatgtaagaggcactcaatcaatatttgttgaatgaatgaaggaaaaattatttcctttctattttcctggattaaaatatcctttttttaatgaaatggtattgaaagtaaatggtaggaggttttgaaaactttttttctatggaaaaataaaagtatataattatttttaaaaggttattgatctttaatgtctaagtttgagaatttctagaccagatgatccattaaggaccatttc

SEQ ID NO: 9498 - DNA, 1045 bp, Homo sapiens
taaaaccacaagtcaatctagaaaagttggtggtgtgtagtttggtaaataagttcagcctttgacatgaagattaacctggtttgacattgattgattgatttgacatgcagatgacctgagattggtgctcctgtcagtcttaaaaacaaacaaacaaaaatccctaagctttgaacttgacctagttgtttaccacatgtgtgattccaggctagcttcctgtctgtaaaataagggtaattgtaatgcttccctttcctattgcacagaaatgtgacgataacgtaagccattctacattctaactatgtgtgtgttggggagggaggggggagggatcatgtctgttttgcttcctttatttccatattgtttggaagatgctcattaatacttgacttaatgaactgtcaggtgggataacccttccctgttcctccgtttggagggcagatagaacatgatgactggagatgcatgaaatgtgactaatgtctctgtgtaatcaggacttgcaacaccctgattgctcctatctgattctttctgaacaaaacaaaacaaaagaaaaacttgacttaatgaataaatggtggagttgggtgatttccacatcattgatgtccaagctttagcgtgcatcaggatcacccgagggtcttgttcagactcgactgccaagacccacctagagagtttttggttcaggaagcctggggtgaggcccaagaacctgcatctaacgacttcccggtgtgctgtggcgcagcgggcagggacggaggcgcccaggggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctct

SEQ ID NO: 9499 - DNA, 1766 bp, Homo sapiens
gggaggctgaggcaagagaatcgcttgaacctgggtacaggggctgcagtgagccaagactgtgccactgcactccagcctgggccacagagtgagactctgtctcaaaaaaaaaaaaaaaaattgaagacctgtgggagccattggaaaacatactgtgctgtgtggtactgattgtactagaaaagagagagttctggagaagtagaggaagacttcttgaaggaagaggctgacaccatgacaaatacagatgggtagtagaaaacagcaggaaaagaatgaggttgggtgcataagactggctgaagggaacaatatgaagaatggcaggagaaacaggatgagccatgtgtctttgcggggtggggactgaggagtaggatccgttatgcagaagatgggcattttgggccttccagagtttatcttttctgtttgcaacaactgagcatggttctctcagcaggtgcagatacagagctttgttccgtggatttttgtggacgctggggatagaagttctttctgtttggtacttcatcctgctacccttttcacagagtagagggaaatggggcaagcttggtgggagctaaccttgaactaaagtagtttgtcaggccaggggcggtggctaatgcctgtaatcccagcactttgggaggctgaggcgggagggtcacctgaggtgaggcgggagggtcacctgaggtcaggagttcgagaccagcttggccaacatggtgaaaccctgtctctactaaaaatacaaaaaattagccaggtgtagtagcgggtgcctgtaatcccagctactcgggaggccaaggcgggagaattgcttgaacccgggaggtggaggttgcagtgagccaagatcgcgccattgcactccagcctgggcaacaagagcgaaacttcatcttaaatgaataaataaataaagtagtttgtcatggcttgtcggcttttccctccaatgtaaaagaaactaaaagagaccttcttttgatcttgagattctgccatatatactgaggacaaaatatggtaaaaagagccgggtgcaatggcatggcctgtattcccagctacttgggttgtggtgtgaggatcacatgagcccaagagttcaaggctttagtaggctataatggtgcctgtgaataaccactgcatttcagccatggtgagacccccacccccaacgcttaaaatgttacgtgcgtgtgtgtgtgtgtgtgtgtgtgtgtgtgtgtgtctttgtgtgtatgaagaaaaaaatcttgcattgctggctaggatggggatgacagtagatttggttagatttaggaaggtattcctggtttcgagagttgtctatgtgtgtagtggaaccttcattttgttggatttggggacatatccttaaaatttggcaggattttcatctagatgtagttcaggcagttattttaagtggtgacttttggattagaagaacctatgtatcagccgggcgcagtggctcacgcctgtaatcctagcactttgggaggatgaggcaggcagattgcctgagctcaggagttagccaccaacttgggcaacacggagaaacaccgtctctactaaaaatacaaaaattagccaggtgtggtggtggacacctgtagtcccagctactcgggaggctgaggcaggagaattgcttgaacctaggaggtggaggttgcagtgagccgagatctcgccactgcactccagcctgggcaacagag

SEQ ID NO: 9500 - DNA, 1071 bp, Homo sapiens
aaaaagagaaaaaaattagccaggcatggtggcatatacctgcagtcccagctacttcagaggcagaagtgggaagattacttgagcctgggaggttgaggcttcagtgagccatgaccacgccactgcactccagcctgggcaacagagtgagaccctatctgaaaagagagagagaaaaaaaagtcaacatgctatttggaggggagaaatatcccgactatatcaagggcatgtttggtgtattatctcctggtgttttttctcattcagattttccttttatttgagagacttttttcttctgtgccttgcacttctagaaggtaagggagagtgttagtccatgcgttgaggatagagaatttgaaaggaaagatcaaactgttttttctttctcacagtcaacacagaacatttctgtgaccagatatgtggggttttctccccacacaccaagaagttctccagtggacacaaactgggtgtcttataattcaatttaattctggcaccttctgcctggagatggtgtcagattccacaggttcagggctcagtcctctaagattgcccccacttcagatgccaatcacaagttagagctacctgtactttttctttttttattttttctctatctgcatgttgcatctgagatctatacttctgaccaaccaactataaaccagagttcccgactcccttttagggttcgattaatttactagagctgttaccagaaaggggtcccattccagacccaaagagagtgttcttggatcttgcacaggaaagaattcagggcgagtacacaatgcaaagtgaaagcaagtttattaagaaagtaaaggaaggctgggcgcggtggctcatgcctataatcccagcactttgggaggccaaggtgggaggatcacttgaggtccagagttcaagaccagtctggccaacatggcaaaaccccgtctctactaaaaatacaaaaattagccaagtgtggtggcaggcacctgtagtctcagctactcaggaagttgaggtgggagaattgcttgaacctgggaggtg

SEQ ID NO: 9501 - DNA, 1052 bp, Homo sapiens
atccacctgcctctgtctcccaaagtgttgggattacaggcgtgagccactgcacccagcctgattgtgcatttgtaaagtcaatttacttagtgttactcaaccctcaaccttagtttcctcctttgtaaaaatttgatgtccattggattttcttgtaaagaatacatgagaaaacattcgtaaagagccattaagtggatgcttaataaatggtagctgcttgcactctgattctggctatcataacattttactctcagtttcctaccagatcttacacccttctgttcttgacaaagcagagacaaagccgggcaccgtggctcacccctgcaatcccagcacttggggaggccgacgtgggtggattgcctgagctcaggagtttgagaccagcctgagaaacatggcaaaagcccgtctttatcaaaactacaaaaaattagccgggcatggtggcatgcgcctgtggtcccagctacttgggaggctgaggtacaagatcccttgagcatgggaggcgaaggttgtaatgagcctagactgtgctactgcagtccagcctgggtgacagagtgagaccctgtctcaaaaaagaaaaaaaaaaaaaaacaaaaagaaaaagcaaaggcagaaagaaagtgtagaatattgagcatctgcaaatgtcacatatttagactccagataaatagattaagttgtggtatttcccctcaagaagctgattctcttatggtgtgatatacttacaaataaacaagtataatataatgtaataaatgacttaagaaattatgcgtaaggtaataaaactgaagaattttacaagctgggtgtggtggctcatgcctgtaatcccagcaatcggggaagccgatgggggtggatccctttgaggcccggagtctgagaccagccgccaacatggcaaaaccctgtctctactaaaaatacaaagattagctgggtgtggtggtgtgcgcctgtagtcccagctactcaggaggctaaggctggagaatcacttgagtccaggaggcagagag

SEQ ID NO: 9502 - DNA, 1008 bp, Homo sapiens
actgagaagtttgctgccagatgtattggagttcaattgtatgttgtttcttttctctcgctgcttttaggatccttttttaaaatccttggcctttgggaatttgactactaaatgcctaagctagtcttctttgggttaactctgcttggtgctctataaccttcttgtacttcaatattgatatctttctctaggtttgagaagttctgatatcatccctttgaataagctttctacccctatctctttctgtaaggccaataactcttagatttacccttttgaggctgttttctagatctcgtaggcatgcttcattgttttttattcttttgtcgcctctaactgtattttcatatttcatatagtctgtcttctagttcaccaattcttccttctgcttgaccagttctgctattaagagagtctgatgcattcttcagcatgctagttgcattttccacctctagaatttctgcttaattcattttaataatttcaatctctttgttaaatttatctcatagaattctgaattccttctctgtgctatgttaaatttctgaatttcttcaaaacagctattttgaattctccgtctgaaaagtcacatatctctgtttctccaggactggtccttggtgccttatttagtttgtttgacgaggtcatgttttcctagatgtggtgttgatgcttgtagatgttctttggtgtctgtgcattgaagagttaggcatttattgtagtcttcacagtcttggcttgtttgtgcttattctttttgtgaaggcttttcaggtatttgaaggcatttggcccccaaaccaaataatgttgtggttcttgtctactcatggaggtgccactttggtggtcttggagaacatcaagaagaattctcttgattgccatgcagagactcttgttctcttcccttactttctcccaaacaaatgcagtttctcactgtggttagcctcctggaactgagagtagggaaac

SEQ ID NO: 9503 - DNA, 1028 bp, Homo sapiens
gttaatttttgtatttttaatagagacaagatttcaccatgttgaccaggctggtcttgaactcctgacctcaaataatccacccgcctgagcctcctggagtgctgggtttactggcgtgagccactgtgcctggcctcagcctatgttttaaatcttataaactcatagcaatttttttaaatctaggtacagattattcagattttacaagtgaataaactaaagcacagaggagccaagtactccaagcaaggtcacacagctcaaaagtgtttgagctggtagtctgactttagagtccatgctcttaactaccacaattacaaagcaactggaagacaggtctttgtctatgagaagacatgagactaatacgaaaagtttgaggaatagtaatttatgaagacagcatttaatggtttgaattacagatgacccttgaccaacttggtgcttaggggcaccaacgcccatgcagtcaaatctgtgtgtagcttttgacttcacaacatcttaactactaattgcctactgttgaccagaagccttactgataacacagtcaattaacacatttttggtattatgcattatatactgtattcttgcaataaagtaagtagagaaaagaaaatgttaagaaagtcataagagaatatatttactactcattaagtggaagcagattgtcataaaggccttcatccttattgtgttcacattgagtaggctgagaaggagaaagaggaggggttggtcttgctgtctcagaggcgacagaggtgaaagaagatttgcacgtatttggacttgcacagttcaaatccatgttgttcaggggtcacttgtacaattgccaaagatgtgcaagaacagagatggagaggtagtaatgggcaaaagaaattgagaagggctgaatgaaggagatgggatgtgggttgatccttggagaatggagtccactgagatttcaagagagacgagcaggcctggcgcagtggctcatgcttgtaatcccagca

SEQ ID NO: 9504 - DNA, 1050 bp, Homo sapiens
ctcaacctgtccttgaaacatatcacggcaagtgcagtagaagatatgaacctgtttgaggcatagatccttcctggaggtgtccttcagacagagtgagacatgctacaccatgaatggagagctgcgtctgcatccgtggggtgtccatctagagagggttgtaggagtttgttaggggagggtttgcaggaggagtcagactcttctactttctccaacactgtttacctgggagaatccaggttcctttaaattagcgtctttggaatctactttttttgagagtctctctctgccgcccaggctggagtgcagtggtgcgatctccgctcactgcaacctccacctctgaggttcgagcaattctcctgcctcagcctcctgagtagctgggattacagacacctgccaccatgtgtggctaatttttatatatatatatatatatatatttgtagtagagacggggtttcactatgttggccaggctggtctcacactcctgacctaaagtgatccgtccgaattggcttcccaaagtgctgggattacaagcacgagccactgtgcccagcctggaatctacgtttttacatgtgttcactgggccattttgaagtacagtaaagtttgggggctgctgtattaaattaccaagactcctaagacaaaagcaccattcctaatcctatgcgggccaagaccctcctggcaaggtggcagagctggggagagtgagggagcagccccatttgttttaagggtctgacttttcctgggaatccacatcttccccaccccactgctgtctcatccctgtccctagcttcttggtctggaggctttcttgccccattggcctggctttcatttccctggattttgctgctttgaggaccaaaatctgtgcttttagtattgctactttgacctgaagatctgacggtctttttgggcttggtccccctcttgctaatgctgaaggttgtatagggtccatgggaaggaagagggtgcctcagacagatcccgaagctgttgatctca

SEQ ID NO: 9505 - DNA, 1048 bp, Homo sapiens
aaatgagaacactgaagcccagagagatgatttgcccaagggtactgtgtcagagccctgactccaacttagataaacctgattccgttttatgacttccagtacacagactattttctgagcacctcaaatccccataactgaccctttgcccaaagaggtacatgaaactgtcagtaatttcccccctctaacctttgagtgttccaagtgtttcttcctttcttttattgtagaagcactggatttattgagtgaataaacttaatatagcttgccagccataactttatattagaatagtttggcttgcctcagtgcttggaaataggggtggagtcctcaaatgtccccccacatccaagtcaacagttcatctcttctctctaccaaaagcttgaacgtctctcagcatttttggaagcataaggaaaggttcagaaattagaatacacattccaaaagcacttattcagcacttgctatgtgtattgcttgctatttgcactggagagaaacaagaaaagtaaaactaagagaacttagcatctgattgactgttccctttcttttatcccctatacgtcaaaggtacctaaagcttggaatttatgttatttcaaggatattggttccatcaaatacataatgaagattttgtgaagaaaaagcgatgttgttttgaacattgagagtttgaagttccacctatgggggcattcagattcagcattcccttcaggattggtgcttgggagatagattgagtcatcatttacaaaaaaaaaaaaaaaaaaaagaaaaaagataatacttgaattcgtataagtagattgtgaagtttaagaattttacacactaaatttgattttgttctgtccagtttttctctatttgggttagactggctttgtaagtttttcaagagttgaggcacttgggaatagacagttttcatatttatagtatttaatttaagcatataaggatttaagcagtatgcctttttctttgccaaaggctatactaattagggtgaccattaatc

SEQ ID NO: 9506 - DNA, 1066 bp, Homo sapiens
tctaccttttgtctgtataggtttacctatactggacatttcatatgaaaggaattatatgatatatcgtcttttgtgactgttttttctctttgcataatgttttaaagttcatccacattgtagtggatgtatcagtacttcattctttttattgctgaataatttattgtatagatgtaccacatttggtttatccatttatcagttagtagactttggcgttcttttcacttcttggtgtttatgaattatgaacgattgtgtatgagcagttgtgtacacatttttgtgtggacattcatttcttttaggacattcatttctaggagtgaacctgctggatcatatagtaattctatgtttaacatttcaaagaactgctaaacagttttccaccagcaatatgtgagggttccaatttctctgtatcctccaacacttattattgtccttctcttctgttatagctatcctagtagatgtgaattggtatctcactgtccttttgatttgtagtatattttcctgatgactaatgatcttcagtatcttttcatgtgcttgttgcccagttgtgtaactcttgtggataaaatgtcatgcatgtgctttacccattttttaattgggttgtctttttattatcaaattgttaagtgtttatatatatataaatttatacataaaatgtatatatataatatgtatatattctggatacaagttccttatcagatagttgatttgcaagtattttctcccattctgtagactgttatcttacttgattaatagtattgtttatggcataagatttttaaattagtcacttctttttttcttatgttgcttgtgcttttgatgaattatctaataataattgtttatcttgagatcatgaagatttattcctatgtgttcttttaagattttatagtttttagctcttaattttaggtctgtgatccatttcgagttaatttttatgtatgctgtaaataagtggttcatcttcattcttttgaatataggtgtctagttgtctcagcatcacctgttgaaa

SEQ ID NO: 9507 - DNA, 1038 bp, Homo sapiens
attatgctgaaagcccagagtattgagctagaagaagggagtattgtgttgaaaacccaggattttctacccacaaatcaggctcttctaacgaaaaaccaggatgttttactcaaagaccactgtgttctccctaaagaccagagtattctactcaaatatcaggaccaggacttcctacccagagaccagcatgttctccacaaagaccaagatattctgccaaaatatcaggaccagaattttctacctaaggaccagaattttttatctagagaccagcatgttctccccaaagaccaagatattctgccaaaatatcaggaccagaattttctacctaaggaccagaattttttgtctagagaccagcatgttctccccaaagaccagaatattctacctaaatatcaaggccaggattttctacctaaagaccaggactttttatctagagaccagcatgttctccccaaagactggaatattctacccaaatgtcaggaccaggattttctacccagagaccaaggtgttcttcccaaagaccaaaatattctacccatatgtcaggaccaggattttctacccagagaccaaggttatcttcctaaagaccaaaatattctacccatatgtcaggaccgggattttctacccagagacctgcatgttctctccaacgaccagaatattctacccaaatgtcaggaccaagattttctaccaaaatatcaggtaaaatagagcagaaaggagatacaaaaagaagaaataagctacttagggtttgaggagggatttgtaaggactgcaagtataccttggagatactgtgggttcagttccaggccattgcaataaagcaaatattggaataaagtaagtcacacaaatttcttggcttcccagtacatataaaagttatgtttatattgtactgtagtttattagtgtgcaatagcataatgcctaaaaaaagtacataccttaatttaaaaatactttattgctaaaaaatgcttacgattatctgag

SEQ ID NO: 9508 - DNA, 1041 bp, Homo sapiens
aatttggccttttgagttattgcctaagagaggttttctatgtccctaggttatgatgacattaacatttgatttacatttggctatttgatcttattcagtgctccatcctacactgagcctacttatgactaaaaccagatttttgttttgtaggtggaggagcaaaggaagagtttgccagatggatgggtgtgccatttagattgcaaattagcatgccttctttattgctaaacctgaggattaggtgatgcctgtgtttaaatccttcctggttcaaagctgtaggtacccacatccaacaagttacacccatcttatcacattgccagaattgagttatggttcagctggaggaagaggacatgtctgtccttttttgccaggtgggcacagtgttttctctaatgagttcaaagcatttggcatacacatgatcaataccactttttctttcacacattaggacattacatcctacacataaaacgtgactgtgatacagctctgtcttttagggcttagagtgttttctcacatggctgtaactccttgttcttaccttataagtaacttgggtcagggatggtagataaggggggatctgaaacagagctaagactaagaggaggatgacaaagatacaaggcaaggaccaggactgagctaagattaacaatggaaaacagagcttgaagtggagcaagattggaacttgagccaacacaataggaatcagtagttaactagacatgggtctctgaaaactgtggagaggtgattttaactagtctaatagacttacatacagtggctcacattggaaaaatccattcatcaaggaatgtaatctgacacaggtaaaccataatagctggagactgagttaatgctctgtgaatatgtatttttatatgtattacattttctgaacccctgacctacctcttccttttcactattagcaaaatagaaatgtagagatgaatagctgttaatacagcttagtttgactccagaagtaggatataattggat

SEQ ID NO: 9509 - DNA, 1071 bp, Homo sapiens
tcaactgcaacaaccatgaaatagagttgatactaaagtttctgttaaataacagaacaaaaaatggattgctttatgttagaataaaaacatttaaaaataaattggatgccctccttccaggaagcagtgaggaagacagtctagacaccttacagcctagttcttccatgggcttactccaccaggactagtgctttacaccctacgggcacacaatatatgctgaatgaatggcaggattcgagaatgaatggctatgtactccctagtccctggacattggtatggtaattctgatgcagttttacattaaatttacattgtacacaaagaatggtagctttacttccatttttatcagtgaaaaatttaaggaacttaacaaattacccattgtgatctccattgtggggatagggtggtatcctcctaattcagcttttgtcaggatacaattttaagacgccacgaaataacctattttcttatatagaaacccagatttactctccctctccaccttctaaacagtggggatcaccagtctgccacaggatcccctctgggtagggaacagtagagggaacatgttctaaggccactgatcacagaatggttctgaacactaagatgacttctgtctgtatttaaggaatgacctctgagccctgtctccaagaaggccatgagcatacagggtaccataacagacattgactatagggttatcccatgccaaactctcagtgaaatccattttgagccctctcagccttctacgtcttatcccaaccctgcggggctttttttgcataactgcattgagtatgcaggtagaaagaaatctatcattcatttcaccacagctggtaattatagactccaggtctgtagactgtaggtcaagtcaagctgaaataaactttgcacagggtatttttttttttttcctaaagccaatctttaacatatatgcctttcatttacatcaggcaaaaaaacaaaaattagaaaacagtagtattaaggatagaatttagtttccaaccttaatacactttcctccat

SEQ ID NO: 9510 - DNA, 1050 bp, Homo sapiens
cctagctgtggggtgtggggtgggaaggggtcccgaccagggaggtaggttattctctgggcatctagagaaagagtgtgtgtggggggtgggagcgggggggaggagggcattgaggggaggaagatttgagatttcctcctcttaatattaaacccaccatcccagccccctgcacccctggcagggagagccagacagcccttacaggacacggaagacgcacgacccacgacccacgagtggcctcggcggcccggggcgcggcgactgccgccgcggagctccaaggctgttgttttgtaggcttggaattcgtgagagctctctcccgctgagagcccgaggggggagggagccgtgaccccacggagactccctggtcaccgcctcccctttgtgagcgggaaaggcttgaaagccaagagaaagagaggctgctcagaataaggggcagggggttaccggagggagatgggcccgaccaccgctcacagtaaaatgcctcgtgcgaattgcactgaagtatacccaacttgagactggctgttttatgatcctctctgggagtttactgctctctgcttttaagtctatagattgctttaagttaatgaaagtgctgctttcaaaaggggcttttattgtgtggcagtggcaaatccagtacctcccctttactcttccaaaatgggcctgtttaaaaagagggagcttgctggatcccacatggcagagcttgggggagggtgccatgtgacaatgagaattaataaaagttaatgtccaagtgattctgaaagacgagtttgcttcttttccagtccggtttcatctgttcattctcgtgttgcctttgggctttcactgagtctgcctttaaatgttgcttggtgcctccccagcagcctctcccagcattgctttaggtaggcctgacccctgttcagttaaacccaaactggatttcaggatttcagcccagctgccaattcaaactgcaactaaaatatttacttgggactgggggaggggctttgcctcgcgttt

SEQ ID NO: 9511 - DNA, 1033 bp, Homo sapiens
gccaggctgatctcaaactcctagcctcaagttatctgccctcctcggcctcccaaagtgctgggattcctggcttgagcccccacgcccagccttcttccctttttttctcctctttggtagttgatctcacctgttgccccagcccagccccaggtggcatgttatttcccttgtgctctgctgaccagccccagtccctctgagagctccccaagctcctagactgctctgaggaggtcaaagagcttcagtgagggggagaacggctgctcccaccattgcccaggtacccccttcttgtggcaaaacattcctcggttctcaccttcactgaggtccaggtgctcctgccagccccgcacatgcattcagtgctaattaaatatattatccatctgagaaaaaccaactcaggaagttaaatcagttattgcaaaagaaaacagtgtggcatatttcactctcccaggtcagcaatgtgggctcctgggttgcttaagatttcctgggttggccaggtgctgtggctcacacctgtaatcccagtactttgggaggccaaggccggtggatcacttgaggtcaggggttcaagaccagcctggccaacatggtaaaactccatctctactaaaaatacaaggaaattagccagatgtggtggcaggtgcctgtaataccagctactcaggaggctgaggcaggagaaatcacttgaacccaggcggtggaggttgcggtgagccgagattgcaccacttcactccagcctgagtgacaaagcagaactctgtctcaaaaatacaaaacaaacaaacaaaacaaaacaaaacttactgggtctctcgttgctatgtgtatggactggacgagacaggagcaacatccactcattgaatgaaccctggtcttgcagccagatcacctcagtccatcacccatggctcagaagcttgggcaggtgtctcctgtcctctgtgattccactttcccatctatagacagtgacaccagtggcctcttagggctg

SEQ ID NO: 9512 - DNA, 1076 bp, Homo sapiens
aaatgtcaaaagatcatctattgtttcattaaaaataaaaaataaaaaagaacagtttgggtttggtggactcagcttgggcacaaggcaggtggtgccaggccagtggagaggagacagaagtgattttctaggacaaccttccagaggcaaagccatctttctaattctccctttctgggtgttgattttgcagatgtaatttaagccagggaaagcgtgctcttatacatttgcccagactcagtcattttggccaacatttactaggcacctactgtgtgcaaagttcggggcatggtccctctggagatcccagtgtgtgttagcgagagcatcgctgcaaggagttcagggccagtgcttgtctgactggggctaagagtggccatggcatctcagacgcagttcgccagctgcctggagaatcctgagtccatggaggggctatgctgcctggaggaggtccagagaggcctcacagagaaggggacatctgggtggggcctggaaggatgagtggactcccacagaggatgggagctgcagcatcgcaggcaaagagaacagagcaggtgatgtaaattgaaaggccacattcagcctggacctagaagttgggcctggagaggtggagaggacaggagcttcctctccagccatgcactgaccagccatgatctgaccagcccctgacaatcaagtgagtgactgaggccacgtctagtccacgatctgctatgcacactctcctctgatgctgatgggtgcaatttcccaccttcgggctgcacactacccctcacagcctttagccggctggcccagctcacctgctgctggactcacaggcttctagagaggaagccagcctctggctgtcaggaagctctcggccacccccatgtactggtggggccatgcagccaaggggattgagtcaggccctccagagtattgggggtgtttaaaacaaggctgtccccaatcccaccctgttgccaggagtcatcagccccacgtgcatcccatacctaacgggaaagcagagagcaggccctgccgccagccctgag

SEQ ID NO: 9513 - DNA, 1036 bp, Homo sapiens
tgtggcccaggagcagcactgagagggggtccaaagaggggaggccggtggagtgagggaccacaggtttggacccagctcagttctctcctcccccagcccccacctcaaccctggggttttctcccaaagaagttcaagcttagcttgaaccacaagccccacccgcccatgctggtgaggagtccgatgttaggggctgcctaaatcaggggattaggttgccagcggcgcagaggcagggccaagagggtgaggttaatccagctttccctccccctcctcccctccagtctccttcgttcccctttgaagtgagtgggttcccatggaaaccatggtgtcctgaggagcggaagaggggcaggagctaggcctggccaggtgcgggtgggggaggaggttggctttgcgaagactgctctgctaaggtgttggctcacttccctaaggctgaaagattctctccgagaaccagggacgcggaggtgctaaagttgttgcccattactgataaggaaaagctgggctggaggcatgagcagtgagaagacagtgagggcagtggtgctttgcctttccattaagaacccagagagtggagctgcaggtcagggatagagggtgaggtggcttccggactctgcctgtctcctttgtggcattactcacaattgaattaactgtgttagcatttgtgtcaaccttatttctgtttcccctgctatactgttaactccagaggacagggtctgcgtctgtcttgctcattgctttatccccagcaccttacatgataccttagagtcagcagcttagacgaagtagctactgcatcaaagcttgttggacggcttcattaaatggttagggagcaccccataaatataccatagttctaggttgatgtgccggcaaacgtctctcgaggcggggaaggggagcagctccgattcgtagcatttgctgatccccgtgatgtaaatactcataccatggcccatcccaaaccgcccacctgagggcaccgagcagt

SEQ ID NO: 9514 - DNA, 1114 bp, Homo sapiens
tgccctcgcagagcagttttaactttcactgtgttgagatttcacatagatgcgtttaatgtgccgggaggagtgtgtgcgtgcatgtgtctgaagggaggagggctgagtagactgcgacctgccctgggccccacacttgccgggaatggacctgtccacccacctgggggaggagagctgggctggagcccaggagctctgacagatgcagctccaatttagcaactcgaagaagtcctctccaaggcaacccaggcgaacacaccgcccactgggcaggactaaaaatacacccgcatggtttcaacgtcacacctgaagtaaaaatacatccaaccaggggccgctggctcgctcccacccccctctgttctctccatctggtgctttcaaggggaggagaagcagagggctggacaagcaccttcctccctactccctcccctccctctaagacctcaccaccctctctgcaggcagcccccagcagagccccaaagaaggcaggtcctttcgtagcaactgtgactagaagctgccagatggcaaaatctgttccaagtccccctagtatggatggattctgagcctgaaagaacttgaggattgtgtctcaaaaccttcattccaatagtcattgcttactccactcattcattcactgattcccattcactgattcgtcaaaaatgtattgatcctctgctgtgtgccatatactgtgcctaacccttgggagttcagagagagagaaaatgtggtcaccgactggaggagcccaccatgccatgaggaagacagtcctgtgcacaaacgactgtgcttagtagagtttaagaagtgtcataaaataaataaaaataaatttctattggcagtcctttttcggttaaaagaaaacgaggttcgaagttctgataaattgtaagatgcctctccctcctctttctgggcctctatttgaattggcatgtgggtttgttttcccagccaaatgagtcagtggagatgggaatataaatttattggagtagatggtgtcagtgttgccctgaatttaaaaagtgcccacgcaccgttccagggaaatggagcaggcattaattgatag

SEQ ID NO: 9515 - DNA, 1047 bp, Homo sapiens
ctggtggagcttgctgagccatcgatatggcaaaagtcactgtgactttatattatagatccctgtgttcatctcattttcctatcctagataacactttttgagcagagacagtattttacatgtttgaaatcaccaaatcaccttattataggccaaaaacagccatttccagcctctgcctgctgatagtctcttgaaatagactcatcccttcagagtcctagtgtactctccctgtgaccccagcagtggctaccacaaggtcttgtgcaagaaagatggccgggaagtatttattgaaagaaataatggaatgagagaaagaaagttgggtggggggcaggggcaaggggaagccaaaggaggaaaggagaaataggaagaaaaataaagggaaagaaagccaaatatgcagggtcaacattcaggagggaagcagagacaggctgaagaattggaggaaaagagcaagagagagagacagggaggcacacaaacccaggaaaagggagacgatactgagaacgacggggcagaaggacagacggagagaggaacggcagcaagagtgacagcaagtgaaaggacaatgcatgtggctcagtgcgcagccagggtacgaggaggcgggaaagtcaggaggatgtgctatgtgctgctcctgttgtattactcaaacttgcccctgcattttctctgactgccactgcctgctttgctcaggcttcaggggtaaatacggtaattacacataggctatggcaggagcttcctaacctgctctcctgccttctctggccatccctcggcccacttgcacactcacacgtctcttaagccttcccaggacaggcccctgtcattattgcactaaggtaggggccgggcttgcatgggctctcccaggaaggagaggcccagggctgctaagaatcggggaccgagactttcagtgcaggaggcaggtcttgggttcaagacacaggagcctgtatgagagagagaaaaggagcttgtgagtgtgtgtgtgtgtgtgtgtgtgta

SEQ ID NO: 9516 - DNA, 1950 bp, Homo sapiens
attcatggcagcagcagggcccaatgcattctttttttttttgagacggagtctcgctctgtcacccaagctggagtgcagtggcgtgatctcggctcactgcaacctccgcctaccaggttcaagcgattctcctgcctcagcctcctgggtagctgggattgcaggcgcatgctaccatgccctgctaatttttttctcaagtgatccacctgcttcagcctcccaaagtgctgggattacaggtatgaggcaccacgcccggctccaatgtattctttagttgcctgttccatccatgtatctaatatctgtatttccttgatcaagtttcatttgtcttgtctttccctgtgtagttttaaatttaatgtcaagttgtcaaacaacggaaataattttgagtaactggggagctaacaagttgggtttcttgccttttagtctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaagtgtctaatggttgaatttgcaaatcttgatttcgagaaatgtattcatggaatataagactttgtcttggataatttagttacagttttgagaaattagccctgaaaaatgttccctgagaaagcctggattatatgattataatcacatttatatttggtagaagagtcagattattactttttctaaagtctatatgtatatcgctactgtatattcatgaagggagaaagaccctcctagatattggtgtattgagtattaatcgagggaagccgttaaacatctggttaacagagacctttactatgtgcaagataaaatatggaattaaaaattgt

SEQ ID NO: 9517 - DNA, 1041 bp, Homo sapiens
gttaggcctttatttttagttgcaaagtaagctttccctttgggactatacttaaacacatttctaaactgctcttctgggacagttaattatggagaacatgcttgacttctcagtgttggggctagcattctatatgccttccacctagtccagtgttgttgttgttttgtttttctcctttattccaataatagtgggaaaaaagattcatggaggaggatagacaaacgtttgttaagggatacacaagtacaactagataggaataaattctagtgttctataggataactattattaggagtataattaacaacaaaaatacacaatttgttgtatattttcagatagctagaagagtggattttgaatattcctaagacaaaaaaaataaggtgatgaatctactaattatttcccgacttgatcattacacattatatacatgtaccaaaatgtcacactgtactccataaatatgtacaattatgtgtcagtcaaaaagaataaaagcaaaacatcttgaatggtgttgcatatcctttgttatagtcgttataacttagctcttgatcaccttgtaatttaaaaaagtaggtctgggcgtggtagctcacgcctgtaatcccagcactttgggaggctgaggtgggcagatcatgaggtcaagagatccagaccaccctggccaacatggtgaaaccccgtctctactaaaaatacaaaaattagctgggcgtggtggcgcacacctgtagtcccagcttctcatgaggctgaggcagaagaatcgcttgaacccaggaggtggatggaggttgcagtgagccgagatggcaccactgcactctagcctggcgacagagcaagactccgtctcaaaaaaaaaaaaaaaaaaaagatagtagtactgtcttatacaagaataactaacctatggtagattagtgctatattgctatataaataattcatatctgtcatgtgatttccattttgaactgcctacagatagtgtccctcaacattttaatctac

SEQ ID NO: 9518 - DNA, 1027 bp, Homo sapiens
tccaagcactaatttacagattatctctaaatcctttcagcaaccctttgagatgtaggtactattattcccttcttagaaatgaggagactccactgggcacggtggctcacgcctgtaatcccagcactgggggaggccaaggcgggcagatcacaaggtcaggagttcgagaccagcctggccaacatagtaaaaccccatctctactaaaaatacaaaaattagctgggcatggtggcatgtgcccgtaatcccagctactctagagactgaggcaggagaatcgcttgaacgcaggaggtggaggttgcagtgagccaagatcatgccactgcactcctgcctgggctacagagcaaggctccatctcaaaaaaaaaagaaaaagaaaaaagaaatgaggagactcaggctgggagtggttatctaaggttgattattcagtacgtggaggaaccgtgatttgaatgttggtttgtctgactccagagactgtagtcactgtgttatattgcctaaagttaaggcttataacaaatttggagggccaaaatcataggttcttgaaatattattggtatcttaaaaatagtatattcaatcttgtggagtattgattgaaaatgcctgcatctatttgcaaatttataattttgttttgtgtagatatttgaaagcattttggaggcattacaaataattctgtttggggcctcccaaattcagtttatattttttctcatgaatgaggagacatgtccttttgttttttctttttttgtttgagattgggtctgactgtcacccaagctgaagtgcagtggagtgatcacggcttactgcagccttgacttgtggggcctaagtgatccccccacctcagtttcccaagtagctgggaccacaggcatgtgccaccatacctagctaattttttaaaaattttttgtagagatggagtctcactatgttgcccaggctggtctcaaactcctgggctcaagcaatcctccctcctcagcctc

SEQ ID NO: 9519 - DNA, 1033 bp, Homo sapiens
tgtagacttccttaattgcttccacttgctcacatatccctaaatcctctgtgtgaccttacagtagattgcatttagattaattctgaggcttgagtccctctcgttatgtgatcatgacatcagcaaccacaagggagcaggggattgagttacagtgatgggtttgaacttgattttatattttcttttttaaaatttattttattttgtgtgacctgtacatgtaaggacttgattttcctgtttaaaaaaaaaaatcagttatttgaactctttaagccatttggcataaataaagttatagttactataagtgttctttaaagagtcacaggtgatatcctacaatatagtggtggtggtctgaggaggcatactcagaggaactgtttttttctattccatcataggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccaggtgagcccttgactgagtagggttttcagcttctactttttctatgcagccccaactagactgatttatcttagattctgttaagaagagtacgacttattcacagcctttatattgaactacttgtgttagttgaagcaacagaattactggtcattaaagtttgcatccaggagtctgctaatatttgctccgtggagtttgaattccatggctcttactttggctttaagtttgtgggaaggggagggatatttagttgagttgagtttagatgagtgatcagagttaaaatttccagtcttcttaatgcagatgaccccatgtagtagcagagattcctgatcttaatggcatctaattgtaagtgcttcaggaagtaaagcacaaacctttaaccacattgctccacagggttaacagacaactgttaaatcaaagaataatgtggtatg

SEQ ID NO: 9520 - DNA, 1030 bp, Homo sapiens
atttgattttgctcaagtctatctattgactaattcagagcaggacttgaggatatagttgatttaatctctacagttggccttggtttgaccaaatttggcctaaaaccctttcaggtagcatttctgcctctgttcttctctccaagtttatatacagcctggctttattctgctggcagtgctgacaaaagtactctcaggtttgaaagaaaggaaggagtgaaactctctaagtattggtggcaattaagcaaaaacctaatccttctctgtcactgagaatcttattaaaatgggaagttgtgattcatttggatcagatgtttgtttgaagagtgtgtgtggaatatttattgcctctttgctgctaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccaggtatgtggcctcgtgttctgaaatggccttgttcataagaatcacaatttgattccaaatttgcaagctaccctcattcgtgttttgtttttctttgcctgtttatgttgtgtaatacagaggacggctaagcaaattttctcatgtatgaagctgagcagaagtcagaagttcaacagttgtagatattggcaagttcagcctcacagttttctgttcatttgtcatttgtgttataagttaaaatttaacggtaatttttactccggttttgttttgttttgtttgagtacttctgtcgtactccttcccctttacccttgtttttcctcttggaagtattgaagtcccataatgagtactgctgattgtaaagcctcatcaatctcttatcttctggccaatccagatgtgttttagaatttaccggtgttagtggtctttttctcttaaaaaataacttttacctttttttttttttttttttttttgagatagag

SEQ ID NO: 9521 - DNA, 1012 bp, Homo sapiens
ttctcactacccatctctagccactgttaacattttgatgtatatttatcaaataagaatgagatcatagttttttccctgatttttttcacttcataaagaatcaaatttctctgttacttagtattattttatagaaatacttaaaatgtatcatttattagttttttaaagtacagagatgtgtcaagatgtgtaagaaggcaagtagtacataatctcatgcagcaatattttaatatattccattttataaatatagtataattagctccttgtttttggacatttgggttgtttctgatttttttgctactttaaagtgtgctgtagtaaacatctttgcatgtttctatgattgtttttttaggataaattcctggaagtggaattgctgggttaaatgtgtggaatcatccagtcatataatgaagatactttaccttgtaggtttcaacctacaggactcagctgcttatttctccttccctcttttgtagttggcctctattactgctttagcaacctgtctgatgcccggatttttatcatcatgtatggtgtgaccagcatgtacttttcagctgtaatggtgaggatgccctcagtctggtagactttttcactctaactctgaggtgcttttttatctgtctggcagaattcagaaagtactgatgattgtgcacatgcttccctctgagcatttgagggaatgagttgtaagttgttgatcctttccaggaacgtatgggacactcatacattctggttgtggggtccaactttcttggattcgtaactttgtattatagaagcatttttgcactttgttggataatatgaccctgggtgtcttaaaacgggagatgatatttttttcttgaaggcttgggagtattacccagtgctagattgttagaggagggatttgaatttttttttttttttttttttttttttttttgagacagagtttcactcttgttgcccaggctggagagcagtggcg

SEQ ID NO: 9522 - DNA, 1026 bp, Homo sapiens
gccaggcgtagtggcacatgcctgtagtcttagctactcaggaggctgaggcaggagaatcgcttgaactcgggagggagaggttgcagtgggctgacattgcgccattggactccagtctgggcagcagagtgaaactgtttcaaaaaaaaaagttaaacagttctgaaggtttataataaaaagtgatagttcactgcccaaaaatctaagcccccttaacatcagtccccagaagcaatgattcctgcagctatttcttctagtacttacatgcatatttctaaatactgtgtatacagtttcccctccatatccgtgggttctgcatctgtgggttcaaccaaccacaaatggaaaatatttgtgaaaaaaaatcataatacaacaataaaaatcatacaaataaaaaatacagtataacaactatttacatagcatctacactgtattaagtattataggtaatctagacatgatttaaagtatatagacagatgtgcataggttatatacaaatactataccattttatataagggacttgagcatttgtgaattttgatattctggtgggaggggatatataagttagactttttattttttaaagaagataatacgataaccattaaaaaacaatgcagaggccgggtgcgatggctcatgcctgtaatctgagcactttgggaagactcttgaggtcaggagtttgagaccagcctgcccaacatgatgaaaccccgtctctactaaaaaaatacaaaaattagccacatgtggtggcacatacttgtaatctcagctacttgggaggctgaggccagataatcacttgaacccaggcagcagaggttgcagtgagttgagattgcgccactgcaccccagcctgggtgacagagcgagactccatctcaaaaaaaaagaaaaaagaaaaatgcaaaacactgttactgtctagatccatgaaaacatgtatgtgaagatcataaaagaagatagtgtagttgtccctctgtatcca

SEQ ID NO: 9523 - DNA, 1159 bp, Homo sapiens
tggggcttgactaaaccagtttctgtgattatcaggctcacgggtggggagagtgcaggaaatagagaaaaagttcacatgtttatatttagctacattttcttctctctctgaagaacttaaggtatatagagtcatatagaaccacataggagtatatctctcatataagaaaagattgagaacccttgatctatgtggagggtagatcagtaatattggtcctcacagaggtattccaaaaggctaagcagagagaatctagtctctagtcagtgcttgtgtattcacagccctaaaccaggctgcagaacccaacataatcctgcccactctgggtgaatccattttagtagaaaatttctccaaagttgatctgattgtaaatattaaactgacatctttatgttgcaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttg

SEQ ID NO: 9524 - DNA, 1017 bp, Homo sapiens
atcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattctt

SEQ ID NO: 9525 - DNA, 1033 bp, Homo sapiens
tggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctctttt

SEQ ID NO: 9526 - DNA, 1087 bp, Homo sapiens
tgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttggga

SEQ ID NO: 9527 - DNA, 1029 bp, Homo sapiens
ttggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggagg

SEQ ID NO: 9528 - DNA, 1050 bp, Homo sapiens
gcagtggccagatcatagctcagtgcagcctcaaactccagggttcaagcggtcctcttgcttcagcccccatagtactgagactacaggtttatgccaccacgcctagctaatcttttttctttttttttgagagatgggggtcttgctgtgttgcacaggctggtcttgaactccttcacagcctcaagcgatcctcccacctcagcctccaaagtgctggaattacaggcatgagccactgcgcccagctgtttgttagttattattcgtttggtacggcatctgtcttttctcccctatcttactgataatgtgtaccctttaatagctttctaagaggaattcaaattactgatttttaaacgtgttacaagtatttctcccagtttgttgtctcttttgccttcattatggtattgtttgcctttgtggtaggatgttttgttttgttttaatactgtgattctttaagctgcttgcttacctccccagaggtggagaaatttgttataactctgcaatagcctccctatagcagtctactgacccagtccctttatctcattttgaagtctttgccccttctacccttgaaatccttttgattgtaactagctaaccctaggatgctgagtcactaagacttttgaagagaagatatggttaggtatttcggtcaatgttgtctgtgtttacagaatacaagttgctctagcttttatgtgaaagtttccctctaaagagaaaggattgttcgatcttttatattagaaagagaaggaactgacagttacctatggaccttattaaagtttctattttatttattgtttgcaaacatcatcttcatatgttcaaggaaaaaaataggagtgtgacacagttgaaatgcagaggaaataacacattaatcactgtatagtaggacacatgccattaaaaaaaaaaactaactcttggctttactgccaaaaatcctcctagcccagagtctcacaaatcgttatttatgtataaatatataaaaagtgtcatttaaatttcaca

SEQ ID NO: 9529 - DNA, 1573 bp, Homo sapiens
tttaggatacctttttttatggcatctattggaaatgtatgaaaactactttatactgattggaagaacaacttccaggccaagcgatggctgaattgaggttaatgtttagtggaaacctcagcagactttgttttagcatagtctatactgtacctaccataattattgaattatagatgttgatctgtgtcagctaatgagatgagttcttaaagtctcattggtcctactctgtgatttttgtaatgttttttcctacactttgttttcctcaggaatctgcctttatgtccaatttagagcccaactaagtagagttgaatagacaagtgatttgcctgctggcattcagtactacagtattgcccctgccagagtggtagctgaaataccactcttgtggttttgctgaccttgatggcaggatttaaagggaattgaatttagagaaaagctgccccatgaagactagttttctctggtccaagtgtcttccgcctacgccctcatattctgtatggtcagctccttcttcatttataactctcaacctagggatcccctcctgagagaccttctctgaccatcctatttaaattggatacttattttttttatccagtctcttgtccgtttcctttgtagcacttagtattaacttgcagctttttttttttttttttgagagacagtttcgctcttgttgccctgggttcaagtgattctcctgcctcaccctcctgagtagctgggattacaggcatgtgccacaacgcccggctaattttgtatttttggtagagacggggtttctccatgttggtcaggctagtctcaaactcctgacctcaggtgatctgctaacctcagcctcccaaagtactgggattacaggcatgtgcctggccgttttgttttgttttgttttgttttgttttgagatggagttttgctcttgtcgcccaggctgaagtgcaatggcatgatctcagctcactgcaacctcctcctcctgggttcaagcgattctcctgcctcagcgtcccgaatagctgggattacaggcacccgccatcacgtctggctaatttttgtattttcagtagagacagggtttcaccatgttggccaggctggtctcgaactcctgacctcaggtgatctgcccaccttagcctcccaaagtgctgggattacaggcatgagccaccacacccagcacagtttttatcttggctgtttatctgttttctgactgtttaccccataggaatagtaacttcacttggataggtatcatgttagtctttcttaccctcataactcaaatacaaccctcatgtctcaaatatgacagttaggtgcttggtaaatatttttttgattaataaatgattgggctgggcacagcagctcaggcctgtaaccccagcactttgggaagctgaggcgggaggatcacttgagcctagttcaagaccaacctgggcatcatagcaagaccccatctctacaaaaagtttaaaaattagccgggcatggtggtgtttgcctgtggtcccagctactt

SEQ ID NO: 9530 - DNA, 1022 bp, Homo sapiens
cgcttgaacccggaaggcgaaggttgcaatgagccgagatcatgccattgcactccagcctgggcgacttagcgaaactccgtctcaaaaaaaaaaaaaaaaaaaaaaagattagctagaactcaacttaatgctttgcactgctagctagtataacggtagaagtacatggagcaggtgggaactgagatcagccttggaggatgtttactggcttaagaaaggtgtgtgttccagtctctaaataactgagtgcagactaggagaaaaatattgttcttatgcaaggaactggcaaaagccatctagatagacggtgtgagtagtagcatgaaatgtagtgtggacaggtaagctaaggccagaccaaagaaagattccagtgctgctgagaagagtttgagtgaggtatgaaatggcaaaaggattcatttatttaagatacttactgagcacttagaatatgccgggtgttgcgataggctggagattcagtggtgaaggtaaacacagcctcccccctcatggattttagagtatgtaacaatacaaactgcagttgtgtccaagagatcatgtagagtttgacctggtctgggggtcaggaaaggctttcccaagcaaggaattaactaggcaaggaagtggacacagtttaaaagcagagagcatatgtaggttccctgtggtgggaggaaataaggtgccatcaaggaactaaagggcctggagtgtaggggaggataagatgaacagaagccagattgtgcagtatcttacaggctgtgtttaagtctttggactttggttcttagagtaatggaaaactcattggagggttttaagcaagagggtttgtgattaaatttgtgttttgaaaagatatttctagctatattgtaaacatgttcacagcagggggtaggatggaagcggggaatcagtgggaacagttaggatgcttttgcatttgtccagttgagagatgatagtggcttggcctaggatgatggtggcagagg

SEQ ID NO: 9531 - DNA, 1063 bp, Homo sapiens
aactgaggcataaggcgctagtaagtggtggcggtaggatcttatttgaagccagcagtctggcttgtgagtgttctgttggtgtgtccgctatgctgcctttgagggacagtgtcccagaggagatacctgtgctcaggaacaggattgtacaaggagtggagaggaggtggatccaggcaggagtggagggaacaaggttaccaccttgttgtgaaagttcatggaataggctgggtgcagtgtctcatgcctgtaatcccagcattttgggaggccacggcagatggaacacctgaggtcaggagttcgagaccagcctggccaactggtgaaacctcatctctactaaaaatacaaaaattagctgggtgtggtggcgtgtgcctgtagtcccagctactccagaggctgaagcaggagaatcgcttgaacccgggaggaggaggttgcagtgagccaagatcgcgccactgcactccagcctgggtgacagagccagactcattgaaaaaaaaaaaaagaagtcatggaatagactgggatagcagggagctctgtgtgctgaagggagacaagggagtagggaaggaaaggcagtcaaggctgaagagcctgactaggaggcttggtcttcagccgctcagcaatgaggaaaaataggggcatttggggcagagaagtgacatgactgagctggactccccacttgtggagttggggtccatacatcatccccctgcacactcccctctctgacacacatacaccgacccacacgtttatctcaggcaggagggagccaaagtttctctgatgtctcctgatcagcttcggaacaagtttccctggataaacacagagggagtggctttggcgtcttatggtgaggcttgcttgcagaggggacagcttttttcctgaagatggagactaaggggtgctacacgttgggagtctcggtactccacagccaagctgaaggaggaacacttccctcctgtgtcacgggaactgccctgggccgtggtagttctctgtccttcatcaggctttgtctctg

SEQ ID NO: 9532 - DNA, 1024 bp, Homo sapiens
gctcagggttacacaggcaagtgagcataattcgtctcttgacaagaggcttgtgggaattcccaaatgtgacccaaggggtgggaaagaatttgaagggattttccgaagttgcagcattgatcgatgattccctagagccaagtaagttcaaagaagagggctctccttgtgtggggcgctgcagtgagaggctaaggggacgcctgcatccactctgcccttccctgcagcttctctctgcctgtgccaccttcaggccttgaaggagggagccaggactggctctgtaggcatttgaagaggtaggacctgatggtcccttgtctcaaactgagtggtggctctgcaaacccccatctgtcttgtggggctgccctgcacctagagatccggggtcagagcctgggtcacaggaggcggggcccaccgttaatgagaatcccagcagggccatagaggtgtggggtaggaggaggaccttctgccgcaccagactcttgaagactgaagagcttgccaggggatcgcagtcttaaggtcatggagggacaacaatagacttgtccgtctgtattccagaagccctgaatgcatttgagcccacggcagagaagagaaatctgccgtccttctgaccccagtgcctccaggctctgcttcagctgccagtggaacctccctttttctgtcccctttaagacaggaaagactttaggagctgcactctggctgccagccacagggctggaattacttgtcctcaagggtcatgaaagggccagcttaaacgtcacactttgcttcatagcgatgcaggtgtggtccttcttaacatttgcttaattctttttttttttttgagacagagtctcactctgttgcccaggctggagtgtagtggtgtgatctcagctcactgcaacctccacctcctggattcaagcaattctcgtgcctcagcaacccaagtagctgggactacaggcgtgagccaccgcgcccgaccttaattcttacttga

SEQ ID NO: 9533 - DNA, 1030 bp, Homo sapiens
ttgctctgctaaggaccagagatccacagattaacgtacattaagatacagctctgctcatcagggagatggacttgtagataaataatttcagaatgtcagtcactgggcatggcaaggctccttagggcagtttcttttccagcgtgcaggcctagtgcaggccttagggagtcacaaggaataaccatctgtgagatgctggcgacatgggccacacctgttattctcatgaaaagttaacttccttagagatgccaaacagcctgagggcaaggatcacttcctgcttgtctctgggtcctcccacacctggttcagtgctttgcatgttgtggtcactgaccttgcctgcttttgggatggaatctcttaattatttgatttgccaatgcctagcacagtgcctgatatacaatagagctgcttcaaatggtatgtatatgttgaatgaataggcaaagtggcttagctctaaattactgaaaattaacaaaattattagacataagatgaaaaagcatactccacacacagtgggcatatgaattaatctgaataaccacagtgatgcttaacctgtgacacacgagaggcttgccatgtgtctctgctagttgcacggtataggtagtaggttccctcctactctctgggccgggatgtttcttctcccttgcaacctgctttcctcgtttctttttggagccctgtagaatcagccaaagtgcggccacccggctgcctcctcactaaggagaccatgcggttcatttttccagtaaatgctctggcactgtctggactggagaccttctttcccatcagattcaacttctaagtctgccccttcttgcagatggggctgtcttggggccaggaggtgaagggaatgcgagaatgacgatatcctcaaggggtggcttagcccagagccctcagcaagtcccttctgctcccacctgacactgagctgcccccactcttgcctgtggatttggactaagggatgtggagacagtctgaggca

SEQ ID NO: 9534 - DNA, 1030 bp, Homo sapiens
gaggagccctgatggcacaccaggaagttgggctttgtccagcagatgtggggagccaccgagggattttaagtgggcaagtaacaggaccagatttgcattttagaaaggctgctttctcaaggctctcgagggtggattgagaaaagagacaaaagactacaaggctgagaccaactgggaggctgctgtaatcatccaggggagcaatgatgaggcctgaagtaaagaagtgatggtggaggacaggtggggcacacatttgagacactttttgaagtggaattgacaggacctgaaaatcaattggagagagaaagcgtagccgagggaaaagtcagtttgattcagtaaacgtctgtgagcctctaccagggcctgtgtaaggctccgaagaccccgggatgaacacagcagcagctgctcaccctctagcaacataaaccgctaatatttcttgagcacttattgtgttccatgggcttcaagcccttctgagttttgtccacttcaccctcaccacagccctgtatactgtggctttcagacccatctcatggatgaggacatggaggcaccagaaagcccatctactatattccttgctctgctgcctccactccaacatgttacgaccgaggcaaccagaaacttctagcatggttgtccaggtttctgcttggacaactaggtagatgatggcccataaatggggattcggaagaggaggagcaggcttgatgtgcctggagaagtgatgagttgactggcaatccagtccccaaggaggaacctgtgtttcttgcagactgttttggtggggtgcgggggatgagggagagggacatgtattgaatatctataatagctatgtgtgtgtgtgcgggggaggggaggggattatatgttatataacaacatattgtggcaatttatgcatatgtcttttctccttactgaagagccaggctctctgaagggtagactgcatttttgttgttgttgttgttttgagatggagtctcgctct

SEQ ID NO: 9535 - DNA, 1031 bp, Homo sapiens
gacctaacctagtctcagaggtcaaaggcttccttaaggaagtgacatttaggccgaaccctgaaagataagcctcggagtcagtatgaaagagaacaggccttccaataagtctttactggatgagtgaatgaatgaaatggccacccggggcattgctaaattaagtaccttgagcttagtcatcctaaccatagtccccccaggcattatctgtgtggccataagccattttcttagccactctcttcttcagtaaaggcaagtagagtgtaatgaagaatactgtgagaggacaattaccttagaaggcattatcagactaatgttttactgagtgcatagagtacatatctataggttaatatgcctttactatgcaatgcatccagaaatttcaaagtcaagaagattctaggaggctgaattccacctttagaaatctcagctatgaaagctctgggtttcaacttgatataactcttcactggccagaaaaaaaaaaaaaaaaaaaaacggcaactctttggcaaatagagctctggaagatgcgctggctggcgccgacataaactgctatcctgatctccatcaaagatgtgggccttctcatgctgcagtttcctcaactgcagaacagggagattcttccaatgataattttacctcgaagtgatgttgtaataaagatggtggtaaaagcattttgcaagaccaaaaaaagaaacacctactaaacaggcatgctgtctatatctggtgtttgttagaatttctgaggaaaccctctggtctaagattctagagagtctacagaggttgataactgggattggcttttaagatcttttctggaatggctgttccctttacctcattattactttaaacaactttggcaggagatatcagtaatgccaataacaataatgatgatgatgatgatggttactgagtagttactgatgagcccagcactgtgctaaacacttgaaggacctttttttttttttttttttgacagagtcttg

SEQ ID NO: 9536 - DNA, 1050 bp, Homo sapiens
ccttgtggtcagggagttcctacatgaacccaaacctttgggggctgggatgtttactcttggcactctgggatttcctgtttctaagaaaatgggcctagatgctcagctacattaaccaaacaacatgttgacacaaatgaatctgaagcttgcccgctccaggctctctagaaggtcaggtttgggaatgaaggcatttgggtgactttccaaactctgaatcccaagcccagtgactcaggccaggtattaatttgagggatctgcttccctcctcttcctgcctaagaaggccccactaagtggctagagtcagaggctccctggtcatcttgagtagtgggaatgcttctcctgtctgtctgcagctggtcttagagggaggcagcccaggtagtatggtaggatgctccaaaagacccaccccgcagaaacctccatcacgtttctgtctgcctgaaatccttgccatgggttcactcctttgaacgtccaggaggttcatgtaaaaatgtaaaagttaccccctgacgtgacttaaccatatgacatttgacacacgactatatgacatttactatatggctgagcctagcaaggtcctgggaatatggaaaacctgaaacattttgacagggtatggaggagaggaaggggagaaagcagaggaaaagctgacaaggtcaagggatgcttctcggagaagggagaagggcaggaggaggatgttcaggcaaggagcagagcagcctggagatgccagtttggtgattatggacaccttggctgcttagccagaggtggccctcacaatgccattcctgctgtgcccactgcccagagtgccagcaaacactgcaggatttgcttgctcagacttcaggcaatgcagctttgtctgctggggagaatcttaccatttttaacctgtatttgaaccaagagatttgcgtgacctccacaggaaagtgcaactatcttccaaaaatgtataaattatcaaagatgtattctataacaaaaatgacagtccttgagatgtggtgg

SEQ ID NO: 9537 - DNA, 1090 bp, Homo sapiens
acaatgccttgaaatacaagacaaccaaggcctcacctttctctcattactcaaatgatgcaaagcccgaagccctctccacctgacttcatccactaccgcctgagctctccaaatgcttccaggtgggacacccaagttcaaggcccctttgattcctggttatcttctagctgctgagcctctgcattgtatagcgtgaacagagcccagctttgcagccagaaagatctggcttttactcctggcaccccacttcaagctgtgtgacattggacaaatcacatatcctagctcaggcgcagtttctttacctgtgaaccgtctgtcccacctaccttaaagagttgccatgagggccagacaatgcaatgactaagagcgctttggaaaggagaatgctggatgcaggtgtcgtcgttattagtgtccagcccatcctttttatgtgcagctctgtgaagacatcttcccttgatgtcagaaccaaaaaacccaagcaaagcaaagacccagggctacatttctgctctggagtctcttgtatgacagtatctatgttgggcttttcagtgtgtaaaccgaaacaaaacaaaacaaaaaagaagaaaaatcagcagcaaatactgcttggttttgcattttcccttctgttttctgattagagtctctatggcttatgagtgcagagagaacctcaaaagatcatgtttgctgcggataagcaccaaactcgatgtttatcagcacttatctcctgcaaactcactctctggaggcttcaaaggctgagggagatctcttagccttgctctgaggagacaggcaggcactcctccccggggcttcagctgcaggtgtggcccaatagcacttgctccattcttaggaacgtggttctcttgctcttccccatgcaaaaaaaggaagcagcaggtttactgaaggtatggggatgagctgtggggtagagggagcaggagaagaaaacaagtattttaaaacaagcccggaaaggctgagaaagtaggtagagagggaaagggaaaggcacactccttacgctcctgctgcccccacccctcaaccc

SEQ ID NO: 9538 - DNA, 1033 bp, Homo sapiens
agctgggcacatgccaccatatctagctaattttttctttctttctttctttctttctttctttctttctttctttctttctttctttctttctttctttctctctttctgtttttgtagaaacacagttttgccacattgcccaggctagtttagaactcctggactcaatagattctcccacctcaggctcccaaaatgctgggattacaggcatgagccaccatgcctggccaaggcttcttttcttaatccatgatctcccaaagtcacacccaagtcagtgatgggataatatgagtgggaggacccaacaacctcttttggagggtcttgccctgactggcacttcacgtgtctgaggttcctctttcgtcctttggctggctgagtcatcaacattgagatctacaggatgcaccagcacctcctagagggccctcagcaaaccactgagcatttcttacaagctacacccccacaccagatcttctcatttaatccacctatcgactctgtgctaaaactatttttatccctgttacaaataaggaaactgaaattggcctggccacagccatgggcaccacccttcccttgtgtgaccttgagcagcacacctagcctctctgggtggatctcactggccttgcctggaaaataaatgctggatctcatctccccttcattgctgatgactccactcagctcgtaagaggcatttctgcttatgcctggaaaaatctagcattcacacaccaccacaatactatattccatgccaagtcaccactattcttggcctccctatccccaccctcctttttgggggtcccagactacagaaccaataaacaaacccactttcatgattcctccatccccactccactgcccaaagtccctcctcacccaggtaacctgcaaacacccatctggtttgcataagggcaaacctgccccctggagtgtgagtcaaacaggaacttccagacaagctgtcctggggcagccctgggccaccttgccagct

SEQ ID NO: 9539 - DNA, 1099 bp, Homo sapiens
aggactgggatattcacttccttatggtccttactctagcgttactctgatgcctcagggaaaggacctgggatggtgcctgagacgcgttaggaaagtgctctatagtgacagtgattgttatgagcaaagacttgaaagacagagaacatcagtcttattcacaaaatatcagataatctactgggccaaaggcacaaagagatgaaaataaaaagcaacagagggccctgaatggcaggctgaaaacatgtgccatttattccacagccagaggctgactttgagcaccgatgtgacatttaacccagaggctgactttgagcacagacgtgacatttaacctcatcagagcagtgacttaagactagcgagctgacagtccttgcgcacagacggtaggatgggagagtcagaaagacaagtgaagaagttagtaaaatatcccagataggaaataatgaagttcggaactaagtgatgatagtgattttggaaagtgaaaaggacagatacataagggcgatagcaaagagatgattaacagggcttaggtgagtaaagtgtgaatgaagggggtgcatgacaggaaagaatcaaaggcgactaaagcctgcacattttaaaggctggtgctgtgagcagccgcagaaaggtggcacaggaaatgctttaggatgggatgtcagtgttctctttgagattccttgtgagcaatgggtagaacatccagataaaaacgtctactaggctttgggaactgaagctcagataatctttcaggcctggaatttacgtttgggcatcatctctaaggagtctgaactgtgaaagtggatgaggtcaccgaggaaactagtctagattgaagagagagaagggaatgagcatggttgggagggagaactcctccagagcagctcatggcctcagacctgcctgtgggaactgccaggcctaccacatttcaaccctactaaccaaaaccagtgactgggatctcagccacctttccagatcccaggatttcaggaaggctcagaggttctgagcctgcagcccctcagatgaatctctctccagatgtaattctgatggt

SEQ ID NO: 9540 - DNA, 1029 bp, Homo sapiens
aaccagtagcaatgttcacagaacacacacaaacagaactcgaggagtcaagagctatgtccagtggtggaaatgaaggacaagggctaccctaccctcggcagctctgctgtggcctctgtcgccctgagatggagatgtgctgagttattacacccttggggccaccgccacctccctgctctattgtggcagccccaggctctcttgtcacctgtcccagtgctatcagctgccagtgggccccagccccatgctagctgtaagtgcaggtcttaatacaaattagcagcagtgcaggcaagctgaatggcaaaacctcgtcccgcactccccctccctcttgttttcatcaagccttcttcacaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgaggtatggctttccttctttctctccctgagcagtgggaggagggccagctgggcaagtgtggggaaccaggatggtgccagcccttctccctaaggacacccgcctgcaggtcctagtgcagaagcctgggaccgaggacagggccattttccagaggagaaacaccctggcgggcgagcggccaaaccgatcacctgtccagctggagagcaggtgtgtgcacagggccgggggagggagagaggaggagggaagcggaactgggagaacttctatgggtcagtgaatgaggaggttctgctcagggaatgagtggcagcggccaccccagcaagagagccccctcctcctctgcgtccactttcccttcgtctaggtgcccatggctcctctccttacaaggtcacgtgttaggcaggtttggggaaatgtttctttcagcttttcacatttattttcctccaaccctggcacctgggaccagccctg

SEQ ID NO: 9541 - DNA, 1030 bp, Homo sapiens
ctgtaatcccagcgctttggggggccgaagtgggtggatcacttggggtcaggagttcgaagcccagcctggccagcatggcaaaaccaccatctcagctaaaaaatacaaaaattagccaggtgtggtggcaggtacctgtaattccagctactcaggaggctgagacatgagaatcgcttggacccaggaggcagaggctgcaatgagccgagttcgcgccactgcactccagcctgggcgacagagcaagactctgtctcaaaaaaaattttagcgatgtcaattcatttttaaagtggtggcttaagggtttggtctggtttggtttggttttgctgagaaagaaaacttcctcggcaaatgatttttgccagtgaagattttagtacacgtcacaatagaattcctcagcgtctttatgaaacatcgtgaggagtggttcagatactgttagatttcaggcattgaaacaagtgaataattcatagtacctggtttaaaggaggaaaagatgtgaacaaataattattaggaaccagagagagactggaaaaaatatttgcgcggcatagcaaaaattccacagaggaggggacttttgaataggagcttgaagaataataagagtgtggcaggcactctgtcctccttggctcgctgtctgtccccagtttttctttaactcaccctccccaaaatatataagaaaggcagaagttctcaggatcagttacatatagcacagcactgcaaaacctttcagagaaacaaaggctcttctaagggaaggaccatttggcttaaaatccgcatggggtgtgaaggaaacagagagccaaaggcactagctggctgtcttgcccaaggttacaactttgatcacacagcactttgtgtttcctgttaacaatttataatttaataatgaccagaacatttagtggaagaattatacaacataatgaatccgcttttaaacatttgtgtttttcatttgtttccttctctcctatcccaccctgagcca

SEQ ID NO: 9542 - DNA, 1076 bp, Homo sapiens
ttcagggaaaattcatctttttccacccagtcattgagagcaaggttttatgacacagaggatgaagagagaggcttttgtgggctgatgtcgctgtgttgctggcctctggtcaggtcacaaggtggagcgctgcatgccggcagggacgtttgggctttcagacagcagaggcatcagagcagaagcaaatatcttcccaaagatgtttggccatatttctaggaccaggttaaaagcttcacacagaagctaagttaacattggtatgtctatgagagggtcatgtccagaaacagctttcgccttccaacagagactttgcggaaaaaaatctccatgctcatatttctctacctcaggaggctctcctggaatctaagaggccatttagtgtcaaattcagccccactaagcatcacataatggtgatactgttaaggacatcatatatgtgaggctgaattatccacaatggctggcaatgtcttcattctccagactgaggctccggcctctttgctttggcaagagttgatctcaggactgcctgaaaccagaaactccaggcaaagctctttgggtcactcttctgaaaaggaatcacaataataagatctgttatcttggtactctgtaaagccaaggtgtcagccttcacgacagtgaaaagttagtttgtcagaaccagggtgtgattgtctgctgattaagccatctgccaccacagaaacagaccaagatcatcaactggtacactggtgccgacggccacatttttacacactgggcctttggctgccacctcaagtttgtcagttctcaggaggcagactccaggcaccacattcgagagggcctccatgcacgctcaggcttcttctcatagcaggcacaccctgcctgagccccactccatgcgctgacggagagtcggggcaggagctctcatgcagccaggtgttgggctctgcaagggggtttgtgtggggatgtgagccactgggtcagctccctggttcaggcttctgcattcaggttatagacatatctctgtgtgtatgttggggactaga

SEQ ID NO: 9543 - DNA, 1076 bp, Homo sapiens
tcttctctggctctgatttttctcaaagcaaatgaaaaaacgattagaaatttcgttcacgggttgaaatgcccctccaaatgtccactgttcactatcatttaattcagtaatttcatgcaacaaatatttatatttgcttggtgatggcattgtcattgagtctattattttgaaacttaatctaactgttgactagcagttagggtgtttaaaaaatccctctcaactacttgtagaaccattgctaagcccttctttgtttgttttgttttgttttgtttgtttgtttgttgttgttttttcctagtgtatgtgagaggcagctcggaattgggataggggaacatctaatacttttgcttactatgtggaattttctctttgaactctacctacagggtgttatcaccagcaaaactgtcaaatcaactttgctacatacaactcaaatgaaactctattatgaggctgatttcctacagatatgtttgttttttgctggttgtatttctggatccaagactgaatttgtgatagaaacatggatagtataaagttgttagttttagcatatcctagaaatcagagtggaaagattaaatgtaacatatcccaaaaatctatatgaaaaggagttaggattgcaaaggattattttatttataaagagagattgaaaggaaaaaaaagaagggaagaaggaaagtaagagtgggtttctttgaaattcttgaggctgcacagattcagcctcatagcacagcattcctccgaagggctgtacaggcaaaacaaagctggcttgtgaaattctgtcgctccatgggtactaaatggctaaagttgattctacttagacgcgtgctggggcctcttcaaggttgagatccagagcttaagctctgcacagcatttagccttcgctctggaagactgagtaaatgttaaaccagaagcaattttaggtgttatttgcactttgttttgaggtcaggtaggaggagcagcagagatgcaaaggtaggtacgtcacatgggctgaggcctcttcatttgtttttgtttttgtttta

SEQ ID NO: 9544 - DNA, 1059 bp, Homo sapiens
agaccgcacatgtccacagaactcttaatcttgtggaacttttgatctttttcttaatagcttttctatcctgaaacagtagcatttaaatacagagcttgttgtacatagtctcacagtgggaaactgagaacactttataactaaacatatgtacaactcacactgaaacaaccactgtggcttctgaaagtggcttttggatcttactaaccttgcctggctgattgagggtattatttatcaccaagataactgctgtttctccagtaatgctttggcatagaataaatagtctctgagttgggtacatgctcttgaaggatgactagtgaagtatttggtcccccagtcgtgcaagagagagttgtcagggtttttctgcttcttcttactgatgtttaaaatcattataaactgcctctgattgcaccttgcttttatgagtatttgttgatatgacaatatactacccttagcatttcaccagtggtcctttgctattgacagtttcatttacagaaattatctaaggacagctgtgattgaaccaaataatctaaaaatgttaacgtgtagcttcttagcaggaaagaataatgttgatattggcatgttattatctgtccaagttctctttatagtccataatcatgatctgattttaaaagtttgttcaatatatggtattggggactgttagaagggatgaatgttaccatggtgatctcacagagatgtctgttaccagcaatcagtgggcatcctattgtttggaggagtaaacctggaccacattttactccctaatgacaaccatagtggcagaaactttattcagcccaacaccaaagacgtttttcttttctcagcaaagtagtcccaatttagaaatgttgctattagacattttggcaaaaacgtggccttttgggagctctatctttctgtgtccttccaaagggaaagtattagtgtggaggaaacagtttgtacaatcaagagtttgccaaagcatttcccttcctgccaccactcctgtctgcctaaacaaataca

SEQ ID NO: 9545 - DNA, 1073 bp, Homo sapiens
gcctggaagacagaatgtcagaaaggaaagtctctggtaagttgtacagaaagtcctcaaacaacatcgtttcattcaatgttgtttcattataacgttgatgaaaaacattaatcttggcctggccactgtccgtgtggagtttgcacgttctctccatgtctgcgtgggttttctctgggtccttcagtttcctcccatgtcccaaagctgcgcacatgaggtgaacaggcgtgcctacatggtccctgtgtgagtgagtgtgggtgtacatgtgagtgcgccctgtgttggggggtgtcctgtccagggccggcccccgcctggcaccctgagctgctgagaagcttctggccacctgcacccctgaactggaaaaactgggtaaatacttaccctacttcattttattaatcattcttcaatgtttatgtagttcatatttatttcagtgtttcatattagaaatctcttggcctttgtttggaagtttgatgtttttgtcgctagaaacgtgctgtaggaacttcactcttgtttatatcaattggcctgtgggaaaattggtttcttatattggtttcacttaaagccgaagtttccaagaacctttctataatattaagtgaggactttattttagaattgtgggaggtagcgtgatatatacttaaaggaggatggccatgaatccaacagacttctgctcaaatctcagacatgtgacctcatcatgggatagtttctgtgtggagtgaaggatgtatgtgcaaagtccagcccctagtggtgcccagtgagtgttccttccttttgtccctctgtccttggccttgagacttgtgggggaatctaaaagacaccaggctgatttaggtcttgtggagcctctctgcttgtgggcggttgactcttcctgaggccctcaccacaggtgcagcattactggcaatattattattattattcttgtttttgagatggagtctcactctgtcgtccaggctggagtgcagtggcacaatctcggctcactgcagcctccgcctcccgggttcaagcgattctcatgc

SEQ ID NO: 9546 - DNA, 1112 bp, Homo sapiens
ggtgcttagctgcctcttcctgttgctttaacctctggtattttaagattctctttagggaagatagtactgaccatctcagcacagagccgaaatgcacttagcgctgatgtgttgaccttagtggttgacccataaactgaacatttatacagttggaactcttgcggtcttttagccaacaaccataatgagtaacatgtggaacataatctttggtgctgataaatggctttttacgatgaaattgaccattccacgctgtggcttgggtgacctcatgtaactaattactgtttcttagctatattcacttttggaatttaaggggtaaatggtttctccttctgcaggctgaactgctgacagattaaataccacctgaaatctgatttgtttagtagctgtctttaatgtaaaaatatagaaggccagagggaatctaggaaacactgctcagaagctttcagacttaactataggagttcattcgtagcaggtttaggaagcacattccttccgacctgtagattgggcttttcatatacgtatttatcatgtcttcttggattttcttcatttaattctatctgaactttcgaagtgggaagcaaaggattcgggggagagcactggtttcagtacacgaaaatatccctggggtttccttacctttatctttggatatccccatttttctcgacacacaatccaagtttctagccataatccttagattacaaaagaacaggacttttggtacacatctttttttttttttttttttttttttttgagacagattctctgtctctgttgcccagtctggagtgcagtggcgcaatctcggcttcactgcaacctctgcctcctgggttcaagcgattctagtgtctcagcctcccaagtagctaggaccataggcacgcgcccccatgcctggctaatttttgtatttttagtagagacagggtttcaccatgttggccaggctggtctcgagctcctgacctcagatatccacctgcctcagcctcccaaagtgctgggattacaggtgtgagccaccgtgccgggcttggtatgcatcttgaactaagtgtgaagattaa

SEQ ID NO: 9547 - DNA, 1061 bp, Homo sapiens
tgggaattgaacaatgagaacacttggacacagggtggggaacatcacacactggggcctgtcgtggggtggggagaggggggagggatagcattaggagatatacctaatgtaaatgacaagttaatgggtgcagcacaccaacatggcacatgtctacctgtgtaacaaacctgcacgttgtgcacatgttccctagaacttaaaatataataaataaaataaataaaaaagttttttcctttgcctttcactttgatcatacacatccagaagtcactttttattctgttctagctcctgggaaaaggatttgtttgtgaagatacaaatagtaaataattaaggtttttaaaagatgcattctgtcacatagacctgaatgactgttgcctctgtgctagccttcttggagtaaacctgcaatttttttccctttggtaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggaggtaagagtgttgccagtaagttgaaagtgttatttttctggggcagggttgaatctgtttaccttagaaatagatattctgtcattctcttttgacctaagaccaagatgctaatgactggagccccaagccttttgtttctaaatgtgtggcatgactgagacctctcaaaggctttgcctgcgtgttctgtgagctctcagttctttaaggaagggatactgcagaagcctggcaagtgccatgggagtgcagcctgcttctcatcctcccacttgtcttggaagatggaaaacaaaacatgtctccttactgacagaaagccaccagtattgtaaaggatcatctcaggtctgattcaactctgtgttaaagagaaaatgataggagatgttataacttgtatttattttttctgatagagacagggtcttgctacattg

SEQ ID NO: 9548 - DNA, 1058 bp, Homo sapiens
cttgcatttcattctagccattgccaatcacaggagtacctgtgatttttgtgtttacatcattctgagctgttattttctgcaggttactatgatattttttaagagtccgtgtcatttgtttaacataatatccctgaatttggatttgtcttattgttgtatcatgattagattcaaatgttcacaaatacttcccgtttgctgatgtagctgggccccagggcttagtggcacggtgaaatgtgcgttgagcttatttcctgcctctgtttttgtgtttcagaatagagaagggacccattgttgtgctttgcacataggagctattaaccttcctttttttctattttggccttcagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaaggtaaccccatgtagagccatggctttgaaatccatgtggtaattattcacttagacttttgcattgcgtctgtcacaggtaagtcagtcacagaaggaaaggtgtggtacctctgcactgaaggtgagttcagctctccagtgcagtgatgggatggtgccgtcttaacaaagtgggcaggcaggcacatccagggagagatgtaggattgaattagagaacggggactagagagtaagagagacaacgtagtccgcccttcagcaggattcttccacattcatcctaaaatgttccctccccaaggggagctcccctcttcgataccactcaagttctggcctcctagaatagaaatggttttcttggtttttcttttcctgcttgtcttctaatctgtaggctgccctatttgtccagatgttttagttgggagggtgaaatttattgacctgctggtaacagattggggcctgcagtttttttt

SEQ ID NO: 9549 - DNA, 1179 bp, Homo sapiens
agggctttgcaggttgagaagcatcaagtttacttccagtgggagcgtttttgttcttctttgaaggggctgaggctggcggatgtgccggcttcatgagtgggtgattccacagggaccgagggtgtcttcagaaaaaagcatttcggcccgctgtcctctccactctggtcccagggaggctggaagcagcctgtgtttgctgttccctttttccagtccagcaatgtgaaccaaaggctccgtctccagcgctcaggcctttatagcacaggcatgtgtcactgatccgcatgatggactgcagtgcttgaaattctcctccactgaacttgcgagtgtcttggggaatggcatttaccaagttatcgattctaatttagttaatctgaaagtgggatattgacacccttttaaaacttatgtagggctcatattcttcatgactttagttgtcgtttttaggtctgttaaatgggcaaataaaagatgcttccgacagaaaaaagttgaactggctggctaatttgtagctgtattcatcaattatatggttgttttaatgtattaaaatgatacaattctagaaattaggtgaatttgcttctgaattaaaaatcagttgaaccttggcattcactctccacttagctctgaaattgtgtcataatctatcaagcaagtccacaccagcttgggaaatcttgcatgaattaggctagtaagtgttaccttaggtatgtcttgagaggctgactgagtaaacttgtcatctcagtcctttcccttatcaggctaaattccatcgtgcagagacttgcttgggccccatgagagattatgcccatccagcagtcgggggtgctccaatgggcctgtgctctggggaacgcttgggaagccctattggtcagtgtcatggatcaaaaagccctatcttcatatcggtgaaaggtgtccttgtcaaatagagcaactcagttttatccttgttggttctgtcactgatggtggggctaagagtccttcactgatactgaaaactcaaaattatagctggagtgatggggactttctctacccagcgtatatgcaaagaacattcacttgagcctgttttctgttgtaaattaagactcaaagatagccagaagagcagaggtacctgagtaataaatt

SEQ ID NO: 9550 - DNA, 1075 bp, Homo sapiens
agaaaggggtaaagtaatttcttctgaaactcttgtgtgagtggtctcaaatgattttgtcccttaacactaacctgccttgctttgggggatggaaagtattgggaggatatttgtgtccttaagtaagccggttaaagtcttctctctttgggtgacacaggagactatctagcttataggtgtcagaggctgagccaggaaaaaggacagatcagaagagaacgggagtgggcaggagattctggaaaatactgtatgttaaggagccagtataactttggaacttagttttgctattttacctagacagtttttttgttacttggtaagctaaaaaagccttccagttacagctttcattcttgtgcctagctgagctttacattcttaagtgaactttttaagcttttgttttcctgcctattttcaattctctagtctctggatattaaaacaactgttctctcttgcagcctcatcgcattctccaggccttacggcgttatgtccgtgctgagaacaaagatcgcttacataccatccgtcattaccagcatgtgttggctgttgacccagaaaaggcggcccagatgaaatcccaggtacagtagatgtagtagaaattgctgccgtgagggcatttccagtggggaacataatgccttgactaatggttgaccagcactgctagttgcatttgctactagtccttagaaaatgagttttgatttccgaagacattcggtacgtgaactggtttttgcaaggtcactgtttttaaaacatctttttaaatacttttttatattaactgctttatacttaaacaatttctgaattttttatatcatttatttctgatttagggtattgccagaaccaatattcaagatccttttctaggtatatttatcaagcagatcttaaaaattggtctcttgttttgtgcagtatagtttttgtttagacagacacttttacattcctaggttttgtccagctttactttcatctacagaggtttgtttctggttcctacttctaatattggtgttgttcatatattaacttg

SEQ ID NO: 9551 - DNA, 1087 bp, Homo sapiens
caggatcttgctctgttgcctaggttggagtgcagtagcacagtcatagctcactgtagcctaaacctcctgggctccagtgatcctccagccttagcctcccaggtagccgtgactgcaggcacacagtactatgcctggctaatttttgtatttttggtggagacagggtttcatcatgttgaccaggctggtctcaaactccttcgctcaagtgatcctgctgtctcaccctcccaaagtgctggaattacaggtgtgagccaccacgcccaggctgaacacgttcttatactttagcagtcagtaaatatggcgtgaggattaatacatttcccctgaccagttgctttgctagactctgtagagaatatgctttgtaaagtggtttttccagaagttgtgtcgatgttccagctgcaagttccctcctggcctagttgttttcagtcacaacacctctccaccataactctgcttccaggtgatgacacatctccacgtgattgaagaaaggaggaaccaaagcctctctctgctctacaaagtaccttatgtagcccaagaaattcaagaggaaattggtgggtaccagctctttgtgtcaaggtcatacgggacttcttgcagaggctcaggagtgaaagctgggcaagagtagagagagatgagcaagcaaggccggtgaagtggggcattagcacatcctggcttcagaagcctggagtccactggagctttcatggcaaggtgaaggaggaaccaaggacaggtgcactggctgtgagccatggagcctcgggcttcactgaccttcactctgttagcggaagaatatctggggtgtgaaattgcaagagactacgagtttcctgttcccgttttcctccttcgttctgattatttcaagcacctgattttatataaattctcacctcctcctctcccggtctttatcttcttcatttattcaacaagttttattatggctgctgcgtgcgtgtcacagagtaaaatggtccacgagcagatggtacctgctggagttgatgtgttgataagagaaaaacagatagtaaaacaagaa

SEQ ID NO: 9552 - DNA, 1693 bp, Homo sapiens
agcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaatgtggctttttttttttttttgaaatggagtcttgctttgtcaccgaggctggagtgcagtggcatgatctctgctcactgcaagctccacctcccgggttcacgccattctcctgcctcagcctcccaagtagctgggactacaggcgtccgccaccacgcctggctaattttttgtatttttagtagagacgaggtttcactgtgttagccaggatggtctcgatctcctgaccttgtgatccacctgcctcggcctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcattaggggtttggggagtggatttggaaggctgtgacagaactggttggttaatgggggtcccacaggtacctgcttccttccatcaagcagcaggtagcagaggaaggaggcagtaaataccaaactccccgttcacccagttgcttgctgcc

SEQ ID NO: 9553 - DNA, 1373 bp, Homo sapiens
ttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgagactgctcgtttcactgactgcggcattgatctgcgtgatggtcctacccccttcctccaggagggtgataacttcgttccacgaaggaccccagctgcacctcacaggcggaaatacgtctgctcaagctgtgactcaaggcttccagcgccgtttcgcatttagaaagcaaagtaagagggaacatctgcacagagcatttgtctggcaaaatttaggctactgatatttattaatatgagacttcttaatgctactgggaacaatgagtagggctt

SEQ ID NO: 9554 - DNA, 1104 bp, Homo sapiens
atccacatttctttccctttcttattatataacccaccttagatatatgagttttagatccaaaggagtgactttgtaggcatataatttgtaactgattaattgaattagttcatatttgttaattataattgcatttgaaggttttgaaaatgtagtcaacagaaatatcttcctcttctgaaaatttaggtgtgttttgtagccaggtaaacttggtttgaagccttcctctatcgagagaggttggaaaaatttattcagaaccctcgtttttgtttgtttgttttgttttgttcttttttttgttttttaaatctacagctttacttactagatctagtgttttaagaattcctgtgtttgtttaccatgaagaaaaaatgaataaccaattggttgggttgttatttttaattcaatctgatttctaagcatcagatatgaagttttcactctgaccatacttggtctagctgataagtccactggtgataaagaatgagcttagaacctttgctgtgaatcactaaagcagtagctgagtaaagaaaaattctcaatcttttatttgccagacactgttttagaccttggggtaacgtcagtgaaatagcttaggttttgactacttcataggaaaagatgaaatctatggactcctccaaaaagtgcttttatgcatgatatggtttggctctgtgtccccacccaaatcttgtagctcccataatttcctcatgttgtgggagggacccagtgggagataattgaatcatggggtgggtctttcccatgctgttcttgtgatcgttagtaagtctcttgagatctgatcggtttaaaaaggggagttttcctgcacaagctctcttctcttgtctgtcgccatatgagacatgccttttaccttctgccgtgattgtgaggcctccccaaccacgtggaactgtttaagtctaataaacctctttcttttgtaaattgcccagtctcgggtatgtctttatcagcagcatgaaaatagattaaaagagtaaactggtaccagtagagtggggcgctactgaaaatacctgaaaatgtggaagagactttggaact

SEQ ID NO: 9555 - DNA, 1037 bp, Homo sapiens
ttagtgaaatgaagcaacagaaatgtaatgtcctgagattattgtgccatgaagtattacaatgaaggagatacacacacacgcacacacacacactttttttgcatattaggaaaaagtagggaagagtatggaagaaaaggaaaacactgtaaatcaacaaataaagtatttctgtttaagaatcagagagtatatatttttcaagaaatgctgaaagaaaccatatgcttaggcattaaaacaaagcattatggacataaaatcatgacctcccacctctctcttgtggattatattcatattcatttgaaagtgttagttgaagtccttagaatctggaagaatttattattgcttgaaagttagtggcactcattggagagcaaaatcttggactctgccttgttacacacctagctatataaggtactttttaaaaacctttctcttcttacgtatacaggttgttggtgttagacttctctggaagaaagaactgtcttagaggccaaatctagtcactcagtaactgggctgatgatcaggggacccaggttttgccatggatttacactatgctctcagcaagttacttaatccctttatgttaagttttctacccataaagcaaatacctaaccctcttaattcgcatggacatataggttctagaatcttagagcttaaaggtattctgtaaaccagtgtttatcaactttggtactgttgatatttggagtggataattttttgttatggaggctgtcttgtgcattgtaggatgtttagtaacatctctggcctctaaatacaagtggcaatatcccagttatggcagccaaagatgactgcaggcatttccagatgccccatgggtggcagtatcccagttgggaaccactgctgtaagacaggattcagcaagaggtagctgatgcccagggatgttcaatgcctgctttagaatacatcactgttaagtgctgggaccaggactagaactcaactttattaatatactgccaacccattta

SEQ ID NO: 9556 - DNA, 1035 bp, Homo sapiens
cttagcaaaatccatcaaaatgagccaggctctatggaatcaggaaatttgtgggctgagactaacattacctcaatatctgttatggcttaaatgtattgttttaataatattttatgttagttctttttgcctgaagctgtagaagcattttatagccagtaactcttcagaatagtacaggaaagcaggcgtcatcctcatgctcaacaatagagctgtgtttctgtgcaccaaccgcagatgctgggtctggcccccacagaaggagtgcctcagtagggcatcccaaatggggctgtgcatagcgtcactccagaggctggggacagtgcagatccagacctttcccagcctgttgagttagaactgggggactgtgctccagggcgtgaggaggtgggttgggaaatggtattttaaacaagcgaagtgattgtcatataacttgtctggcatcagatccgcagactctggcagagtttccggaaggtctctcaaaactgaaataagaaactgcagttgttgtccacagctgctaaaattgttccaaattaggaaagggaaggggaaacagaacacagtagttccagagaagaatctgaggagccgtgtgagctaggaaggccattgtgagcagaagcgagtcagtatttcctcatttcctctcctgccttatcattcccatctgccagctccctcctttttttttttgagcatgtaaaacatgttttgttgttctttaaaagggttcagggtttggttttaaatcaggctgcacacctttcaaatcattctgacatctctctatgtcaaactggcttcagctagcaatacttcattaaatccaaaagaaaaagattcctttaattttaaggaaaaaaatccagttttgagaacaattaacattagtctttaatttaaaagaaaatgagggctaatgtttcatgttgctttatacatccttctcctcaatacagaaccaggaatgtaattttcctaacttgggcaggcactgatactgatggacactgc

SEQ ID NO: 9557 - DNA, 1036 bp, Homo sapiens
ggaactgtcttgcatcattacggattcgcagacaagtgaccccaggatcgagtggaagaaaattcaagatgaacaaaccacatatgtgttttttgacaacaaaattcagggtatgatcctgtagtcctcttgcctgctgacctttcctctgtccatagacctgggtatacactcttggccagaaacttacctcagactggtaacctgcatctgtagctaggaccgtttttttttttttaaagatttataattatggaaaatttcaaatatatgcaaaagtaatgcaaatggtatatcaagcctccctgtccctgtcccccagcatcaacaagtgcagttcattagctaggatcttaatctgctcacagccccatttctttggggaatcaaagtgaacattttcctaggccatcttctcatgatcctgatgtgagtgatgtaggtgagtgaatgagaaggaccatatgtttcagcaagggcacagcacaaatggactgagccacccactgtgtttctggcttggtgctggggttgccgatggggagaaaacacggtgtaccctgaagtgacatcctcccgggtgggaggatggtggtcagggaaggctccccaaagtggcctctctgggtgcggtgtgaagggtggctggttagcaggcaagatggtatggagggaggtggtgatcaggagagaatgctgtgtatgaagacgcagaagcaacagacggactggctgatgggaaagactggaagttccccactgttgccggtacatggacagggagagagggaggagaggggggagaggggctggagaggttgcctggccaggcagactgcactgaatgccaggcgagcatgggcggtatctgagggcccgctgtgaggctctcaggggaggtgccgtggctgcatctatgtttcagaagactgaagtggctgctgtagagaagagattggaggcggcacaactcagagcagaggcccaagtcagaggccttctgcagagtccgggagagggctggtggggggcccca

SEQ ID NO: 9558 - DNA, 1962 bp, Homo sapiens
aatacactaggataaaggagatttttttaaaacttccaagttacttggctcttgttgataaattccctgcatagttttccatgtgtcgcttgcttgaaggaacggctgccagagccccatatgaaagtgacccagtgcctttgcccagtgtatagacatgagaaaagggttccagggggtttcctctcagagggcttatagatcggaggtcaggcagccggcagagacaaagctctagttcttacctaggattctttacttgtttgttttttgagacagattctttaaggcttgaagctacctttcttccccgcagcaatctgcaacaaagggaggccctggaaattagggattcttttcttcttgggatcctggctcctaatcttgtcctcataaccatttcctccataagtaatctcaggcattcagccagaggatttttaagcctacagtgccaagcccactttaatacacttttcagtgcgactgcatttcaactgtagaagtctcagtacttttcacgtgtgaagttaggagttatggtgtcctatatgttctaggctagaaggattgtaagtgttctctcttctagctggggtaggcctgagggggcagggggcaagtgggtttggggtgaaggaaggaggcacagcagggccagggcctttttaaataacagatagtgtgtatcatggcttccaccaaacctccttttcttcagatgacctgaacattggcggaattattgggggggttctggttgtccttgctgtactggccctgatcacgttgggcatctgctgtgcatacagacgtggctacttcatcaacaataaacaggatggagaaaggtgagcctgccttatgtgaaaaaagggaagttcaagctggcaataatataacaaccctgttgctaaactgctctcttctcctcatagttacaagaacccagggaaaccagatggagttaactacatccgcactgacgaggaggtaatcatttagtaaacctggaaacctaggtgtacccagcagggaaaacaacattcccccttggaaaccacacgggtctcctgggaagatttctgagtgattgtgcagctcctgagctcctcagccccttcacagtaacacacacacacacacacacacacacacacacacacacactaatgggatttgtgctttgcaagcgctagtgatggtactttttaagaatgattattccatctgtatttagcccatgttagacttactccgtgtttttccctgcttgccaccaggccccttgatggctctaactgtgtgttggctttgcagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgct

SEQ ID NO: 9559 - DNA, 1028 bp, Homo sapiens
ggagttagctgatgaaataaaacctgtacacaaatacatggtcagtagtggtaagggccgtgaaaggcccaagaataacatgtgattggggtacaaggcagagaaatcactttcccttacagcaggattcttgacccgggggcatgggctccctagagggatttgggggaagggtctttgaactccctagaattgtggttgaaaaggtctctgtataggtacatatgtgcatctttccctggaagagggtctgtaacttcttaaaaggatacaaagccctcaagggttaagaacctttgtacaggcttctctcaagtgggccaatttggtacctatatctaggtagcatctggagactgggagtgtttattcatgacagttccgtctcctacagctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaagtaagtgtctcagtgccaaggttgtgaaatgattatttaaggaggttaagatgggacttgatgcagatgcaaactgatgaccctctgtgactcgactgctttgtggtggcatgcggtgggggaagaccgtgggagcaatccagtgagtgtctatggcaggccagctgcagctggaccgaccacgacgtaaacacttcatttacctaaactaaaccatattcaactaaggtggtgtctttaagttaaacatcctatgatgcctctcagtcaagctaaactaacttgaggttatttgttttggaattccagcttcagctgtttcccgctactgctaagaacaatctcagaataccattccattatcatgtgctccctccatctgtgtcttcagaaatcaaagcgacgaaaccaaatattggccatgatttgctgcttcctccctgaactaaaatgaattatagcaaagaat

SEQ ID NO: 9560 - DNA, 1094 bp, Homo sapiens
tgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttccaggagagaagccaggaaattcctctgtcagtcccaccactgtcctagccagagcttgtgctttatttctgtccatcttttcttgggatatctttaacgatattaaagtgtcgggtgagtgaagtggacttagcacttaaaagcaa

SEQ ID NO: 9561 - DNA, 1032 bp, Homo sapiens
tgattagtatgtcttcttggtgggccatacagtcagttctacgatgtattgtcaaaaatctctgcactgcacaaaattgtgtaataaaaaccacagggcttataggaaacatgatgttaaggggcataacactcaaacatgttgccagtggcacaaaaaaacacagttgcctagtgaactatgcctggtatacctaataaaatttttactcatagccctatgggggagggtcccctgggggcccttcttgctaaggtctaaaggtagtacccttactagatttactgtaactccactatcttcacagaaactcctcatttattcttattttgactaactcatagcaaaaatttataaggaagatgtagacatttttgtttttgttctcttttttaatttatacttttaatgagtgttacaatagggcagtgagtggaagaatttatatataaatcccaagaaacccagcatcataggataattggcagcttgaaccacaattggataatagagcaaggaactattaaagatggtcatggttagtgtaacagaggtttaatttccactggtaacttcaacttatttcaaaatagagctatgcatggttttggcttggatttggggcagacctaacaatttggaggaagaaataagaagatactcatcatacttccctctcacctcttctagctatgttccgtggaacctgcatgagccagaaagaggcaaatttgacttctctgggaacctggacctggagtatgtggtgttgctgcttctgtgccctggtcaggggcagggcacagaggtggctactgggggtggattagcaaccaaagagaaccagggagggacgtgggtctggagtcctgttctaggactgtgagaggccctgcacccaggacccagacgctccccaaccgtgacctgtcacccagagggactgggcctgcagcctccgggccccacctctccactgcagcccagaggggcagaagaccctgggagccgcccgactctgcatggggtctg

SEQ ID NO: 9562 - DNA, 1045 bp, Homo sapiens
cataccgttttccacagaagttgcaccaaattacattcccaccagcaatacacaagctttgcaatttccccacatccttgccaacacttgttatttcctgtttatctggggagagccatcagtgggtgtgaagtggtatctcatggtggttttgatttgcatttccctggtgatgttgagcatctttcatgtgctgattggtcttttgcatatcttggaagaaatgtttattcaagtcttctgctcatttttgaatctagttgtttgtttttatgttgttgattataggaattctttttactttctggagatcaattccttaacaggacctgccaggactgggtccttcgcttcaaggcagcaggttcccttttggctcagggtatgtctagaagtgtctggaagctagggcctggaacgagggcctcttgactctgccggcgccctttcctactgtggttgagctggatccaagatgcaagacaaagtcctctttactctttgctctcctctccttaagcagaaggaaggagccactttcgttgctgtgagctgcgctacctgggcttgggggagggatgtgcaagaactcccttagccatgccagctggtggctccttaggccatgcgctgtgctagtacactggctgtaagctcatcctagctccaggagttgcataggaattgcggtctttgtgtcctagactgcctttcatgtttacctaggactccagagcacttcagcccatggtggtgaggcttcccaagaaactcaagttccaatcactagggtgggcagttcctctctggctagggctggtccaaatgctccgtctacgtggatgctggctgagctcagcatggctttatcctgtgctgtgacaaggcagcactgagttcaatgtaaagttccccagtcactgtgctctcccttccccaaatgcacagatcctctctcctcaccacttggctgccgctgggagatgggagagggtggcatcggtggtgtaaggctgtctctcttgcctgccttaatgcgtctttt

SEQ ID NO: 9563 - DNA, 1078 bp, Homo sapiens
tcagggagacccaggtgtgcagtcccgctctgccgctacctgaggccaattattgtgacctagaggcaagttatttcacttccccggagccccagctgtcgcttgcgttccttcactggcaatcagaggctttcgtcctgcagcagagcatcagggtggcctggcttgccaggctggctcagcctctctggtgtgtgcctaggctgtgcctgtgaactgactgttaggcagatagcaggcaggtgaggggccccaggataaggctgtgccactggggtgggcgtgggcatgcccgggtgtcagccaaacagagcgcacctttcttgagcatatgtttcactgatagaaagccactgaaaatagcattttaaattttaaacggaacatgttatggggtagaatacagaattagcccttatcaagaaatcagagaggaatctttgtttacatcattaccttggaccggatgcttggggtgccaaggaaggatcaggctctggttcgtacaaaagaacaaggaacagagtgcatgctcggcttgtagaagtcacagttgattgagatcaggtgcacagcgagtgactgcctctcagctctgtgctgctgtggcggagtctccaagacaacaagataagtctcctggcgtcctggctgacttatttatttatttatttttgtgagacacagtctcactctgtcacccaggctagggtgcaatggcacaatctcagttcactgcaacttctgcctcttgggttcaagtgatcctcccacctcagcctcccaagtagttgggattacaggcatgcaccaccaaccctggctaatttttttgtgtattttagtagagagggggtttcaccatgctggccaggctggtctcgaactcctggcctcaagtgatccacctgccttagcctcccaaagtgttggggttacaggtgtgagccaccgcgcctgactgtggctgacttctaactggaggtgggaaacggtgtcagggccgcttactttattgtgctggtggattgagaagggtctggggtcacctagaaggtccctggctttgagacagtgc

SEQ ID NO: 9564 - DNA, 1067 bp, Homo sapiens
gcctggcctttgatagatatttcaagttcatcttttttttttgcttccttaatttttttttttgctataccccatgcctccaagataacagttttttctttttaatttaaatataatacagttttactgtgtatccaagaatatctgaaatctttcgtgggtctctttcttttgtcttttgtatctgttgctttttgctgggctgagcctgcttaaaacaagccccgttagctgtaaaggtttaccttagaaagtcaggtgtcttcctctgtaactctctcccttttccatctgctccaaggcatttatttatattaatcttgacgcaaagggaagttgtgtccacttcaccttggccagtaaggaagcagtgtttggcagatgttgttactcctaataatgccagccagtgagtgaagctgacctgaatgcctcccagggctgaggcaatggcatgatcaccgaagctcaaaccagagacagtttcacctttctgactgaatagtgttcggtgtaggccaaatgcctgcagactactgtttgaggactggtgtggtctaccaggtgtttccttagcgcctggatgtctctggctgccatcccagggatagagcatggtgttagatacgctagatgcctgccgaagtaattatgggtgaaacatatgatgtccaagatttgcttttaaaggctccaatacctcctcccagattccggagggctgtgaaacaattagctatgaaaactggtaattcctgaagctgggtacatgggggttcatgatccctctctcaccttttttgggggagaatgtttgagactttaataagaacttgttgccttttccttttacagggtgttgcaggcatcttcctcaggcctgttttctctgttttccaggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtttg

SEQ ID NO: 9565 - DNA, 1050 bp, Homo sapiens
ctaatgaatggttattttaaaaaataaacgtatttcgggataattttaggtttacagaaaagttgcaaagtgagcgcagagggtcccttctgccactccgcagcctcccctctgtaacttcaaagcccacagggcatggctgttgtagctgagaaaccgtcgctgggtgtccctgtgaactccggactttgaatttcactatcaatgtcctgtttctgctctaggaccttgtccccgctgccacctgtgggagacagcctcccgtgcaccatttgcccagcaccctcaggcctgtgacggtctctcagtctttccttgtcttccatgccctgcagttctgagagggcctggccaggcagtttgtccaggtgccccgatccaggcttgtcttgtgctttctcgtgggggtggacgacaggtttcagggaggggtgctgccgcctgtctcaccccactgtggcgtccctgacatccaagtgacattacagacagctctgaccttcctcaccagagtcaggtgtctgtaggtgtctccttggtgacaggactgcttctccctttgcacatttagtcaggcagcaagtccacggccgtgggggggcttctcctagacgggaggatctggaatagcttggacttgtatttatttatttgatcatttgtttgtatccggatgggctcattttatatgtgttttaaactctgagctagaaggcaacactactttcttgtgaagcacaccatctgtccttggccctagggagctcctgccgtcggctcctgggtcccctgatgcacccctttcaacagacttttcattttggggtacgtcctgacttcctggcactgcagggtgctccagcctcctcttgcattccctgccctggcccgggaatcagccccttctccaaggagccccgggtccttttattggcaagtcttaagagagtgaggcctgggtgccaggcagggagccccaggtccttttattgggaagtcttagagagtgaggcctgggtgccaggtgggtgccaggtgggtccggtgctg

SEQ ID NO: 9566 - DNA, 1050 bp, Homo sapiens
cacctgacgatggtggcctgacccctgcggtggaggagaggcaggaatggagctacaagagtgggtccaggaggtgtcctcacctgcggggaggccgagagctcctcgtaggcatagggcacacctgaccagcagaacccacagctgtgccgcagaaggagatagaagccccgtggtggtttgatagagctggggctggctggggtggcgggtttgttgtatgcattttttactgcacgtaaaaggctttactggggaagaatagatttcctctctttttcctggaagagccgaatgacttagacaatggaatagaaatgtaggtcgagcgtgttcatggaagtgttaagatcttcctggttacaagggcacacacctgagggggagtcactttgtttgaagcacctgagcgaggctgttcgctttgtccattctggcttttgttgcttgttaaatgaggctccttctgttgcagaggtgaccacagtgacagtggccaacgtgggggctgctgcagacaatgtcttcaccacgtctgtggcgaacgcggcatccatctcaggacatgttctggtaagctgctccgaggggcacagcccagggcgggtggtgccacgctgggggcctccggcttccccgaggctctcccggggttcagcccgctgtgtgaacgtctgctctgtgagctggggagggacgcactggctcgctctgctctcagaggccttcgggctgtgctggaggtgggagaaattacagctgaggtagaagctgcctcggaaggccaggtgaagagccacacctgtcagatgggcttgtggcctgcgttgggcagggactcccagcaggctgctgtccggccacagttcagcctctgcccgaggcccggccctgcctgtgctccttatcctatagctgcagggccagctgaaagaagcaaggcgtttccctcccccatatcctgttctcgtagcatttatggtgcagtctcccacgcctgactgctgtctacttagaaaactgctgaaagccagttgcatttcaaatagt

SEQ ID NO: 9567 - DNA, 1035 bp, Homo sapiens
ggacttagcttgttgaccggctcggaggcagaggcctggcctcctgtgggaagccttgaagggtgggagggactcctcagcagtgggggttggtgtggggagggctctgcccactcagctctccaccccaggaggagccctgcactggtcttgatcaagggcactggcagcccagctgcctccctggcctgctgctctgcccgagttgtcccctcttgcaccctggatgggcgggcatgcccaacccagactggagttgaggggcagtggccagatggctggtgtaaggtagggtagcttgttttaggttcagggtgagaagctgcagctccatcctacagcccagtgctgtaggatccgtaaaggtggccgggtgcagtggctcaggcctgtaatccctgcactttaggaggccgcagaaggaggatcgcatgagcctaggagttcgagaccagcctaggcagtgtggtgagaccccccatctctacaaaaaatagaaaattagccatgcatggtggtgcgcgcctgtagtctcaactacaggcgggaggatcacttgagcctgggaggtggaggctacagtgagccaagattgcatcactgcactccagcctgggcaacagagtgaggccgtgtattgaaaaacagggagaggccgggcatggtggctcacacctgtaatcccaacactttgggaggccggggtgggtggatcacaaggtcaggagttcaagaccagcttggctgaaatggtgaaaccctgtctctactaaaatacaaaaaattagccgggcatgatggcaggcgcctgtaatcccagctacttgtgggggctgaggtaaagagaatcgcttgaaactgggaggcggaggttgcagggagccgagatcgcaccactgcccggggcgcactccagcctgggcgacagagtgagattccgtctcaaacaacaaaaaaaatgggggtggcgacttcaaggccagtggctggtgcatgtcgtgctgcccccacaaggtggcaccatgaccccatgca

SEQ ID NO: 9568 - DNA, 1020 bp, Homo sapiens
gcctgtaatcccagcactttgggaggctgaggcaggtggatcacctgaggtcaggagttcgagaccagcctggccaagatggtgaaaccccgtctctactaaaaatacagaaattagccgggcgcggtggtgggcgcctgtaatcccatttacttgggaggctgaggcaggagaatcgcttgaacccaggaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtgagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaata

SEQ ID NO: 9569 - DNA, 1092 bp, Homo sapiens
ccacagccgttcccaagcaccagcgtggctcctggtgccagtgacctgccaggaggccccttgtgattataaaaccgttcagttgggccgggcgcagtggctcacacctgtaaccccagcactttgggaggccgaggcgggcggatcacgaggtcaggagatcgagaccatcctggctaacatggtgaaaccccatctctactaaaaaacaaaaatacaaaaagttagcctggcatggtggtgggtgtgtgtagtcccagctacttgggaggctgaggcaggagaatggcgtgaacctgggaggcagagcttgcagtgagctgagatcgtgccactgcactccagcctgggcaatagagtgagactccatctcaaaaaaaaaacgttcagttggctgggcgcggtggctcacgcctgtaatcccagcactttgggaggccaaggtgggtggatcatctgaagtcaggagtttgggaaaagcctggccaacatggtgaaactaaaatacaaaaatgagccgggtgtggtgtcaggcgcctgtattcccagctacttgggaggctgagacgtgagaattgcttgaacctgggaggcggaagttgcagtgagccaagattgcgccattgcactccaacctgggcaatgagtgaaactccgtctcaaaaataaaaaataataaaataaagccgttcaataaggagaatttggaaaaaagtggaagaaggaagcgctgcagccacatccccgccctgaaggctgcgtccctccagtgcctcgcagattagtcaggatgcccacttagcactggccacggggccttgctctgtcccgggtccactctcatccccgtgtggtgatggacctctgtggacaaatgctttttattttatttattttttgagatggagtttgtctctcgtcacccaggctggagtgcagtggcacaatcttggctcactgcaacctctgtctcccgggttcaagcgattctcctgcctcagcctccggagtagctgggattacaggtgtgcgccaccacgcctggctaatttttgtatttttcgtagagaccgagtttcaccatgttggcca

SEQ ID NO: 9570 - DNA, 1837 bp, Homo sapiens
tcctcagtgggtactcagtggtgccctccgaggggtgacaccaacccagtctcaggttacaagtgggcgtgaccccttgagtgagtggttagattcactcctgcccagagggtgccccgccccagcactctgcccaaggggctcaccccaccaagcccttctcattctagtcacctgtgtgctccggtgctgggggagctggcccgtcctcctgtagtggccgtgtcgctctcagggacaccccatgggaagatggctagactttgtcatctctccgccctccagccttagcagctgtccctgttatgagcagtgacacccccggtcccacttggttgggtgaggctccctgccctgacttgaccttcctgacccctggggtgggccgcagggcctgggcctgtctcaggagcccccaccccgctcccgcagccctctgtgtgtgagctcgtcagggcccccggcttcgcccgcctgccgctcgtggtggaggacttcgtgaaggattcgggcgcctgcttcagtggtgagcctcgagggtgccccctgcacttacagaagatggggtggggggcttccctgctgcagcctgggggagaagcctcctgggccctgggttctatagacccccatggcactgactcagacccagacaggctgacctactgctgaccctgggagcccgcctggagttcgaggctctcagtgggtgaggtggacattgcctgaggttggtgccctcggtcctccccagcaagcgagcctgacgctgtccacgtcgtgctggaccgccacctggtcacaggccagaatgccagctccactgtcccggccgtgcagaacctgctcttcctctgtggcagccggtgagggcaccagggtgggcacattcctgccacatcagagctgcacccggtgcttttgcccaagctttgaccacacgtctgtcctgcaggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggggccttgaggggagggcccagccggcgggagctggctcagaactttggccaaaggtgaacggaattttttaggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttc

SEQ ID NO: 9571 - DNA, 1033 bp, Homo sapiens
gcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccggtgaggctcccactgcccgctggctgccagccccagggctgagccctggctgcctggagggcccacctgattctgacagaagtttcttccaggggaggtgggggaagggcaaacaccaggctggaaaggaaaggtctggccgcacctggccccaggagccgggaactcccccacactccgaggcagagtgtggtggggggtcctgggcaggtggacaggacccctctgtcgcccatcctctgcctgcagggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcacctcagagcttgatttatttgttggatggagaagccgttggagggcggagggtggtggggtagaggcctggcccctgcggggagggaggcctgtgtgcacaggtgccccacatcctggtcctgtcctctcccactgtgcctggggcctcctgtgggtcctcatcttcctgggagggaggagctgtgctacaaagtaacccacatgggctactttttttttttttttaaatggagtttctgtcacccaggc

SEQ ID NO: 9572 - DNA, 1031 bp, Homo sapiens
gcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaaggtgagttccacctgttctgggccctgtctccatctctcgctctgccctgcctctgctgcatgttctcaaaggcaaaccccagtcccagccccagctccaggccgcccctcccggctccccaggtgtgaactgttctgctcttggtcctgtccagccccatcgccatcctcggtgatcaccacccccagtgtggggctggctgggccctggctcctggaccctgacgctgcccagtgggggtctctccagaccacagtgcagatgttgttcctggggaaggttgtgggtgatggttgtcagctgagatgagccggtggtctccacccctgcctccttccatttgcgggcacctctccagtgtttctgtctgtctgtccctgtctggctggggtgggggtggggtgggaggtctgtgcctctcgagcagctgtttctctggctggcagggtcgatctgggacctcggaccctggctctgagggccacatccgcctccccccttcccaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcag

SEQ ID NO: 9573 - DNA, 1035 bp, Homo sapiens
tgccaggaccgtcaccagggtgacaatgaagtgcggcagaggcagagagagcttctggatcccctggacacctgcctgaccccatgtgcccctgcagagacctagaccccatctccagggcccagtggcacattggttagctctgggaccatgggggtgggggttggggctagccacgcgtgtgcatgtgtgtgtgtccgccccgcctgtgcatgtctgtgtctctgaatggcctgcccaggcccctcacctgctggtagtaggcgtaggcgaggataccagcgatgatctccagcagaaagatgatgaggagcaggatgaagtactggggggggcagcacaagggcacccttgttctgaggcctagtgcctagacctagtgcacctcagagcagagtccccaccccggctccccaggctccaggtgggggctgaggggcggccaccctccctgaagctttcttgcggagctggtgtcttccctcagctggtccagcaggaacgtggggacccacaggactaggcaggtgtggaaggaccgtgaccccccccccaggtgagcacagcaaggcacaggttcaaagcctgcagcgacaacctccttgggcccatctgcaccacccccaccccgtggccctgcgccctcctgaccaggcgcagcaggttccgacgctccttgaaggtggcgcagcagcccaagaccccagtcaccatgacgacagtgcccgccaccaccaggatgtaggctgtggccaggtaggtgcctgaggccagcaggctgatgtagtcactcttgagggccagcgtccagatgcccactgccatgacagccaggccagccagctacaagcagtacacaaaggtcatcgcatctgcccaggtctgatggtggcccgggaggggtgggggtgggggtgggggcaaggcgacccctcctcacccagaagcagcaattgtaggtaaacagcaggtacttgaggcaaacggtgccacatgttgtcttcttctcgttgaactcacccatcctggggctga

SEQ ID NO: 9574 - DNA, 1073 bp, Homo sapiens
tctctctgatggaaggaagcagaggtgaggaaagaccccacagcggcagagcagggcttgctctggctggggtgggggtgaaccagctaagggcaggcccctggagagctaccctgccgtggccagtgctggatgaggtggctgcacatcagcaccttggtggtcttggttttctaagctccccgcaattacttcgttttcatttcatttacatttcttacatacgttatacacacacacgtacagccagagtaggtgggagaggaggctcctcacgctccacccagggttctgggcatttccaggttactccagccaggatcatactgctagatctcagcttctgagccgggtgaatctgttcgccttgccggtggcggggggggtgaggccagcaggcagtgagaggcaggttggatgtgggctccaggcctttgcagaccgtagagaactcagttggcctctgctcctcccctcgacacagggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtgtgtgtatccgataccccactctggaaggaaccatccagtaaaggtctttcagaaccactaaggtcccagccctcactaggatgtcaggagccaggtctaggcccagctttcacactgtggcagcccagtgaagcagactgggccatgaactctcctagccctggggccagcctgttccacaggcacccctgcaggaggcgctgccaggagagccttccatctcggggctctttgaggttccctccttctgggtgttcttcaggctgagcagagaggctcctgtaccctctctctcggaatctgaagagccagatttaggccgggcaaaggggctcacccctataatcccaggactttgggaggccaagg

SEQ ID NO: 9575 - DNA, 1063 bp, Homo sapiens
tgattcacaaaacaaagtagtgttgtgttctagctcggagtgcagcctcaatagccaggacttcatcccaatataaacaaatggctgaatatataaatgagtgaccaagaagaggccgctctctggtgccgaacttccagtaattcccgtagctactcctccgtcagggtggtaaggggtggtccccaccccttcagtgtggtctgcgtgcagcagcttcgttcgagagcgcggtgcggggcggggaagacgagagcgtctttgcgtggggaggcctggcagtcacagcctcagccaggagatcgggagcacctcccgcgatgagccgtgctgacaggacgggccgtgggcacggggcgacgagggggacatttccctctgtgctcttcctacccacacccacagcccagcctcgtcgtgaggagagcaatggatggatccagacgtctgagtcaagtttggaccttgctgcatcaatgtggatttgttcattgttaacaaacagaccatcctagtgtaagggttagcaataggaagagtgagtggggggccatggggattctgtgtttgcagttctttgtaaatctaacacttttctaaaactaaaagcttattaaaggtaaaataacctctgacacagacacatggcccgtgccccctgccccgtcccgccttggttgcgaccgttcccccctgcgtggtgcctctgccccgctcctgtgctctctgttcctggccagctcctggccctggctgtgcccagaaggtgcttttgctcttccttttctggggtggcggggccaggccacactggcacccgtcactggcctgcgggcctctgtggcagctcctcgtggagtctgcagagcctgctccaggtctgctcctcttcccagtgcagtgtctgtcgctcagtgtctgtgggttccagctgcccctcaccctaccccactcctgccccactacctaagttttgatcaataggaatacctgctccctgcacgtgtcccccagtgaacaaacacagatgaatgtggacgttcctctggcgccagcccagccc

SEQ ID NO: 9576 - DNA, 1043 bp, Homo sapiens
ggactgccaggcaggccgcatggtcagccaccagggtcaggtgtcaggcgctgctccagacgcgtgcgtctctgatcttgggcatggctcagcagcctccggcttggccgtgggtggttcctgctcacctgtttctgagtgaccaaccctgaaacttctgggcctaacatgaggcctcatcacctttcccgcatctgtgggctggtgggtggggctctggccccacaggttattcctgcactgccacccgtggtggctgggctggcagccctcaggggccttgctgtcatgggtgtctgctggggtgccacagtttcccccacatggatctctccaggcagagttttatatcctcaccctagagcagagtttttggacttcttgctctcaggaccccttaaagtccttgttgaggctgggcatggtggcttctgcctgtaatcccagcactttgggaggccaaggtgggaggatcacttgagactgggagttcaggaccagcctgagcaacatagggaaaccccatctgtacaaaaaagtaaaaagaattagccagatgtgatggtgtatgcctctagttccagttgtttgggaggctgaggcgggaggattgcttgaacccaagaggctgaggctgcggtgagctctgcaccgctgcactccagtctcagtgatagtgagaccctgcctctaaaattaaaaaaaaagtccttattgagtttacatgatggagctatgaatattcatctttcagaaattaaaattgagaatgtaaaacaactttaattcatttagaaataattaaaaacccagtatatcttaacataagtaatatttttaaaattaaaaaaaaaacctattatcttctagagtcaaataaatagagtggctttactttttgcaaatctcgagagctggatctgtcaggttctgtgtttatcctgctgtaattttacaggccaggtggcttccacaaggctttggcacatggcacctttgtggtactgtaaagacagtgctaacctcatggtcccagaccacac

SEQ ID NO: 9577 - DNA, 1050 bp, Homo sapiens
tgggccctatcagcccatgaaggagcctcctagaccccaggctccgctaggggagaggcactgtgtgggtgcaacacgcccctgcaggagctgggcactcacccccagcaggcacgtggcgcacactaaacctcagcctgcaggtcaggagggcagcagtggcaaaggagccgtgcctctgtgcctgagcccctcccgcacccgcctgctatccggctgcccccgggagcccactctccagtggaggcagccccaaggccaccatccaccaggggctggattatcggcttacggagctgccctggagtcaagtctccagggattggactccctggggctgtgctagggagagaggggcaggtgtgaggacagcaagcccggaggagggcagagagcttgaccatgtgggagggtgaggtgcagtccagaccccgacttgctgggggtcctgtggtggaaaagatgcagaagtcacagcagggagatgcctgtgtcccagggatgagatggaatgttctggaatgcctaagggtccgtgaaccccagggcccacaggaaggacccctggcctcttccagccctcagacccttctctgtggggcccatttgcccccctctgccttgttgcatcctgctgagagctggccttgtgacctggacggggtctctccagagggagaagggttcccacgggcacatgttggtgtgtcctggtgggcgcagctcccagctctgatctgtcctggggagcttctgggtgccacccaggggcccgcagcactgctgaccatccccctgtccctgcaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagc

SEQ ID NO: 9578 - DNA, 1043 bp, Homo sapiens
gcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtgctggtgtgctcttgtgcctggtcaggggtggctccaacttgggatggggaaggagggtgggtagtgcgaagccagcacggcagctgactcggcagcaccgggacaagcatttggggtgccccgggcctatggccccctgccctgccctgcccagcccatgggctccagcctggtcggccagcggggactgacttgttcccaggtctggagcagtagccggcaggatgtggccttggctggggtttcagggtgtctagtgtgagtgccagccttgaggagtgatttcagggaggtggccc

SEQ ID NO: 9579 - DNA, 1859 bp, Homo sapiens
gtgcagaggccctgcggccagaaccagccatcccaacttcccagattgtgccatcactccctcctggaagccttctttggttttttcttccagacagacagacagggtcctccccagtggagctcctggcactcacttccttgtctgccgctagccttgaccctgatgtctggctgaaccttggctcctgagcagaccaggagaacctgagggttgaggaaaacctcttctgggccaggctgggcccacgcagagcagccctaccccgggaagaagggagtctgtccctcctcctgccttctgggcctttccatccctgcagtttcagaaaggcccctccttcaggaagctctccctgattgccacattcaccctcttactcctgacctggcactcttgtgcttggggggtggcgtggcagctgactcctcccttttcctcctagggacccagatgcgcagcctgggggtgagctgatgctgggtggcacagactccaagtattacaagggttctctgtcctacctgaatgtcacccgcaaggcctactggcaggtccacctggaccagtgagtagtggctgcagtcggctcccctgggttctgtgggcgggggcggtgtgcggagaccctggaggaccccggttctgcaggtgggggttgcatgtggggagtagtgggagctgggcaagaaagagatggggtcagaccagccctccatgcccctccttgcccctccatgctccccatcacctccatcccctctattccctctatccctccatccctccatttcctccatgcctctgtgactctccatgacccaccatcccttctgtccatccctccatgccctccatcccctccatcccctcatccctctgtgactcttcatgaccctccatctcctccatccctccatcccctccatccctccatccctccatcccctccatccctccatccctccatccccacatccctctgtgactctccatgaccctccatcccctccatctgtctatccctccatccctccatccctccatgcccctccatcccttcatcccctccatcccctccatccctctatgcccctccatcccctccatccctccatgcccctcaccaccacctgagggtctcccaccccctctaccactctgtgtctcctctcccaccctcttccctggagggcttacagccggctgtgcttccaggagccctgaggggaggagagtgcagcccagccaggggaggggctcccagggaggggcactgggcccccagggcacactccagtcccggcaggggcttcacgccctgactccccgcagggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgaggtgagcgccgggggctggggctggggctggggctggcagggggagccccaaggccaccactaccaccctgacactgctgtgacccctcttagtacatgatcccctgtgagaaggtgtccaccctgcccgcgatcacactgaagctgggaggcaaaggctacaagctgtccccagaggactacacgctcaaggtgagcgggcaatggggtgccgcacgccccaggtgagcgggcggtgagggggcgcacgctccaggtgagcgggcaacaggtgggggggcgggtggtgctaggcctgggtactgaccaccagggccgtcccaggtgtcgcaggccgggaagaccctctgcctgagcggcttcatgggcatggacatccc

SEQ ID NO: 9580 - DNA, 1051 bp, Homo sapiens
cacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgagg

SEQ ID NO: 9581 - DNA, 1050 bp, Homo sapiens
acaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgacttt

SEQ ID NO: 9582 - DNA, 1078 bp, Homo sapiens
caaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatg

SEQ ID NO: 9583 - DNA, 1077 bp, Homo sapiens
catgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcc

SEQ ID NO: 9584 - DNA, 1937 bp, Homo sapiens
aataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggattta

SEQ ID NO: 9585 - DNA, 1050 bp, Homo sapiens
aggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgaca

SEQ ID NO: 9586 - DNA, 1023 bp, Homo sapiens
gtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagt

SEQ ID NO: 9587 - DNA, 1028 bp, Homo sapiens
agatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaa

SEQ ID NO: 9588 - DNA, 1028 bp, Homo sapiens
ggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcgggga

SEQ ID NO: 9589 - DNA, 1046 bp, Homo sapiens
ctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctct

SEQ ID NO: 9590 - DNA, 1041 bp, Homo sapiens
ggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaact

SEQ ID NO: 9591 - DNA, 1069 bp, Homo sapiens
ggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatga

SEQ ID NO: 9592 - DNA, 1029 bp, Homo sapiens
agttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagc

SEQ ID NO: 9593 - DNA, 2302 bp, Homo sapiens
ttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcactttt

SEQ ID NO: 9594 - DNA, 1046 bp, Homo sapiens
gcgagggtttttggtcagcctcgttttgtcttggccaggctctttgggcagcctctggggtggctgagattgggagcttagacaccagggttcaaggttattgattttgttttttgcatattttacacatattttttcggccatcccttaaatgtgatttccaaaagaatgaactgtagcctcagcttatactgtggaagatatcatttatggtaacccagggatctttttgccccatacagtacaagttcttaggttccataggcacgctggattaagggcaatttgtaatcttagccagaaatcataggttacaggttcgtaaagttactagcgcagaagcattagcaagatcgtgatgtatttcttaggctattgttggcctccacacaaattcatggagttgctggatgtggtttaaagggtacaagatctctgtgttagataatattggagttaatccattcctctgggaggggaattttgtgtcccggatgccgttactggaaggatagcattgccccttggtgagactgttaggagagtgaaggagagtgagtgacagatggagctcttgggagtggcagctcatcatttgttggtgcagtacaggccaccagaagaggatggatctgccggggcgctccctggtagtacaaagagcaggaacccgctagaggagagatgtgctttccatgagcgccaagggcccagcctacccccagacagatgtgcccttgagaagtggggactgttggcaccaagaggggttgcctccgcggtggccttcctggatggagctgcccgtgttgagcgcactgtgctctgtgtgggcaggggttccagctgcttcccagccctttcatgggcaggcccctggagctccaccaccccaaggagccccaaaaccctcctgctgaacatgccatgaatttgaatgcttgaaggcatagctttaaaaacaaaaaaaaaccctgctttgactgcagggtggtagggggagttagctttgtttttgtcactatttttaaaagtatatttgcagt

SEQ ID NO: 9595 - DNA, 1052 bp, Homo sapiens
ttctgagcccagtgtttcttgctaaccaagtagcaaagatgtaacttgggtgtaattttcattgctgatggtactgctttccagtaagagggccctggatggtcagcagtctgcacggtggcacacacgggccaccataagcaagcagtccttgcagagagcataacacactgggctgtcccagctgtgctcagaacacacactggcagttgaaattggcccactgtcattaccaacacgtgtctgttgaatatctatactttttgaattcatgttttgtgcagaccaataggtacacagaggggtaacagcttttactgtgccagcattttttatctgaaacatgaactggcatctgttttggtgtcagcagtaaaaagtactgttgtgaggttggtgctagttgaatgaagcaagaaccagttgtagatgaaagtgagtgtcagtaagcctggaagctgtttcccactccactttcttcagtccctgtagctctgccctgtcctggaatgctgacaggaggccgtaagtagacagaggctcttgcccgtgacgagacctgttcactcgtggcactcgggatgtagtgggagaaagcagagaggtggggacaagaggtgccatgaggaaccccacaaccatagcagggcctctgcatgccaggataagtaggcactccgtttttaagggtctcgtcacagaacatcagcatgatcctggcagcccatagaccagacgtccttgaggtcttagcgccaccgcctccctgtcttcctcatgtaggctgctttcatgggaaactgatggtacatagggcggatgcagctcttggaacgattttgttttccagggccaggtttcagaatatggctgtatgtttaaaattatgtctagctgccattaattcctgttgtccccgcatgtctgaagaacttagccactcttattccacctgtaccctcacccactctcccacgccacccctcccatgccaccagctcttttgaagagaatcctcgatgcgtgccacctatccgtatttcagtatgcct

SEQ ID NO: 9596 - DNA, 1018 bp, Homo sapiens
tcagataatttaaaataaattggaaaggtttactaaagaaaactgagttgaaaatgagtgggcaaccccattaattttacctgcaaatttagatttttatttgtggtctcagagtaacttaaatcaaggtactttgaccatttggcacattttaaaatcagaagtgcttaaatgtcatcctacagcatcataagagtttcttcttgtaaaacatgaaatgtgtagttcacttgcctcttaaaattaagtatattatgggctgtcagaatactaacgttacctggtgtttttgtaatgtgtctctgtccgactagacgttttttgcttgtttttacccttgttttttggagtgtgcactaaaagctgtcagtgtgatattctggctctgtcatcagttggtttaaactggctgtttccatgaatgcatgttcacagttgtggttccttcaaggaagggatgggagaagagcttttaaaacttttttgagaatgtgtcttataaagactactctgggaataatctgctcatggaaatgttcatcttctaaagtttggcctgttgatgtgggaggactctgctgaaagcgtacctgtgcgcagcaccgtggtggtgggcggtgagggctgtaggagaccaaggcctgggtctgccttgcgtgcatcacagtgtgcggacagggaaggtgagggctgtcagtcagccagtgaacaacgttgggtgaataaatgctgcccatcactgctgtgcggggtgtctgatggacccaagggccacgtgtgtttattgggctgtgtttccgccttgtgggcgctgaatggacacttttaaggttgcagttgtaaagcaaggactggggtcaattggcagggccacctcctcagactccgcgcacagctgcctctgtccttgttgcacttgtatctccccctccctgtattctgtgcctcagcttctcttttcctcccctctgttgtttgttctgctttctctgtcaccttggagaaccttgagtctcct

SEQ ID NO: 9597 - DNA, 1046 bp, Homo sapiens
tggatcttctaccagttgaacgttgcacagcttcattgagtgtggttagaagtccctatctgtcttggtgggcttagctcgtctgagcatcagctttcgctgaggaattgcgccactctacaggggcccctggtgggcattccagcactctccaaacaaacagaaatgcagtttctgtctcgctgatttgcagtgccttagtaacactcacagcttataaggcttaaggactttctctttcctgcaccatcatgtatagttctgcgggacatgagttaagtttccccataaagcacaaatgcactgaatggccacagcctgggggctgtttgccattcctcctgttaatatattaactctctcaaaatgatcttctcaagcttgagtgccagcccatggcacatgatggaggaggagaagggaggggggcatagaggcactcaggccagcttcagaagtggtggatggagcttgcaaagatgtctgtgaggagatgcaaggctttggggatttctgttaaacctcgaggtgagaaatgttacattttatctaccagcacagcttcctcctgtgtgggctttaaaattctgggagttgtcactgtaatttaaatatgttttgtcttttctttttctagcatccggggatggagaatcactggtaagatttgttgttaatagtcttattttcctgttgaagtctctcctgagtgaatgtctacttgtctacttgttaaaaaaagtccagtcctggctgtgtgtggactgggtatgccagtgatcttaatgctttgggaggctgaggtgggaggactgcacgagtccaggagtttgagaccagcctgggcaacatagcacaaccccatctccacaaaaaattaaaaccaaataaattagccagccgaacatggtggttcacgcccgtaataccagcactgtgggaggccaaggtgggtggatcaccagaggtcaggagttcaagaccagtctggtcaacatggtgaaaccccgtttctgcttaaaataccaaaaaaaaaaaaaattagt

SEQ ID NO: 9598 - DNA, 1499 bp, Homo sapiens
agttatttccagtgtagagatgaggaaactaaagcacggagacattgagtagcttccgcgagttgcctagcagtgtaggcagagatgggatttgaatccaggctgtctgagcgtagaactggtcttgtaaactgtctataaattactcaaccaagcgcatcttccatgtttttcttctataaatagggatgaggtcaatgtctttgcacatatcgatgcatccatccaggtatttttctcaaatagaacaaattcctcaaaatagaattactgagtcagggaatatgccttttaatttaattttttttgatattgccaaattgtccttcataaaatctgtcgacagtacatgagtgtgctcagtaccccaaaatcctggccgggtctacatatttttgtacattttgccccaaagaaaggcatctcattttggtgttcatgtgttttgttactcgtgagcatgaatgccttgttgctgctgttggttgttctatgcctgcgttcatgtttgcatcctttttcccggtgtgctcacgtctcttccaggtctgtagcgtgctttgtaagtgagggatgagctttctgtccttgtagagatttgtccttttctcccacccacctcccgggagaaaagctgtgggtcactgctttcactgcacagcacagagtagagaccctggcttcccccagcagggtgggggctggggcttaggctgagcggaaaaggacaggaggaggatggactgctggtccccttactttcccctagtcaccttccctccttccaggaagcaagggctgggagcagctaagagaagctaggatttcttaggagagcttgacgcctattggtgaggaggcattggagggggaacatgccccttactcatgaactgaacagatatttcccgccagtccatcgttggtttttttaacctcacgctagtcttttttgcggtggagaagtttttcttgttcatggccctatctgttgagctttcccaaaatagcttctagtaagtgttgtgtactccaagcaatctgtcctcgttatttttctattttaactggtgcttactctgaatttctacttttagtcttttgtgttagagttccactttgaacccaacgactactttaccaactcagtcctgacaaaaacctacaagatgaaatcagaaccagataaggctgatcccttttcctttgaaggtcctgagattgtggactgtgacgggtaagaaaatgtcattctaccttgtttttctgaaacaaaatcaaaagataattttgtaacttgatgggtaagatagaagtaaggaataaagtacagtcttgagtctgcttaaaagcctaaaagcctggtagatgtatatttcaatagtctttcagtttgggaatgctcatagtgcagaacttggagatggcggctgaacctgggaaatgagtcacgtggttgcacatgcaagcctttgggatagtgccctgtttcttcattt

SEQ ID NO: 9599 - DNA, 1049 bp, Homo sapiens
ttctccttttcttttcttccttttttttcttttttctttttttttttttttttgagaccgagtctcactgtgtcaccaggctggagtgcagtgatatgatctcggctcactgcaacctctgcctcctggattcaagcgattctcctgcctcagcctcccgagtagctgggactacaggcacgcaccaccacgcccagctaatttttgtatttttagtagagacgtggtttcaccatgttggccaggatggtctcaatctcttgacctcgtgatccacccgcctcagccttccaaagtgctgggattacaggcatgagccaccacacccggcctctttttttcttattggacacctgtttgatgatttcctaggtcaattttctttctttcttagcctgtcatcttatttttctccatctcattgtgactcatagactagagctctggttatggtagactgtggaccagtaatttttttttttctttttacttccctattataaaagtcatatgtagaaaatacaggcaagtgtaaagaacactatacaaatctgtcttctaaaagtaaatctcagcagcttagtgaatttccccatactctttttcctttgtaaaattattatgaagcgtctaatgcattttaagttataaagataaatgaaacttcaaaatgagtcttgactggtgtttttgcagcatgcctcattcccttcccttgagcgcttgcctacctggatacacagtgcacacgtgtgccacacggctcctgccacaccacatggtgtgtgcacagtgtcaccctgctgccacatcacacaggcttggctgggggaatagttgttactgcagccattggctataaaacagtttaacattcccctacatgccccacctcccccattgtaaattgttgcattatgatcagcatacttgaacccaaatttgtgttaaattaaatgtttgatggtttccttagtttaggttcctttcagtgtacttaccagtcaaagaagatgaagctttagaaggcccaaaggtcgttcagttgg

SEQ ID NO: 9600 - DNA, 1042 bp, Homo sapiens
cctgcagccaggtgggcaccaatgcaggagtcaggctgcaactcctgggctgtagtggtgctgtccactgtgccaggccttggtcttgtagtttgtttgtttactctgttgggtggagatgataccattcttttcccaagtgtctctgaagtttgcatgcatctaatgtatatgtttaacgtttaaaaagatgggagctatgtacacataatgatcagcacttattcagaaatctgaacctactaggttttaccctaaaaaaaaaagcgcaaataagactgaaaaatgttttcctgctctttgatttgtcctgaaacacgtctttacaatatgcttgccatggcatatcattgcattagtaatgttagtggcatggatcagcctaccagttggtaagataagcttgactaggtcagcccttacttttatctgaggaaccatatgctcatcttcaaatggccttgccagactgtctcatcccagcctggttctcccagggagcactgttcgtaacccgttagcctggctgtagctaatgggttccattccggtgcaatagcatttccagcgacacatgactgactgactggtggctttcagtttcaggtcttggagacaaatgctgcatgacgggctgtgggttagggatcttgggtgtgggtgatggtggtaggggcctggggccagtcaccagtatcttccttcctccccatctcagcactggggcctgggctaatggatgagggccactaggagtgggatttcttcactgcaagtgctgcaagtaatgcctggggcagcagcaggggtgggcagtggatgtacctgtatctgtctcttctactttttcctgtctgttttccactatggaaggtgacattcaggtgtccctctctaggtggggccctgggagctgggagtgatgcctgctcaccagctgggggctgccctccagaggggataccccatcttccttgccccatgtgggttatagcaggtccttcttcctgggcttgcatcacttctgtttagactttatcac

SEQ ID NO: 9601 - DNA, 1956 bp, Homo sapiens
agttaataggagtaagatgtagtgccacctcagttatctgtggacaggagcatattgaaataagggatcagaccaacaaagattaaaacatcagagaaagcaaagatgaagaagagatgcccctgtgttctcagtcactggaagattgggggagttgtgaggggagtgccttcctgctcagtggcatggactagcttgccccctgagaggtgctccgccagtggattggttgcagatggtggttgtggtgtggccatcagtcacctgctcacagcctttttctagtgactggtcccattccagtgctgtgaaaactcccagtgtaccatggattaactttgtcagcctgattttatgtttgggagacaagtaacttttatcctataactaactttttgcagttttttttttggggggggggtggtatatgatgattttggtagccatatgtgtttttgatgctttaaaaatatatagaacctggcctaattgaagccatggctgtggattaatacagttgtgaatcagtttctaacagctcaagggaaatctgcctttgctgatttaaaaggcctttcatttcaagatcatttcatcataacaatcccgtttggcaaggcattcagaatttcccatagttgcatctggtgttgcgtttcacctcccttggtctaccttttccctggggcctgactccccttccttttgccatgtggcctttctggtcactttctgatgcttgcgtggtgtctgagctggcatttatagccacttccttacaagctggataagttgctgagcactttcttgctgcagatactgctgcggcaattttttttttttttatttcaacttagcaccccacaaattttaacaagaggtcagattattagtccaagtgaacttctttatccttgcactggactttttttgcccagtgctagatgttctgcatatttgcattgcatctccttaaggttgatgtacagtctttgcatctgcatttgtgatgatgattgtctcaggatggcacctcacagagctagcactggatggcctttcccagcgtcggtggcactttgtcatctctttagtttcttcgcctttgatgtgaaatggtacggaattccgtgtggatgtaatgacttgaatgctttttcctcagaagcatctgaaaagtgtcgcgtggcccagtgagtggtttggaggtgcagacttagaaagcaaggtgtttgatgggagatagtagaggattcggcaacgatattctacgtgaagccgctgcattgtttgtaaacttttattttcgttacctatgttgcatcttttttttagggagacatgaaaagtaaagtagtcgtcacagaaaaagcagcggcaacggctgaagagccagatcccaaaggaattccagagttctggtttaccatcttcagaaatgtggacatgctgagtgaattagtccaggtaagcacacttctgtcttgtagagagattatgtgctagtcttctaacattacttatctatggcattttttaagcactacactgggcattgaaagattgttcatagtgggcggaagggcactttctctgaccaggacctcagatgagcagtcctgatctcacagtgaatggtttattcacagtggggcttccatgctgtcttttgcagttcttggtggaaagctgggcgcttcagcctgatccaaaactttcaaatcagttccttttacctcttgtaaagctctgttgtcttgcctgtgggaaagcctatgaatagattccagagcccatctctgtcttcctgtggtgtgagtgtgcaggaaagggtgagggcaggagaccagagcagaatgaattttgaagggatgagctgtgtgtttgtttgtgtgtgtgtgtgtacacacacatctcagtgaatttttgaacaagttgctaatattttctgatcat

SEQ ID NO: 9602 - DNA, 1026 bp, Homo sapiens
taggataaatttttttttttccttttggtaagatagggtcttgctctgtttcccaggctggagtgcagtagcgcaatcatagctccctgctgccttgacctcacagactcaagtgatcctcccacctcagcctcctgagtagctgggactacaggcgcacaccatcatgccttgctaattttttaaaatttttttgtagagagaggtcttgctgtattgctcaggctggtcttggagtcctgccctcaagcaatcctaccttggcctcccagagtggtgggattacaggcatgagccactgcgcccagccttaaggataaattcttagaaatagaattactgggtccaaagaacattttcaatatttctgcccttcagaaagatgagtcagttagagggcttcttggcccttagcctcgtaaaacctgggtgttttgttttggtttttaattgccaatttggtaaggaaaagctgagtgttcttaaatgtttgcattcttttggatattttatgaaattgaatctttcttcatgtttgacaatttgtgttttttcttttgtgaattattttttctgcttcctcctgtatcctttttttcctgttggggtattgtccttttcttaatttttaagaggtcttgttcatagtaaggatgttgattccatgttaacctaaatttattttaataaaattgaaaagcatgctgctttattttgcaggcatgaggatgttgtatttcttactcccttttttagtttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaaggtagggagctctgttaatttaatatacagatagttttcagcttacgaaggtgttaggttccgataaacccattataagttgacaacatctagggtaagaacgcatctaacctgccaaacatagcttag

SEQ ID NO: 9603 - DNA, 1090 bp, Homo sapiens
gctcaagtgacccacccacctcggcctcccaaagtgcttggattacaggcgtgaaccaccgcgccaggccgagaaatttttttatgagtaaagtttgtgtgtgatgaaatgcacagatctgaagtgtatagtttaataagctttaacaagtgtatatactcaggtaacctcagtcaagatctagaacattttcatcactctagaaagttccctcctgtcccttctagtggactccatcccacagataaccgttgtttaaaaagtatattgaacaaacatttttgcttatgaatataattattacaactctttttaatttataggggataaaaacattcagatggcagatcacaggtaagccaaagtggactttgtttattggagtttaaaattcagttggtgagcaacagccaagccatttttcaataaataattagaatcaaagttaaatgcatttcagcgtctagctgatggctcatttcttgtgtatgtatttgagcacgtaaagaaattacttccgacatgaacagtgcctcagacattgacactacagatcttttatggaaagcaatcgttttgctctccatgctttaacacccctggggtgaagttaggtaattttgacactctcctaacagtctgtagttgtcagtgatcaagtggaagattttgttttgtggattgagggttacttttagttgtgtatattatttgatgtttattttttgtgagggaggtgtgtccaggcatctttaaaaactgtttcatggctcattttacacttgttgtggctaattttacaaagccactttgggcactgtcttaacttggtaagactgccttgctctgatcacatgagcagctgaccaaacagtaacatgttcgttggttgatgggtttggtttgagggctgggagcagattttttgaggaaagaagctgtagaaatgagagctaagaagctttggctaaggttggaaataagaactttgtagggctttatgtttgggagaggagaggggatgttacgtagtagaatatttttatagcagagaggacagcctctgagataacatgcacattggtagttt

SEQ ID NO: 9604 - DNA, 1055 bp, Homo sapiens
cttgttctaggcattgagttctgggttggttggttctttagtcaaaattattttcttttttattgtgtaaattcattattttttttctatccttgatttagcacttttttttttttccagaataccgtgttgggtttaacttaactgccttgtcatcttgttaacaaaaattgtattaaacagcacatgccgggctgggcatggtgcctctgtcctataatcccagcactttgagaggctaaggtgggaggatcacttgaggctaggagtttgagactgcagtgagctatgatcctgccactgcactctagcctgggtaacagagtgagactgtgtgtctctttaaaaaagcacagccttcacttaaatgaaaattgagtgaatcattttatcaatggactctgttaagttggaacaggtaccattccatgggaaggtgaacctctttggctcatgtcctaacacaggtggtttatgctttcaacagatatttattatgccaggaactgttaggggctctggggctgcatagtgaacagcatcaaaagggagtattgtcacactccatttgtagacaaaatggatttcttggagatgctgctgaacagtaggatttcaaccctgactaagctgttgcttgtcacttgttccaatagcagcaacaggttttttgttttttgtttttttttgagatggagtcttgctgtgttgcccaggctggagtgcagtggtgcaatctttgctcactgcaaactccgcctcctgggttcaagcagttctcctgcttcagcctcccagttgctgggattacaggcgagtgccaccatgcccagctaatttttgtatttttagtagagacggggttttaccatgttggccaggctggtcttgaactcctcacgtcgtgatctgcccgccttggcctcccaaagtgctgggattacaggtgttagcccccaggcccagcctagcagcaacagaatctttaatgagcaagtagaaacagccagaagtgaagtggtgttggtactagggaaaggttagaaggagtcaga

SEQ ID NO: 9605 - DNA, 1890 bp, Homo sapiens
taagaaaacagttgtttggggtacaaagaaattaatccataaataggattgttacagtgactaatataaataaaagaacatttgtgtaatcatgggaattattttattttatttttcctcgacccaattaactgggtgaaaatttgcttgccagttcagatttagaattgtagacacagttaaagtttttgaccttgggagggaacctgaactttagaaaacttacaacattcttttgcctggtatccctttcataatttaacttgattgtcttttatttatttttagttattatttattaacacaaaattatatttatgatgtataatgcgatgttttgaagtactatacattgtggaatggctaagtcaagttaattcacattaggtggtatactgattctgacaagaacacttaacatctactctcagcaatttttcaattatgtgatacattgttgttaactatagtcaccaggttgtatagatcccttgattgccttttaaaagtgagagaaccttctggatgagtcttcgggctgtggttttataagactagtattaaactgaacataacatttaaaacaaacagatatttattttcctcaaacctgtatatttgatagttccttataactttctgttttaagggtgatagggattgataaacaaaaataatttgtggtgctgaaacttgactgaactctagcttgtttataataccacctctctacattgtctttccttattcaggttgagcactcctgatcccaaaatcaaaaatccaaatgctccaaattctgaaactccgttagtgttgacattaatgttacaagtggaaaatttcacacctgacttcacgtgatggatcacagttaaaactttgtttcatgcacaaaattatttaaaatattgtataaaattaccttcagtctatgtgaataagatgtgtgggaaacgtgaatgaatttcatgtttagatttgggtcccatccccaagatacctgatcatgtttatacaaatattctaaaatctgaaacacttctggtcccaagcatttcagataagagatactcaacctgtataaagggtgcagtgtttaaagtaacttgatttgttggtttcatatcaaggaatagatgtagtctatatgcatggcagttacaaaagtgaaaagagacctggcctgctgttatgtactaggaaatttgtctccattaacagtttctcaggtagccactgtcttctagtttgtggatgatgaaactgaggtccagaggaaggttatgcagaagagcatgagtgggaatgagtatggggaagtagacagggcctgaattggtaggaatgtgtattctgcagaaggtgacgggggaccattgaagtgtgtttgttagttttttgtttgtttgttttttgagacagagtttcgctcttgttgcccaggctggagtgcaatggcgagatctcggctcactgcaacttccgcctcctgggttcaagagattctcctgcctcagcctcctgagtagctgagattacaggcatgcgccaccatgcccggctaattttgtattcttagtagagacgggtttctccgtgttggtcaggctggtctcgaactcctgacctcagatgatccgctcgcctcggcctcccaaagtactgggattacaggtgggagccaccacacctggcctttgttaaagggtttttaaatcttcactgactagggctgggtttgggttgctgctgtggtcgtggtggtgagcatagccagccattgtagggtttgttgcctttttttttttttttttttttttgaggcagggtcttgctctgttgtccaggctggagttcagtggcgcagtgatagctcactgcagccgc

SEQ ID NO: 9606 - DNA, 1031 bp, Homo sapiens
tgttatggatgggaaagtgccatgcttttctttcagttcagagatggtggaagaggtcacatttgtattttttgacctgaccagagtctttgttgttttcaattttccccttctgaatgctttccgttcaccccagcgaaggatggcctggtcatgataagactttccaccgtccacagttctctaagtctgattgcggggcaggaggcagacatgtttagggtccagtaaaggggactccagccttgggacctttagaccctaacgtgtgtgtcacatcacctgcctgggtgactgtgcgctcctctggcaggaaggtccgccatttcattatgttctcggaggaatcgtcggggcacattcgtctgtgctttggttcgcatcccccagtctgcattactttttcctgtagtaacccgtgccttatcctcctgcattaggtttacggggtgaaaatagacttttaaaaattctcttaccttagaaatatacaaatatgtagattaggttgttggaccttaaaggtaagtctttctaagttactaccttcctgtaatagtaactatacctctaaatgactaatacctgcactgcgcaccagggactctttcagcctgtttgcgtgtgttaactcatttcataatctaataacctgagatagatgctattgtttttccatttaactactctggaagctgaggccctgggaggttaggtataatgacttgtccgaggtgacaaagcttaaagacccaggcagttttaactgtacccagggttactgcttctgtagagggaatgaaagaagttttaatgagaaattgttttcatcattgtgctaagcttaactgaactctagcttacgaggttttgagctggttgatcatttccatctcaaaattctcttattccacagaatgccaaatgcctcctatagtagaattttgagattcagactgggatgagcaattgctaatggaataaataatatgcaaatgtaaaatgaagttcagagaaagcaacgtggtgat

SEQ ID NO: 9607 - DNA, 1035 bp, Homo sapiens
ccatcctgccctggcgctcttgctccttcccaggtaccccaagacccactcaggataaccctcacagtgctgtcctggtcattgccttacagatcctctctccttgggccaggctcaccatgctggtccatttcttcatgttagtggtgcctggatcttttagcattggttctgtttgtctgcctgctgcatacctttgcatctagggcagggccaggcacccaggggtgccgctgaggatccccaaagggaatggaagagggtcggtgtgctgcccggcacatgggcttgtctccccacagtggggagggcctggtcagagttcagccctccatgccaggccctaggagaggggcttgtttggctagacctctcactccgagagacccagcagcctgaggcagccctgtctcatctggctctgtattgaccctccaggttgaagaggagaagaggaagaagaaagaggaggcggcccggaggaaacaggaacaagaagtaatgcattttgtttgggggtgagggctctactgggcaggagtgcaccctgaccccatgccctgtggctctctgtgcctccgtggaccttagccaggcccctgcagaccctcacagaaggagctccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtc

SEQ ID NO: 9608 - DNA, 1064 bp, Homo sapiens
aggaactgaggaaggagaatcgacagggtggttgattgatagatgggatgtacaaggtcagggaaggcatctatgcctagccctgcactggcccaaggcacgaggggagagctcatgccagatccaagtgtgggtggctggagtttgcagtgctttggaggaataacgaactggaactctggggaaagctctagacagtggtgagtggtctgcaggtccatcctggttggcaggttgggaagagctgggcttgccctgtgaggttggctggtgtgactgcctcatcagggcccctccccattccatcacagtcactcacctagccttgggtctcgcctgccgtgctgtgctgtgaggtggcctggtgctggctgtgcagacgccctggcttgctgcactccctggcagagtgctcagaagcaggaaacagacaagaggagcgccagggtggcccggccagagcctcacaggccttgcactctttgtgctggcctttccactggccaccttggctgtggcctgtgacttctagtagctcctgtttcccaaccaagggactcttacctcaccaagctgctgcaagaaggcatccccaggcccgaggcaccatgggggaggggtcctgcctctccctgtaccattcccaccagcacataaacacatactaacttttaaagggaaaaagcagaaatcctgagcactgtgtctctggttcctccaagctcagtgcccagctcctcccccacctcagcccctttccctcggccagccctgctctccctccatctatctcgaaagagctcgatcctgttggccccagccccatcctgagtctctgagacctttgtgccttcctggtttcttttccctagctctgtgtgtggcgcctccccaggagaccttatctggtcctgcggcttctccaccatctatcttgtagccggtggcccaaaaacagtttgcccagctgcctacctgatagctccactgggccaggaagcctctgatatctaggctgtccaaagtaaatgtgattttcaactccccaaacttgttcctccttc

SEQ ID NO: 9609 - DNA, 1050 bp, Homo sapiens
ggggcttgagtgtaaatggtccttctgtaagaaagctgattctggcaccaacagagaggctgcctcagatgaagagtgttagcacccgaagggacccccaggcctgtcctgaccctcccacccctgctgtcggcccaacttgtgtccctttcctggaagaactgcttccggcggccagtgtgctatgcttcctcctggctctgccctgcacccccagaacagcccctgggcttacgggagacactagtctctgggcttctgcagccaatcaagctgctgggccctccctcccaagcactggaggaggtactcgttctgtgggccggggcccctccctcctgagcactggaggaggcacttgttctgtgggccacggcccctccttccccagcactggaggaggcactggttgtgtgggccctggctcctccatgtctgagggaactgctctgcttctcctacagtccctgagattctgcagctcagcgatgccctgcgggacaacatcctgcccgagcttggggtgcggtttgaagaccacgaaggtgggtgagcccttgctgtttgctacaaagttaccaggagcttggagaggtgtcacaaggagagctcccggggctgggctgaggctcatgcttcatgattgctgatgcagaatcccaaagtggcagccccatgggtcccccggcgccattcccacgctggccagcctggcaggggcaggggagcaccccgtagctccttcccactgctgcgtgtggtggtgtcacctcccctgcgcatcatctcccctaggggcctggctgcccgctgcccctgttgctaccgcctttgaagctctcagctgaggaaccagcctgtatcctgtacactgtcaacagattgcatgcttgttctcccacttcgtggaggtctttttgttccacagaaagttaatttttttgttttttattttcaatttttatttatttgtttattgagacagagtttcgctctgtcgcccaggccggagtacagtggcgcgatctcggctcattgcaacctctgcct

SEQ ID NO: 9610 - DNA, 1139 bp, Homo sapiens
gttcttatcacttgtcctagacactggtgggctaatgctgtgagaaggcagcaggaaggtgaatgtcttacggagaccccagatgtggcctcaagtcagccaggtatataagctggtgactttggggattatgtaccgttttgtaaatctagacactgggtcaacaccagaatctggtaatacatagttaacttgaagaaatgcttgagccaagttaataaacagaagttagtcagaaggactgcccattaggcaccgtggatggccttgaagtgagacatgtgggtctgtgggtgctgctgagtgaccttgcctggcgtccctcgtgtttgcaggtgacctgagcatctctgcagaccgcctgagtgagaagcgctctcccaacgactttgccttatggaaggcctctaagcccggagaaccgtcctggccgtgcccttggggaaaggtgagcgagtggcctagaaggtgtggggcttggacaggggcactggcgccagccacactctcaggcccccagcagagggccgctctgtgtgtgaaggatgttgtcactgggccagagcctggtgctggtgcagcacaggctgcctggccccggggacctggacatcatggagactccctgagtctctggacaaatcacttccctcctgggatttctgttttctggtctgtaagtggagatgtgatcagagtagacgtccatggaggcttcttggttcttgtgttctgtgactctgagtattccaggccccagggtgtaggatgcgttctgatcttcccggtgacaggagttgttgactgcagggtaccctaggaaggggcgtgaccatctgcagctgtcaagggctcagaggtctggatgtaattcagtaacttcacctaaacctcggcccacataggaccggtttatgaacttcaccaaagaaggctatccttagtcttttttttttttttgagacagagtgtcactctgtcaccaggctggagtgcagtggcgcgatctcagctcactgcaacctctgcctcctagtcccggttcaagcaattctcctgcctcagcctcctgagtagctgggattacaggcatacgtcaccatgctcagctaatttttgtatttttttgtatttttagt

SEQ ID NO: 9611 - DNA, 1028 bp, Homo sapiens
cttgggtccttgagtgacacacctgagtggtggaggtgcacgcttactgctttgaaggctctaaggagggaggctggggcctggggccaggggccaggggccaggtgaggctggctggagcagccacattttcctggcagccctgtgctttcttgggctggtcctttgagggggcccagtcctcctgaggctgtggccttgacctgcagaagccatgctagagtccagctgtctcttggtgcaggggtgtaaatggcacacattgtcaatgtggggttctcctacccctcatcccccagcacccagagggagagggtgccgctgcggcaaagaggcttgaagttggtttggtttgggggatttctgttgtgagtttttaaaaattgaggttaaattctcgtaacatacttagctgacaggagggataccatgatcatgtaggtagctttcccaaggcgaggcttatccgttatactccagatgtgctgacccctatgatttccccaaatgtcagaaactgaactgtgtaatttgtgatggtgtggaactgtgttcctgctttccctgatagaaaacataaattaaaaatgtaaaaactaagtaatttatatgacataaagtgaaaagtacacaattctgtggtatttggcgcatgatgttgtcatgcagccttcatttctgtctagttccaaagcattttcatcacccaagagggaacccatccatacctgtcaggcagtcactccctcgcccccagtcgaagcgctgcccctgtgcctttgcctgttctggatgtttggcgtccagggaagggcttgaacacctttttccttggttctgtgccatcccctagtccctgtctttctggcggcctctgggctgcccgcctgcctgcctgacaccatgtgccctctgtctttgcagctcctgactacaggtccattctgagcattagtgacgaggcagccagggcacaagccctgaacgagcacctcagcacgcgtagctatgtccaggggtactcactg

SEQ ID NO: 9612 - DNA, 1024 bp, Homo sapiens
gagtgtgcgaagaacaacttccaggcccagctggaattcaaactcaaggtagcgctggctgcagcctgggggagacgaggccagggaaggaacgaagccttggggatccccctcacactctccccaggccccaaggaaggttccccaaggcagtgcacataaggggagcagctgttgacatcccggaacacagacagggcccagagaagggaggctgctgcctgcagccacacagcagagccagcctaggccctgtctctgtggcagggacactacatccttgagcggaggcgtgggggtcccgaaggcctcgttggcgagggttgggtccatccctcctgggctcccaggcaccccaagagaataactgttccgtgcccccatgaggatgtgattctggaggccccagcccccgctcactgggctctgttctgggtgtggccccgcagcccttcttcgggggtagcaccagcatcaaccagatctcgggaaagatcacgtcgggagaggaagtcctggcgagcctcagtggccactgggtaaggggccgtccctcagggcaggcacggccgggcggtcaacgccaggccagcctctgaccccgctggccatctggggcaggacagggacgtgtttatcaaggaggaagggagcggaagcagtgcgcttttctggaccccgagcggggaggtccgcagacagaggctgaggcagcacacggtgccgctggaggagcagacggagctggagtccgagaggtgaggcctgtcagcgcccagggaccctgctgaccacagcctgacatggccaagcaggcaggtcagcagggctacagtgctgtgagcatggccccaggatgtccctggcagggagggcaggcctggtgcacccctggtggcagatcacgtgtcctggaaaggacagatggagggaaggggtgtggcctggagaggagccggctgccgtgacctctcactgcatcactgccggcgagtgaccaacaggtgcacagggaggtccctgc

SEQ ID NO: 9613 - DNA, 1043 bp, Homo sapiens
gctgcgggtgctccaggggtggggtggagacgcattgggaagagttcacatctgatggggctgagtcagcctcatgaggccatggaggccaggtcaggggtttacaccctaaggggtggcaggtacagcctcctccagccagagctgccactgtcccgccaccccttcctcccggctcttccgggcagggcctgactgcagcctgtctgctgcagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccaggtgcgcgccatgccgggaggggcaccccacacctcgtcctgcatctgcatgagaccctgcagcacccccagcccctacctgccctgtgggggcttccagagaatcccatggctgatctcagcccactgtttctgcagctgtagcctcccagggggccctgtctccaagatgggcctgggaggagccagccatccgtggtgagaggggggtcagtcccaagcacttgccatgcaccctgagccctgcaccctcgagctggatgggatgggctgcagaggcaggaagggggctgcagaggcaggaatggggctacagaggcaggaagggggctgcgcagactggaaaggggctgcagaggctggaagggggctgcgcaggcaggaagagggctgcagaggcaggaagggactgcagaggctggaagggggctgcagagctggaagagggttgcagaggcaggaaggggcagcagagcctggaagggggtacgcaggctggaagggggctgcagagactggaagggggcaacagaggcaggaagggggctgcaggctcaggagccaggcagagggagcaggtgggaacaagagcatgggcagggaggcttcctggagacaggggcaccctggcagcccaggtcagc

SEQ ID NO: 9614 - DNA, 1058 bp, Homo sapiens
aggagacttagttttccaaacaataagccctaataacatcatgaagccaattaaattgttttccaaaattccaatctataaaattttcatcttgatcataagatataacttccataagcctttataacctttattaaggagtcagttattgtttcaagaaaaccttgttaatctgacacaggggcccatatgctagtcttgcatcagtgtgcctttgacattaatgattaatttatagaggaactgaacttactttatctctcaaagtcagcccttacaatctcacatgtctatctcttctgggatagtctctgggccttgaggagttgaacagctttaatttctgtgtctcaggaatgtggtttattttgattggcatcttctaccgggcctgaagatgaagctttaattgctgtcagtgtttaaaatttagcaggacttggtgttctttttagacccatgagtcaaatccctgtaactcaatgtcgcaaggactttaaaagcacatacaagaagatataaggacggaataaccttgatttaaaaaaaattttaatatctgtttttcctaagcaaaccaaacttaataataatggcataggaattattttgataaaacataaaatctgttaggccacttaccaaaaggcaaaagcaaataccttctgcagtgtatagaatattatgttagaagaaaacattttctttaagaaaacattgttagcatcaggccacacacacacaaaaaaacagaacctgaggaggaaaacaaaacttatatgagctgaaaatgagttgaagggaagtgttactattttgttccttttaagagggaagagaaaactgaaactggcaagatgcaatgaaagttgaactttgggttaaaattaaaaaattaaaatatcttataattgattaagagtaaatcaacctcttaagaaaatgtcggccaggtgcggtggctcatgcctgtaatcccagcacttttgggaggccgaggcaggaggatcacgaagtcaggagatcaagaccatcctggctaacatggtgaaacccca

SEQ ID NO: 9615 - DNA, 1029 bp, Homo sapiens
gcaaggaggtggcatcaaggtcaccccagcccctcacccagctgctgtccaggagggacaacagtggctgctccccaggggtggccgaggaacagcgcccagccctcacccctcctaacccggggctgccctgccagctctaacgggtgggaaaccagagaaaccctgaacacctggttacatttggatttcagagaaacatcagagttctttcatgctagtatgaccccagtcatgtatgggaaatacttacaccaaaaagctactcatggtttctctgggattcgaacatcattgggcatcctggatgtgcctttgctgattctggacagcccaagtcaggaggctcagagctggaaagctgagggcagagctgccagctaagaaaggggacagagctcccccacctacccgcctctctgcagccaagtgtctacctggccaggtgcctggccccacctggtggccctgtggccctgggggtgtccaggtggtcccaggtgtggatccgcatggttctgcctgacctatctgtgcagctggccctgggtgttgcctcgggtgacacccagatctctctctctccagggccccaaaggtgagagcgtgggctccatcacacagcccctgcccagcagctacctgatcttcagggccgcctccgagtcagatggtgagtccctgccagcttgcgcatctccccagtgcccccacctgaagtgggcccccttttgaggttgtagcccaggtacaggtggccccagttcagtcccttctactgtctgggggcagcctgaagtctggccaggatgagcccggctcggagtcaggcctacactcacagagcccccatgcctagcctcagttttcccatgagtaaaatgtgacattaaaataccacctgtcaaaggccaggcgtggtggctcacacctgtaatcccagcactttggcaagccaaggcgggtagattacttgaggtcaggagttcaggaccagcctggccaacatggtgaaaccccgactctact

SEQ ID NO: 9616 - DNA, 1067 bp, Homo sapiens
ccggaagtgctggtgggggggatggagggtgccaggcgggaaacgagtggagcgcccttctctgacttctgccctcatatccttggcatcaggccaacctgggctcctagccctgggccggcccctgtgccctgtcccgcatacccacctctctctttcaggcagagtacaggctgtgcaacgggtcagacaaggaatgtgtgtcccccaccgccagggtcaccaagaaggagactctcaaggtgagcccgggcccggggagggtgcagcagtgtcactgtcagaccgacggccacctgagccagggaggtcaccctccccacctgtcaaaaggaggggacaaaccgcacctggtcgcctccacaccccctacttcctcctacttcctctcctgcccctgcccctggacccatccctgggctggacggtgggaggagctggggcagctcggtgccttctcccatgacccaccgcgggtgccccgggcccaggcgcagaaggagaactaccggcaggagaagaagcgcgccacacggcagctgctcagcgctctgacagaccccagcgtggtcatcatggctgacagcctgaaggtaggtgatgcccggcctccggccacccaggacacgggtcagcgtgctgctgccataacaaaggaccataaaccaggtggcctgaaacgatggaaattcacttccctgcatctagccgttatcactgcagcctctgctccttcctcatgaggcctttccttatccacctgtctctccccctttttataaggacaccagtggtaggaattagggccaccttactccagtgtagccccatcttcacctgattatgtctgcaaagaccccatttccgaataaggtggggcctggccagtgggcggagggcgctggggagggagacattgctctggcttctgggagaggaccccacatcagggccgggtgtcctgtgttcagacctcacggagaccgtggccattcactcgcctctgagcctccatttccccttgtgtacagtggaggtaaaactgcccaactccgaggctgctgggc

SEQ ID NO: 9617 - DNA, 1049 bp, Homo sapiens
aagggtcctgcccagttggggagcaggggttgcaagtgctccatcccatgccatgcggtcttgcctctctcttcccctgttgcctcaaatacacacagccccattcagctgcatctagtgggaagctgggcagaggggaattggcagcaggttcatgcgtccatccatccatccatccatccatccattcatccattcattcattcgagatgcttgctaagcccccagctgccggtgtgaatgggcagtagggtagaaccctcccctggtggaagccacagacaatcatcagttcaccacagaaacggctgcgtggttgtattgcaaaagtcctgggcgggccaagggtggtgtgtgtcaccaggacctgtgccagcagggatatgagctgtcctgcttctggggaagcagctcagggagcctgagaaagaaaggagcaggggctacccagccacagggaaaagcattccaggctgggaacaccatgtgccaaggtaactaagggcatcatgaacaagatcctggctcaggggactcccaggagggcaacttaggacaccttctctgccagcctgggtccctggaggcctgtcaactggccagggtccagcatatgcctcgtcactcagatctgcctcctccttatcactcatcgtcagcccaaagactgcttccaagtcagagccccccaggcaccccatcttgtgccgttttcttcttgtgatcctgaatgctcttacttggctaagaaagtgccacaatggagcaacactgcctgggttcagtcccagctcagctccttattagctgtgtgaccttgggcaggtttctgaacctctctgtgcgtaggctcttcctctgtacaatgctgagaataacaacgatgacctgagctgtgggatctaacgtgcttacatccatgcacagaacgcagaaccgcagcgctcacctgacccctggctcctcccgcctctgcgtgctggtggctggtctgcctctccctgaaagagcaggacactggcatctttactttctaacctcagtgccta

SEQ ID NO: 9618 - DNA, 1044 bp, Homo sapiens
gtgcactggctctgggtggggcccccattgggcctgggccccatgctgccaaacagctggccttggcgtggggtcagagagcatggcccctccccaggtgtccagaggcaagcatcctcagggacacagggctggccaggcagaggcagaacctgacctgtccctccccatctgctctgggctggcaccacatgggacctcttgtctcccagtggtggaaggggtctttcatgccccacatgagaaatggaaggaagagcctgctccagcctatgcagtgggggttggggaggggtggtcagcccagagtcagagctcactcccttcctgtgccctcgcctctgtcccctccgcaactcctaggtggcccaggaaactcagcagggcaggaggaagtgggagccatgaggaggggaccaggaggtgcctgtggttaacaggaaggggggtcaagcagtggctctgggtgtgggtgggaccctgccgcaggcaaggcggcccccaggcgctgccaccacggggcggtgtcttagctgtggtctcaggagtgcagcagctgcacgacaccatcacggccacctgcagtccccgagagccccacatgtccatctggcctgggcattctgcagctttgggcacaggcaggggtgggagtctggggctagcctggaggagggtgctggggtctcaggagaggacctggaaggggcacccatccctgcctgcctgggcatccacctccttgcccagaggagggcctcaggagtggcctctgcctggctgccacggttctggctctctgtcccccttactctctggccctccagaacgttccccggcccttagcagctccagcgtctctcaagcccccttccagccatgagcgaattcattctagagatgcagagttggcccctgtgtgtgccccgcccaactgggtccagaggtgcttgagtagtcaaggaagtcagctgggccagtgtccccttggcggaagcacggccctgcccagcccagcacagctcagttcaggggaacccaccc

SEQ ID NO: 9619 - DNA, 1031 bp, Homo sapiens
gacacgtgagcacttggcgcctcgattcgagttcacaaacggcactccggagaggtcagtgcagctctgcctgcgttgctccgtcccagctgggcctgcacggggctatgtgcccatagcagggctgactgggctgacccacagcctggggcacgagggagaggctggaagcaggccttgtcaccatgggctggcctcggctgcggctgtcccgacccaggccgcttgaggtcaagccaggtcggccagcagaggcaggagccgtgcccaggcccatggcaagccctgtgggacacaggctgtcagacacatccagtcctggagctggcgcccactccccctcctcccagggcctctgccagcatcctcctgggtgggcccggcccagccctagcccctgactctggagcaggagtcccaagtccagcactcaggcctcacagaggccttgcagccctcccacccgcccggtcctcttgagacggggtgagtcacacggctgtggttctgccttggggaaaagtgaagcccaggacgtgagggtgactgggaaggatcccaggacagagctggggcctcggcccacccagagctaacaaggtgcgggctgtgcgtttagctcaggagggtcgtgacagctgccaaggcccccgtgccctcagctgagccacctctaaaatcccagcccctcgtgaagaccagagctgggtgtgctgggaaggggcgtgagaggcgaatcataaatagaaacgccagctccagccacggcgaaggggatctggctgccagggaccctgcagtctgctgccctgtgccaggccgcttcgggacaggctgtacaaaggccaactcagtcatctcccaaaccccagaggggccccaggattgtccccctccccagagagaagcctgcagcctggagctggcctctccccctgcactcaggcacagctgtgtgcccagcggcttagcagctctgcagaaggcaagcgacggagtgcccgaaaccgggtgcgatggaaaccgggtgc

SEQ ID NO: 9620 - DNA, 1026 bp, Homo sapiens
tcgggagtcgtgccaacttggggctgtgcttcccggcagcttgagcctgtggtcagttttgaaattgaggtttaacgaatgacctcaggaataactgtcctcccgccctgttcattatttttaaactgtgtctgctttgaatgtgcaaggaacatgctgtttgtctctggtgggcgcctgttcctggctgtggccattcattattcctgggcctcagccctagcgacggtgctggcgtcatcagcccccgcagcttgccagagcaggaatagccccaggaatttgtgacctcaggcagccacatcttcaggctagagggggctttcccacacaagagcagcttattcccatggaggctcagatctttaaacacatttgccctgttccgtgcatatcccaaaatgcattacatgcaaccttgaggtctacatgagaaacactggaaccctcttcctgctgacttgtgtcattataacagctaattttgataatgattaacatgtattttatggaggcttttggaatgacttatctcctttaacccttgaaacaaccctatgccataagttctattattgtccccattttacaggtggggacactggggctcggagaggtgaggaaacctgcccagagtcacccaccgctacatgacaggactgggattggaagcagctcacctcgtagccgggaccccctggcgcctgggggatgttgcactctgtgggctgtttctccctgtactcaatggccccagactcctcctcttctccttgttggaggggctgtcaatgctcattcccgcccactgctgtctaggaaaccagatgagtaagattgttagaaaagtgagcaaaccgggagcggacggacgcggcaggaggacccgggaagtaccagcgaggcatgaatgagacctggcacgtggtattccatgatgcttgattgggctgtttagagggctctttacttttctgtgttcttcattcttctgtttctcgctcaacatccagtgtggatcacacg

SEQ ID NO: 9621 - DNA, 1084 bp, Homo sapiens
aatatgtacattcttagggattttaagtggaaaacagggaggagatttgagggataccccacctcggcaggcagctggtcaggctgcctgttgtgaccagcctggggtcgccttcccttcatccaaggccaggggagatggcaaaccttcagtaagcgctgccgtacctggcagagcagaagcaccaccccagcttggagacagcatgcccctgactgctggtcacggatggccccttggtaagtgccctgtgcttctgagcaaggcgggaacgggcctccagacgctgggggacagcacagagggagctctgtcgcccgtgcctttgtcccttctctcgctggcccattctcagctgcttcctcgcggggaagggccttcctcggccaggggagggagagctcagtatcccggcgttgcggagggattgatgtgctattggggtgaatacggcgctcggtgtgggggcggggtggggggggggagggttgtcatttaaaggggactttggggatggtcagcagaggaaggcgtggtgttggggcggagcatccgcatctccgcgcccctttcctggcagccagcgggatttctcctgatcagctattgcggcgaataagacagagtcaactaaagggcgcgccgctgtgggtcccattcgctgggctgcggctccaggcaacggcatttgtatgcccgcctattagggtgaatgcgacgcggggagtgtgggtcgcttaaagggccgggactctggaagcagtgcgtcccgctcctgcccgcctattgcggtgaatacggcgcagcagtcgggttgtttaaagggtccaggcgtcctgcttgctggactgtgctgctttggggcagctcctggtcctgggcgggaggggagcactttagggaggctccccacattggccagagggagaggagccccgacgctggcccgtggggcaggaacgctagatgccctccttacaggatgaacctcacccccaccccaccccctgctgccttaggaagtcacccaaatttagcaaaattcaagccagagccagcaggcaccagggtggggcatgtgacc

SEQ ID NO: 9622 - DNA, 1247 bp, Homo sapiens
tgtgatcgtggctcactgcggcctccacttcccaggttcaggtgattctcccactccagccttctgagtagttgggactacaagtgtgcaacagcatacacagctaatttttttgtattttctgtagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactggtaatctcctaagagcatgtaccttgcttttcacttgctgctttcaggattcttttctcctttgactttggaaactgtggttataatgtgtcttatgtccctttttgtttatactagttgatgtgttgagcttcttgatttttttgtatttttttcttacttttgagaatttctcagtaattatttcctttcatacctcagtttctcagtctgtttttcatacttcatgtctttttattggtatccttattttcctaattttacttagtttgctgttttgccatttttactcattgagcattattcaaatggtaattttattttcttcagttaatttatgcatctccatcattttagggttgatttctgaactttttttatttctttgattatgccatgtgaccctaatactttgtacatgtcatctttgactgagattcaggcattaacaacaagcctcctgccacaacctttataatgtgcctttctcctggggtcatctaaaacaaataggcccagattctagaggcctcttaagcctgttctgggatgtgtcttgtgtggaattgtgtgtgtatttttcatttaaagagggtttctcagctttctttgtagtgccctggaatcacacaatacacttgtcgcctggtgctgctgctgcagccttcctaccgctgtcatgggtatttcctttcggtctcagcagacccagcctgtcactcagagtaccaccatttctctcagcactccgtgtcacagggggcagaaaccaatctttgccaaagcttcaaaaggccaaaagtaaaaacacttgtgccagtatttgctttctcttttgaaggagaagccaagagctgagggtgtactcttaaaggcatgatgctatactgcggaggagcgggggctgcagtgggtaaacgtaacagactgtttttcttcttatctggctcctagcactgtgctcacctggggt

SEQ ID NO: 9623 - DNA, 1053 bp, Homo sapiens
cagcgtgaacatctttgcaatattaagtatttcaacctttgaacaagagcatgctcaaatgtgttgtttaatttccatatatttgtgattttttttgtttttctttgttatttccaggttcatttcattttggtcatatatagtaatgcagaagacttcaattttttgaaatttgttaagacttatttatttgtttaacaggtggcctatcctagagaatgttttctgagctcttgggaagagtgtgtctcctgctgtgttgtgtggagtgttctctctatatctgtgaggtggaattgttttgtagtgctttcaagtcctctctacaattattaagtcttgctttatcatttattactgaaagtgggttgtagaagtatgccaatattatattgctgtctgtttcttgctttgatgctgtaattgtttataaagaacttgcaaaattgaagcaaaaaatagcagtataataggaagttacttcaatacctaaatatatatacgaatatgcacccacgcttgtcataggttcccagttcattctcccttctgttactgttttatgttcttgttttttgtgagctctgacttaaagtatgttttaggaagtatgacattttttgacttaagatgtattttgcataatacaattgtaacctcttctgctctcatttcattaacatttgcatgaaatgtctatttccatcttgccactttcagtctctttttgtcattagatctcaagtgaatctcttgtaggtcagctgtagtttgatcttagtttggttttaaattatttagcatatgccttttgattgagtagtttagttcctaaataagcaatttactgaaatgaaaagatgtactttagccattgtattttttttacttgattcttgtagctttttctttctctctttcctttttgtgtcttgtactttgtataataagctttgactctttttaaattttcttttgtgtgtcttataggtattttctttgtggttaccatggaaattatataaaacatcttaaagttacaacaaggtattt

SEQ ID NO: 9624 - DNA, 1028 bp, Homo sapiens
atcagaaagtgtaatgcctctttgttctttttaaagaattttgactagttattgttcttaaactaattttagcattaaaaaatcaaaaagtagctttgggaatttgatagagattacattgaatgtgtacattagtgtgggcagtattgacatctttaaaaaactaaattatctgaccattgagcaagaatgtgtatgttcaagggttttaatttccatacatttttggcattgccagttttacttttgcttttgatttctagttttattacattttggttagaaaacatgtcatgagactttcatctttaagagttgttatttgttgtaacacaatgcactatgtgtatttgagaatattgtatattctgcttctttggactggagagttctatgcatgtctgttaaattgatttggtctgtaatgttgcccaagctttcttattgatcttctgtgtaattttctattctgtattgcaaatggggtcttagagttgataattattgtattgctgtgtacatcttgcttcacttctctccatatttgctttatatatctgggagccctgatgttagatataaatatagacagataaacagttacaggttcctggttaatgtacgcattttgccattacatgctattaatctttatctcctgtgacagttctgacttacagtgtattgtgtctaatataaggataaccaccccacctgattgtggttactaattgcatggaatttttttttattttcactttcagcctattttactatttaaggctagagtcttttgtagctagcatattgttcttaatccattcagctattttatttctgttcaataagtaggttaatttatatttaaaataatttctgaaggaaatgaagttactatcaccatcttgattgttactgttttctgtgtttcttgtagatatgttatccctcatttcctctttgactgtcttcatcgtttgttttgttgattttgtgtggacaagctttcattcttttctcattgtgtt

SEQ ID NO: 9625 - DNA, 1050 bp, Homo sapiens
caacctctgcttcctgggctcgagccttcttcccacttcagcctcctgaggacctggaactacaggggcacaccgccacacccagctaacttttgtgtttttaatagagacagggttttgccatgttgcccaggctggtctcggactcctgggctcaagtgatccacccgcctcggtctcccgaagtgctggggttccaggtgtgagctggtgtgaaccagtgtgcccggcctatgctatctttcatcgtggctgcatcctttctttcctaccagcaggttacgtggttttcaatgtcttcacatccttgacaggtctggattttttttttttactgtggccattctaataggtgtgaggaaatatcttaattgtgattttgttttgcatttctctatagataagtaatttgagcattcattcaaggcttgttgggcgtttccatatcttttttggagagatttcagttagtccttcatctatttttaaatcaaattatttaatttttgttgtttagttgtaaaagttccttatatactctgaatataaggatacactcctatcaaatgtgtgatttttacccatttcttaggtggtattttcacttcactcattgttttctttgatttgcagaaagtttgaagtttgatgtagttcagtttttctgttcttttgttgcttatgcatttgctgtcctatattttcttctaagagttttattctttttttttttttttttttgagatggagtcttgctctgtcgcccaggctggagtgcagtggtgcgatctctgctcactgcaagctctgcctcctgggttcacgccattctcctgcctcagcctcctgagtagctgggactacaggcgcccgccaccacgcccggctcattttttgtattttttttttttagtagagatggggtttcaccgtgttggccaggatggtctcgatctcctgacctcgtgatccacccgcctcggcctcccaaagtgctgggattataggcgtgagccaccacacccagcctattctatttttatgtttttc

SEQ ID NO: 9626 - DNA, 1115 bp, Homo sapiens
tctttacatccttatcaacattgttagtagattggcgcaaaagtaagagtatttcttactatttagaaggcaaaaaccacaattacttttgcacagccctaatatgttacttatttttgatattagccatcctagtatccaaaagtttgattgtaaattgtctttggtgtcacaagctttttagcttaatgtactccattttgtttatatttacttttgttgctgtacttttggtgtcgtgtctaaaaaatgattgccaagaccaatatcagaggttttctctcagagtttttaaggatacatgttttacattttaggcttgatttcaagttaatttttgagtatggtgtaagaaaaatgggctatttcattattttgattgcgggtattctgtttctccaggaccaagtgttgaagagactatactgtctgtattgtatcttcttcgtgaacttgtgaaagattagttaagtggatatgcatgagtttaattctgggctctctgttctgtcccattggtctctgcggcagttttcctctctgttcgcataccatcctgttcttactactgtagtcctaaaatgtcacttgaaaacagaaaatattatgcctcttgccttgttctttttcctatagattgctttggctatgccaagtctattgtaattccatataaattttagaattctattttcattactgtgaaaaaggccactggaatttgataagaagtttattgaatctatagtcttggtctttagcagaattttacaaccccctccctggattactaagctctattaaaggcatttttgtgagatgagatctctctgtgtcacccaggctggttctgaacttctggcctgaagtgagcctctcaccccgaggtcctgaatagttgggattataggcatgagccgtggtgcctgattctcttggaaaggcatttctgtacaagaagactgacacatttttgttgctgtcggggaatatataacccagggtccacctatgtcaccatttttctatgtcactgtcctgtacattttcactttctcttttgttccatttcaaatttatctctaatttcaaattctaatatgcagaacaatatg

SEQ ID NO: 9627 - DNA, 1015 bp, Homo sapiens
tgtataatgccactcagtgcaaggtatgtagcccgagaaatgaccgacctgatgcgtgttataacccatctgagccctccgcaaccaccgtttttgaaataagaataagaactggccttttcctaggtgatacaagtaaaataataactagaacagaagaaaaagaaattcccaagcaaataactttaagatttgatgcttgtgcagccattaatagtaaaaagctagaaataggatgtggttctcttaactgagaaaggagctaaagagtagaaaataaatatgtttgtcatgagtcaggggtttgtaaaaattgtgcctattggccatgtgttatttaggctacttaaaaaaagaacaaaaaggaaccggtttatcttcagaagggggaagccaacccctcctgtgctgccagtcactgtaacccactagaactaataattaccaatcccctagatccccgttggaaaaagggagaacgtgtaaccctggggatcaataggacagggttaaaccctcaagttgccattgtaattagaggggaggtccacaagtgctctcccaaaccagtatttcaaaccttttatgaggagctgaatgtgccagcaccagaacttctgaaaaagacaaaaaatttgtttctccaattagcagaaaatgtaattttcttacttacataactgttacttcttgttatgtacgcggaggaaccactatcggagacagatggccttgggaagcccaagagttggtgcctactgatccagctcctgatataattccagttcagaaggccgaagctagcaacttctaggtcctaaaaacctcaattattagacaatactgtagagctagagaagggaaagactttatcatccctgtaggaaagcttaattgtataggacagaagttgtataacagcacaatacagacaattacttagtagggcctaaaccacactgaaaagaatccatttagtaaattttctaaattaaaaactgcttaggctcatcca

SEQ ID NO: 9628 - DNA, 1050 bp, Homo sapiens
agcccggttcctgatgattcctgggtcctcacaatcccaggccctgtcagctctggggtctcagggatgggaggccccaggttctggaagctgttgtgcacttgagtgatgtagtgactgaggacgctggcaccgtcgggaggccggggcgtccctccctctgccagagttcaccgcacaccggctacctcgctttgcagtcgagatatggtcttggtcagctctgtgagtctgttgcccagatctggaggaggtggagtaccaaggggcctttcagaggatgagcctgccctataccccttttaccctttacagtaccccaggggttgccctatccaggattcctgagggagaactggaagaagtgaggaacgggtttgtgggctaggggtcaggtgggtgggtgaagctggggcaggtgaatctgatcgggggtgggagggagtagctgaggagctggaaagaaggaaagtctgggggccagagaaagatgacaagccacggggaaagcttactggactgcgtagacatttgtgcgttcacctgcctgccctctcccgagtctacggccagccagctcaccccatccttcagggcccagttcagatcccaccccctttgtcccttctgctactctatccttctgccttctcatgagcctctcaaaatgacgtgctccttctcccttcaggcgcccatggcaattcgcgtctctcttagctgcacttcatgcccgctgtgatggtttctcttcctcaccagactgaaagcttcccgtgtgtccctgccctacagtgccccgtctctccctccaagacagggcctggaacaaaggaggccatagtgatgaatgttggtggaacgagtcaataagcgagtgaatgaaaaaggtgaatgagtgactgggtaagggagtgaatgggagaataactgaacacacctgaaggcaggaatgagcacttacatgaaatgagtgggacaaatgcccggatgggtcagagggtaatggagtgcaaggggcatgctgtgcaggttacccttccaagggca

SEQ ID NO: 9629 - DNA, 1116 bp, Homo sapiens
aaaaggttatgctcaccaggacaccaacatgtagtaggagaggatcttaaggcatgccagagtcagattcttagggctgttgattcataaactccactttcttcctgtttattttgactgtaaggctaaacctctggtaaaggtactgccttttaggttactaaaagcttttgctttactactccccccctttttttttgttttttgttttgtttttgtttttgttttcgagacagtctcgctctgtaccccaggatggagtgcagtggcataatcttggctcactacaacgtttgcctcctgggttcaagcgattctcctgcctcagcctcctgagtagctgggattacaggtaacgtgccaccacactcggctaacttttgtatatttagtagagatgccgtttcgtcatgttggccaggctggtctcgaactcctgacctcaggtgatccgcctgcctcagccttccaaagtgctgggattacaggcgtgaaccactgcctccggcctttttttttccctcccccctgcaccaagacagagtcttggtctgtcacccaggctggagtgcagtagtgcaatctctgtttactgcaacttctgccttctgggttcaagtggttctcgtgtctcagcctcttgagtagctgggactccagtcacgtgccaccacgccaggctaatttttgtatttttagtagagacaaagtttcatcatgttggcgaggttggtctcgaactcctgaccccaagtgatttgcccgccttggcttcccagagcactgggattacaggtgtgagccaccgtgcccagtgttttcctccatttttcctttttatgtttaagatagagtctcgctcttgttgcccaggctggagtgcaatggtgcgatcttggctcactgcaacctccaactcatgggttcaagtgattttcctgccttagccttccaagtagctggaattacaggtgtgcaccagcacgcccggtgatttttgtatttttagtagggacggggtttcaccatgttggtcaggctggtctcgaactcgtgacttcaagtaatccacctcccttggcctgccagagtgctgggattacaggcattagccac

SEQ ID NO: 9630 - DNA, 1052 bp, Homo sapiens
ttattagcaccaaagaccctacattttactttgcatggggaaactacttgtgccgtttgagtatactggaaatagcagtcttctcatctctgtgtcaagatgactgcataccatcacctcaccccttaaagaggttgattgcaaaacttcagcttctttttttcttgggggagagaggcctgtttctttaggtatttaggaagatgtgtatttttctttaatggtcacatttgttccattaccttttatataatatcgtcagtcccctgtttccagttggttcttaagcctcgcttttgctcttaaaaaaagcaagtaaatctaagcaaccagaaaacataaaggtaactaaattttcatgtgatcttctctcctgtaccttttaggttagagaaaatgttggttggcagataaaccttagtcacagagatgaattaaggtagttgcagagtattttgttctgtggttagaacattagtttcaaaatcctggtctgggatccaatttccagctggctgcatcaatgccctggtaagcttgacttagattccacagatttggcatggggctcaggcatatttatattttaatgcttctccccaggtggttgaaatgtgcaatcaggtttcaaaactatgttgaaagacctcaggcctttggcactcaggtagagatacgtgtaggtttttacctcagcctttttttttttttttgtaaactttttttttttaaattattattgtactttaagttttagggtacatgtgcacagtgtgcaggttagttacatatgtatacatgtgccatgctgctgtgctgcacccattaactcgtcatttagcattaggtatatctcctaaagctataccctcccccctcccccctccccccaccccacaacagtccccagagtgtacctcagccttataactgaagtgtaacttgtgttcagtaacatcaaggcaggctaattggcttgctcagaaacttagcattgttcactaagtgaatttaagttaatgactttttttttttttctgaggcaaagtttt

SEQ ID NO: 9631 - DNA, 1031 bp, Homo sapiens
ttgtttttagtaaatgggtagtagctgttttttattattatttagtacggtagccctttaagacctgcataagacttggttcgtaccactggactgtaacttaaataagttagtgattcctagcttaagtgtgaaaatgagattggaaataattgatgtaccatggtaatttaaataaatgcagtctgactctagaaccagatattgagttgtcaatgtaggagtgactccttgctcttaagcttatggggcaaaactcaagtttatgacacatgcagaataattccaaggcagcatagttaccattattcactatttatgtgttaggtggctttctggtcttatatatgaagcgcttttactttaattggttactttaattggttatgttttacaggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtatagtcatttaacccagttcagacttttataaactatatttggagtcacataacgtttatgttggaagggatcctttgctaaattctattgattgattgatggggttcttgctctgttgctcaggctggagtacaatggtgggatcatagctccctgcagcctcaaattcctgggctcaagcaatccttctgcctccgcctcccaagtagctgggattataggcatgcactaccatgcctggctactttttaaaatgtttgtaaagatcgagtttctcagtgttgaccaggctggtctccaactcctgggatcaagcagtcttccctccttggcctcccaaaagtactgtgattacaggtgtaagccactatacccagccaaattctctttatttttagaaatttggagagagatgtacagatacattatgattcactccaaactacaaaccta

SEQ ID NO: 9632 - DNA, 1081 bp, Homo sapiens
ttgtctagataaaccagttttcatgagatggtataattgaaagtgttgtgttagtgaaagacgatatgttggatttagttttcctatagttgtctgtaagaaagatgacatgattgtgttagttgagtattttgatttgcaagtattgaattttaagaataattaatttttaaaaattctttggaaacctgttttattataggtggcaggcagttaagagccctggttgtcaaatacacctaggtttgaaccccatttctatcatttataacattgtgacatcgtgctaattactaaaccctaagttttctcctctgttaaaagggaataatagtttctacaccagacattttgatgagcatgtagtatgttcccgatgtcttctaaatgctttatgaatgtttatccattttaattttaggattactatctaagctatgtgttacttcatgttataattgaggaaactgaagcacagagagatttaagtattttacctatgatgtgtataatgtactgagcgcagtacttgacctgcagtaacacttaccgtattcacccctttgttgaaatgagtggtcactatgaagtttccaaatgtattatatttttaagtaactgacctctggcacaacattgaaaggatcttctgtggtgcttttttctttcctcttgtctccgtagctcttggtgctggacaggcatctttgtttgggaacaaccaacctaagattggagggcctcttggtacaggagcctttggggcccctggatttaatactacgacagccactttgggctttggagccccccaggccccagtaggtaagtgtcagtcactttagaaggcttttcttaattttttgctaatacttgctgacctgattttccatcctacacctgtcccattcctaccaaggcattgcatacatgcatgtcattaaacaattgggtagtaaagaagggcttattaatagatcctggcctactctgctttcccagctcctaggcctcctctgtcaaagaaaccacttttgttactatttttaattcatctgatatataatttagttcatatcgc

SEQ ID NO: 9633 - DNA, 1049 bp, Homo sapiens
ctgcaacctccgcctcccgggctcaagcgattctcctgcttcagccttcccgagtagctgggattacaggcatgtgccaccacgaccagctaattttgtatttttagtggagacagggtttctccatgtttgtcaggctggtctcgaactcctgacctcaggtgatctgccctcctcggcttcccacagtgctaggattacaggcgtgagccaccgcgcccagcccacagtacctttttttaattcttctgtggattactgaaatacagtacagtgattttagaatgattcatgggtcatcgtccagggatgctgtaaaggtgagggcaatacacatttagagtagaatttttcatctattttatatatttgagtttcacctaagtttttgtttggaggcaaggaggtattagactaccagaaaataaacaattctgtagtttgtgctgtaaactatttcctttgatgaagtaatataattttagtatttcttggagcttgcgttaattactaatggtttagaactttaaaagaagtcttattctttgtcccaaagctgtctttttttttttttttttttttttttgagataaagttttgctcttgttgcccaggctggagtgcaatggcgtgatcttggctcaccgcaacctccacctcccgggttcaagcgattctcctgcctcagcctcccgagtagctgggttacaggcatgtgccaccacacccagctaatttttgtatttttagtagagacagggtttctccatgttggtcaggctggtcttgaactcctaactttaggtgatccacccgcctcgacctcccaaagtgctgggattacaggcgtgaggcaccgtgcccggccctgttgtcttatttttaatgaggttggacagtcagtaatttgttcagtagtcatccttactgatttatattgtgtgggttgtcttggtataaactttctgttcttttttgattgtgatctcaaagcagttcccatacaatatttttgacctgcaagtattatatctttgaagtgattttcc

SEQ ID NO: 9634 - DNA, 1461 bp, Homo sapiens
caaagtgttgggattacaggcgtaagccaccacacctggccagttgtttcattttttttagtacaagttagggggaattaatttctcttctaaataaacttgaaacttgcattgaaagctttgggccttacaaaggcaatgttcccaaagctcaagtgtgttcactttgcttgaatattgatattatcctatattgaattgatatttctttattttattttatttatttatttatttttatttgttttcgagacagagtcctgctctgttgcccaggctggagtgcagtggcgcaatctaggctcactgcaacctttgcctcctgggttgaaacgattttcccaccttagcctcccgagtagctgggattacaggcacgcaccgtcatacctggccttttttttttttttttttttttttttttttttttttgtatttttatagagacggggtttcaccatcttggccaggcttgttttgaactcctgacttcaggtgatctgtcagcctcggcctcccaaagtgctgggattacaggcgtgagccaccgcgcatggcctttgaattgatatttcaaggctgaaatgtaattaagtaaatatgaagacttgtttgcatatgtgaaattttttttttaagttatcctacaagttaggagtcctaaatattaactgaaaggttcacaacttaaagtcagactgctttgtgttaaactcccttatagaggaaattgagagttatattaaaagtacaatccactcattcttttgtcttcctaggttttggcacaaataccagtgggaatagtatttttggaagtaaaccagcacctgggactcttggaactgggcttggtgcaggatttggaacaggtaagaaactgctaccatgagatctaggaagtgacacagcttgactttctagtttctggaacttgagagatctgtttgattatgttactggaattaagaagtctaccttttcgtttttccagttgcgtttataagacattcccagcagttatgctttaccaggctttaaaatattggcatgtttgtgttagaagctgtatgctcccttttctacaaaatgtcctctgatagtcctggtctttttgggatttttagtatttaatgtgagaattgtcatgaggacattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgta

SEQ ID NO: 9635 - DNA, 1020 bp, Homo sapiens
tcccaaattgctgggattccaagcgtgcaccaccacagccagctaattttttttttttttttcgtggtagtagagaagaggtttcacatgttggccaggctagtcttaaactcctttcctcaagtgatccacctgcctctgcctcccaatgtgttgggattacaggcgtgagccatcatgcccagtgctttatgacttttaaatgacttcatatgttctgcaaacagggttttctggctaatgatttcttttctctcatgagaaattaatgacatattcattaattgttttgttgatatttatttacaaaaagaataatgaaactgtgggcatagatgaagaaaagaaaagtaatggcagcagtacagaataggatctttgtttgatacctatggatttttttttttttttttttttttgagatagtgtctcgctatgtcgtctaggctggagtgcagtggtgcgatctcgacttactgcagcctctgcctcccgggtttaagcaattctcctgcttcagcctcccaagtggttgggattctgggtgtgcaccaccacacccagctaatttgtgtatttttagtagaggtggggtttctccatgttggccagactggcgttgaacttgtgaactccagtgacctgcccaccttggcctcccagagtgctgggattacagttgtgagccaccgtgcctggctgatacctgtggattttaaagggaaattataggattttgtttaaatggtgggtcatagtgaagaagacttctcacgtgtaatcagctacacgttactatcctggctaggttcatctattcaaaataaaagctactgtggaaagttttgtaagtaatttttttcttagcaaggacctttaggttcagttaaagtgtctttgttgattgttttatttttattttattttgtattttttttgaaacagagtctcactctatccatgctagagtgcagtggcacgatcttggctcactgcaacccccgtctcccgggttcaagt

SEQ ID NO: 9636 - DNA, 1025 bp, Homo sapiens
gagattacaggtgtgagccattgcacctggcctggttattcttagtgaaagtcaaaatatgccaggcatcatggtgagcacctgtagtcccagccattatggaggctgagtcaggagtatcacttaggagttcaaggctgcagtgtgctatgatcacacttgtgaattgccactgcattccagcctaggcaacatagtgaaagtaggtctctaaaaaaaataataaaataagaaaaataatagaagaaagttgaaacctttctgatttgggggattattcagtagtttattttttacggtttcaaaaattttgaatgcatgttcatagtatgtatattcattgttgaaaatctggaaaatacagaaaagattgaacaataattttcaaaaccttaacctactgggaaaaatgtaaaccagttttatggaacatgatgatattattttatttatttatttatttatttttgaggtgtagtctctgtcacccaggctggagtgcagtggcatgatctcgatcttggctcactgcaaactctgcctcccgggttcaagcgattctcctgcctcagcctcccgagtcgctgggaatacaggcacgcaccactgtgcctggctaatttttgtgtttttagtagagacaaggtttcaccatgtaggccaggctcgtcttgaactcctgagctcaaatgatctgcctgcctcggcctcccaaagtgctgggattataggcatgagccaccacacccagtcaatattttcaatatatcttataactacctaattatgttttcaaaattcagcatctgtcagatcagatatgggaagtttattctgtttgtcgagggaaatagtggttcaagtatttcttgaggattttgtgtgccagatacatcactaggcactgatagattctttttaggagttgagtacaaagacatggttatttggtgtaggtcagcagttaacagttttttaatgagcttttgaacgatcctgtactggagaaagagatcatattaaac

SEQ ID NO: 9637 - DNA, 1032 bp, Homo sapiens
aaaaattaaaaaagagccaggcgcggtggctcacgcctgtaatcccagcactctgggaggccgaggtgggtggatcacctgaggtcaggaattcgagaccaatctggccaacatggtgaaaccccgtctctcctaaaaatacaaaaaaaaaaaaaaccactagctgggtgtggtggtgggtgcctgtaataccagctacttgagatgctgaggcaagagaatcacttgaacccaggaagtggaggttgcagtgacccgagatcgcgctattgcactctagcctgggcaacaagagcaaaactctgtcttaaaaaataaaaaaggaacacaaagtccctaaaacatatggtcctgttttcatggagattgaaatttctcttttctttttttaaactttggacagataattgaggtaagaaattgagaaaattatataatgcttcaagacattctagtacttctgttgttgttgttgttgttgttgttgtttttgaaaccgagtctcgttctgttgtccaggctgtactgcagtggcatgatctcggctcactgcaacctctccctcccaggctcaagcgattctcgtgcctcagcctcccaagtagctgggattacaggcgtgtgacaccatgccaggcttttgttttgttttttgttttgttttgttttgtttttttgagacggagtctcgcctgttgcccaggctggagtacagtggcgtgcgatctcggctcactgcaacctctgcctcccgggttcaagcagttctctgcctcagcctcccgagtagctgggattacaggcgcccgccactgcgcccagctgatttttgtatttttagtagagaatggggtttcaccatggtggccaggctggtctcgaactcctgacctcgtgatccacctgccttggactccgaaagtgctgggattacagacgtgagccaccactcctggccttaatttttgtattttttagtagaggtgggattttgccacgttggctaggctggtaactcctggcctcaaggat

SEQ ID NO: 9638 - DNA, 1046 bp, Homo sapiens
agattgtgccactgtacttcagcctgggcaacagaacgaaactccgtatcaaaaaaaggaattaaggctctttaacataacactcgtacctcggtccgtgttgatttattttcgctgattatttttggttacttgattctaagttcactccccagcttgatactgattagttcttttcacctaaatcgttgaaaatgaaggacctagacatactattttgcttctcagtgttgcaaccctgacatctcttagagcacaagagttaaagtcttattatttaatagacgcctaagaccttggagttcatcatcctgggaagaacaggggcttaaatataggtttgaacttctgttcctaccattcaggagctgtggcaccttgggcaagttttaaaatgctctgagctttttgaaaaatatactccctgcttttcagggttgttttgaaggaaataatctatataagttatttagcctaatatctgtcatataagcttgaaaaaatggtaactttttttttattactctgagattcgttacggaaactattacaggatatcttttaatctatataaacttctttgcagggattatttggagtaacccaagcctcacagcctggaggtctttttgggacagctacaaacaccagcactgggacagcatttggaacaggaacaggtctctttgggcagaccaatactggatttggtgctgttggttcggtaggtttctgcagttgactgtaatttgaagatgtgtgtaaatttgttaaaaggaattttcttctaaggatttgactgttttgcaggtatttttattgggtgtattattgcaccagcctaatatgatttgattctgagaacaaaaaattatttgatataaaatgaaatttcaggttaacttcaggtttgttttcaattagtaaattctttcccttttaaaatttctttgcctcagtgcttatgtgcatcatacttctgatagcattggttaaattgttgagtctaaattgaaattcttttgctttatttgaatcagataatt

SEQ ID NO: 9639 - DNA, 1023 bp, Homo sapiens
taattcagtagtaagacaataactcatttaaaaagggccaaggatttgaattgacatttctccagagaagatatgtaagtggtgtgataatatgcttaacatcataagtcatcagggaaaggcaaatgaaaaccaaaatgagataaccactttatacctatttgaaagatacaataaaaaaagactaacaggctgggcgcggtggctcacgcctttaatcccagcactttgggaagccgaggcaggcagatcacgaggtcaggagttcgagattagcctggacaacatggtgaaaccccgtctctactaaaaatacaaaaaattagccgggcatggtggtgcccacctgtagttccagctactcagggggctgaggcaggagaatctcttgaacccgggaggcggaggttgtggtgagccgagattgtgctactgcactccagcctgggtgacagtgtgagactcaacaaaaacaacaaaaaaatacagtagtaagtattgaacctggagaagttggaaccctcatacattgctggtacagcccctttagaaaacagtttggtggttcctcaaaatgttaaacagagttacgatatgacccagcaattgcacatcttgggatttaccgaagaaaaataagacatagacttgtacacaagtgaacataacagcattattcataatgactaaaatgtagaaataacctaaagatctattaacaatgaatgggtaaccaattgtggtatatgcatacaatggaatattgttcaaccataaattggaatgaagtactaatatatgctacaacacagatgaaccttgaaaatgtgctaactgaaagaagcccgtcaccaaagaccacattttttatgactccattcacattaaatgttcagaataaaaaaaaaatccatagaaaaagatgaatggttccctagggatggggagtaatcactgatgggtctgggatttctttggggggtgtaagaatttagatagtagggatggttgcagaacatcacg

SEQ ID NO: 9640 - DNA, 1047 bp, Homo sapiens
agaagttttctttccatgtctcctcatcatgttacaataacggaagagattaaaacaacaaatacatttagacagcaatgtttatcctggttagatgttttaatctaaatctatcttggagtgttaaaatgcatttgctcacctactttaaaatataaatgaaggtaggaacctgtagatacaaaaagttggagaaaaaaagacaataaagatgacaaaaatctattaatccttgatagaaaatgagaagagataaaacactggtttacataaagaaaataagatggatagatagcagatccttataaaagtgataatttgagaaaaaaaatactccatattctgagtttcttcacataaaataatacaaatctgctgtggtaagttacaaagagatagattttttatcattatataaaagatattttaaacagagttatacaacaaaggaacagactatgtcatatattctcacttatcactataaacatctcagaaaaatctgcaaaatcatttcatagcattttaaatagttaggaataatgtagaaaactgaaacagttctaagtttcccacaaacttagagtctcaaatgttgcattacctaacttacctgcaaatattttatacaaatttgcacatgctactctagtcaaaaatatatgtacattatgggtattttctgtgtgtaacttggttctagttgcttctttcagaaatagcctctatttttgatttacctgataaaatcacattcctctccaaagccttctaaatacttccagactaactactttttagtacatctaagaagaaaagagttttgtctcttatccacctctgagtcaaaaagcagcatgtccatcaattggtacatagttcccacagccccacttagctctggattggagttctacttggcattgtttgcaactacatggacgtaaaatgcatggattctcttgaaaaaatgtttctgccatgatgttctctgaaagagactaaccttccctcgctttgcagagaaagactcgtgtaatccttgac

SEQ ID NO: 9641 - DNA, 1188 bp, Homo sapiens
cttgattgcaagacacatttttacagtgaggagagggaatgagggtgggaaaactacaataaagtaacacatccatggaaaaacgcatccaaattttgtaagcattggaactgagaaaatactatatgttgagatcaaagaaggaaattagaagcataatcataaactgttattaaatgtagagttgatctatcccagtggtttccgaggtaatcctaaagagctggactctgagaggttgctttaaggtgcatctcaaggcttatgtgaaggaagtttcttgtcttatttttccacaatcacagcagatctgatattatctagttttgcttgtgtatcaagcacttaggtaagattctacttgaacaataaagtttctccaataaatcctgttttgaaaatcatccattctttggctgttattaaaatgtgaaaagaaaaacaggtgctggtgaggttatggagaaaaaggaacacttatacactgagagtgggagtgtaaattagttcaaccattgtagaagacagtgtggcaatttctcaaagacctaaagacagaaatatcatttgacccaacaatcccattactgggtatatacaaaggaatataaatggttctattataaagacacatgcatgcatatgttcattgcatcaatatttacaatagcaaagacatggaatcaacccaaatgcccatcaatgttacactggataaaaaaacgtggtacatatacaccatggaacactatgcagccataaaaaacaatgagatcatgtcctttgcaggaacatggatggagctggaggccattatccttagcaaactaacacaggaacagaaaaccaaatactgtatgttcttacttataagtaggaactaaataatgagaacacatggacacatagaggggaacaacacatactggggcctatcagagggtagaggatgagagaagggagaggattaggaaaaataactaatgggtactaggcttaatatctggatgatgaaataatctgtacaacaaacccccatgacacaagtttacctacgtaacaaacctgcacatgcatcctagaacttaaaagcaaaagtaaaattataaaaaagaaaatcatccattcatttggaaactatttattgaggaccttctgtattttagatagtgttctaagcatttggga

SEQ ID NO: 9642 - DNA, 1031 bp, Homo sapiens
atttttctttctacagtctttagccccttaaacatattcaaatttcttttatttaaaaaaaatcaacacaatcctctttttaacataggcacttctacctgtgcattcagttttcccttcgtgtgaagctgtttgctgaagtaaagaatctctgacaaggtgatcagtcctccctgtgtttgttcactccaggcctgctgtctcattgtcctcccgcatctgtttctctcttcacatgaaactgtttgctaggatcaccaatgattacctaattgccaaatgcaatggataatctctttctcacattgctgaaattctttatgtgagcatgtctgtccactccattggattttcaattatgtctctgttcattccttttcagtttccttgcaatctctttacctcttctggtcctaagattaagggtaggtgtttcatagaatttcattatcatgttttattttaaatttacatttttcccttaagtaatttattcagttctatagtttgaattatacatgatgtgctgatgatttccaattctctatctttgagctttcacatgaaatcaaactactttctacaacattaaatgtcatatatattgtgatagtttatacacccaataagctgaacatatcaaaattggttctataatttctacctctgcaacatacatcaaatcttttcaaagcctatttttttgtcttgtgaaatttacttagtcatttaagtcagattggacagtgcagttttagaatcctaccctcttttcttctatacaagtagtctaatcgctgtctgtcatatttatacctctaagatatgcccctttccctcatcttcagagccatctcagagccatttattcactcactgatcacttctcagttggactactgaagccaacagtcacttgtccccttttagatgtcctttgcctcttttggacccttaagtttgggtgtgaaagaagaagaaagagatttagtatatttccccccaaaataaaatcatggtttttatactaa

SEQ ID NO: 9643 - DNA, 1027 bp, Homo sapiens
tgttccaccgtcttggttcccagcttctgaaagacaaaactgatgtcttctctggtcctccaaatatttttttccctaactttaaattggctcacatagttactttgtctttgcaacaccatcttctagctttctttctgagcaggtttagtgttatcctccgttttttgtggaacctaattctttttggacctaattactttctcaacctatttgttcttctgttgtgcctcttgggtgaatcttttataaaaacaatatgtaattgtagcttatggttataactgaacacttaaaatttgccagatctgaggctaaatgctttatattgataactctttgatcctcttcatcaccttatgaggtaggtatattttcctattttacgaactaggaaactaaggcttggacaattttgacctgtccaaactagtaaagggcaaagccagtgaaaccagatctttcagagtccagagcctaagatctggcttgtcagcttgaatgtgtgtaaagctggcatctggaatcttgtgggtccatatggtgtctgccatcttatttcctccagaataggtggccacgggatatttaaacatacccagaggctgacatacaaatacttttcatctggtgggggtctcttgttttggggaggaatgcgtgcgatgtgcattgtgttcaggctttgtatccttgtgcccacctcccccccaacccaggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgtgcgatgcatgcatgcatgggtgcgtccaggctccgtggtgggccaggcccgcagctggagtgaccctgggtgggctgggaacaggcccagtgggactagaaaggactgtatcagtctagagctgc

SEQ ID NO: 9644 - DNA, 1046 bp, Homo sapiens
atagaaatactactgatttttgtatattaattttgtatcctgcaacatcactgaatttgattatcagttctaatagttttcttgtggagtatttaggtttttcccaatatcagatcatatcatctgcaaatgaggataatttgacttcttcctttccaagttggatgttctttttttctttctcttgtctgattgctgtaggacttccaggactgttgaataatagtggtgcaagtggatatccttgtcatgttccagagcttagaggaaagactttcagtttttccccattcagtatgatactagctatggatctattatatatgacttttattatgttgaggtatgttctttctatccccagttttttgaaggttttatcatgaagggaggttgaactttgtcaaatgtttcttcagcatcaattgaaataatcatatggtttttgtccttcattttgttgatatgatgtatcacattgattgatttgcctcccagggaaaaattttatttggtaatgatgaatgatctttttaatgtatggctgaatttggtctgctaatattttgtggaggatttttgcgtcaatattcatcattgatattggcctatagttttcttttatgatgtatctttgtctggttttggtattggggtaatacttgcctcacagaatgagtttggaagtattccctcctcctctattttttggaatagtttgagtagaattggtattagttctttaaatgtttggtagaattcagctgtgaagatactgggtctcgtgcttttcttttctgggagactttttattatggcttcaatataattacttgtttttagtctgttcgggttttggatttctttctttctttctttcttcttctttttttttgagacagagtttcgctcttgttgcccaggctgcagtggaatggcatgatctcggctcaccgcaacctctgcctgctgggttcaagcaattctcctgtctcagcctcacaagtagctaggattacaggcatgtgccaccacgcctggctaac

SEQ ID NO: 9645 - DNA, 1058 bp, Homo sapiens
gcctcgaaacgacttagttctcacttacgtttcgcagttgctgttgctgctgctgctgccgctccatcacgccaccggcgcatgccgtacgccacttccgtttcagcttctcggtgccgccccggaagtaacctctcgctgatctcgagagctagctcgagtatcgccctgccctggctgcgacgtcagctccgcccttataatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgaggtgagaggaacatgcttgggcgacgggaagttgaacgcacaaacctgtccagagggcaagatgccccgagccccggggaaggatgaggacacacctgatgtccaggtgtatgggggtgggggcggggactcacacacctgggagacataactgactgtggaagggtcaccgatatcctgggagagagaggcttttaccagagactgggaacatacacccactgatctaactaaggcctggtggggagggcccgaggaagacgaggtgtatgagacggaggaggggagaccccctgaaggaagggggaagaaacgctaaaggaatgtgaaaggccaagcaatggagaacaaacctgaataggggggtgaagacctgagccctggaaagggttcatctcctcagcataaacacgcctgcatggagataagttctaagagagcagactttccctcttcactgttgtattttcattgtcacaaatagtgcctgacacatagtaggcactcactaaatgtctgctgaatgagtgtagaaataatcaccagagtcctggtgaggttgggggcttgtgagaagacaccgtgctttggtgtgcctgtttcaaatgtgcgttttggaggggagaaatacatatatctgaagaaaggaatgatggccaaacgctgggacactcaaaccctgggacagcctttaaagaaatgacag

SEQ ID NO: 9646 - DNA, 1106 bp, Homo sapiens
ttggttttcgtttttttttttttgtagatatggggtctcactatgttccccaggctggtctcgaactcctgggctcaagcaatcctcccgccttggcctcccaaagcgctgggattataggtgtgagtcaccatgccaggcctgtctggttaattttaattcatcctttgggtctcagcttcaaaatcacttccagtgaagctctccttcatccctcaaacagaaaaagtttgcacttctgtatgtttccattacaagatgcatttcttctttataacattcatcacagttgtgattactggtcctatattaaccttcacgtaactacgttaagtttcaagagaacacggattgaacgttctcgttcagctctgtatctgcagggcttaagctaaaattggtaaaagcagtcactcaaatatctgtggaatatgtgaatatatagatgaatgtggggcatacccagaaaaggaaaaacagaatctctattacatgtaactaagctaattcctaactaatcaaaaggggtctagactcaagacaaaaagctattaggaagcactctgttgagcccctgtgtctccgtgctggagctgcagggactccttttttaaaaattaaattaaaaaaattttttaagtgtaacaacaacaaaagctgttaggagactgctgctgtaatctgtgtaagagctgataaaattttaaggggccgggcgcagtggctcacacctgcaatcccagcactttgggaagctgaggcggttggataacctgaggtcaggagtttgagaccagcccgaccaacaaggtgaaaccccatctctactaaaaatacaaaaattagctaggtgtggtgatgggcacctgtaatcccagctgcttgggaggcatcaggcaggagactcgccgaggagaggtggaggttgcagtgagcagagattgcatcattgcacaccagcctgggcagagcgagactccatcttaaaaaaaaaaaataaagctgataaaagtttggttaaggtaataacaatgaagatggagagaaggaaaatggtttaagagatatttaagcagaactataggacttagaaattaggtggaaac

SEQ ID NO: 9647 - DNA, 1030 bp, Homo sapiens
caagctaaaagacaatagaaaaatgatagaagtcatgagaggacacatatcagaattagaaaaactcagaaattatgtgacagaactatggaaagaattataaatgaaagaaaaaacaatttcataatggaaatttaactaaaatgggacataagagcaaacaaactcgacagataatttctcaagaaaaatagaaggcaaaataagggtaattatacaactaaaaaggaaataaacaattttaaagatttcaagagaaagggaaaaatattggggatgggtgataaggatctaatgtatcagtaacaagattcccccaagaaaaaaacaaagcaagggaagagaacaaatattaaaaaccgtaattcagaaaaattgttctgaaatttaaaaaaagatataaagccacattttgaaagaacatacctgacaatccttccccagaatgttcaataccaacacatattctaacaaaaataactagatttcaataaaaaagaaaaaaaatctaggcaaaaagaacaagtgattttgtaaagcaaataaaattagactatcgaaggctttttgatagcaactcataatgtcctaagaaaacatagtaacatatttaagatacacaaaggaaaaaagtataaaccaacaactttatatccagcaacactaactttcaaaaggtacaaattgttatcaacatagaagaacttcagaattttgtccctacaagcccttcctgaggaatttagtaaaaagtgaccttcagacaaacaaaattactagaaagacatcaacacaagggctgctagtgggcttaaagatattgttacttacagaactaagattaagtgagggatagaagggaaagagtatagtatgaaatgacgatgtagagaatgctggtgattatcttgcttgccaggtggacagagcctacctgaagaatggaactctgaaggtacattggttgattactcaatagctattcccttctcccttcctctattgttgtagaaccatctcccatgagaca

SEQ ID NO: 9648 - DNA, 1026 bp, Homo sapiens
cagtttactttcttgagtgggacaaaaagtgatagagtcacacccaaatgctgggcctcatgcatcttacacatgtgcacatcatccattttggagatctcagagtattaaaaagctggaatcactaggctatcaaagctctgatctgacaaaaagtaaaatgacagtaaatctaaactcttccagtctttgtctaaactcaaagatatggctagagtcccatacaatctttgacagcagttgtttcaacatcaaatattagacaaataaacaacttcatctgtaagaaagagcagagatatcatctccaaacacatgaaaagataaagacaaactggggattaagagcaaatgtcctttgacagacattttgtgatatctacttgataatttccatgcattttaaaactttttatctgaaaatgagttccaatcttcaaagttgtaggaaaaagtagtaaaaaaaaattgtgtaccttctatcttccataggtatagatatatatctatactgtttatctttgccttttgttgacattttacccatttgctttatcatttgcattcacatgctctgtgcatgggcatgtgtatgcacatatacacacacacaatttttttttctgaactatttaagggcaagttacataaatactcaagtatgcatttcctaagagtagggatattcttttatataaccacagtgcaattccaaatttcatatattatattgatacaatattttaatctactgtccatatttcagttttgtcagttgacctaataatgtcctagattgcattttttgcctcaattatagcatctggtccagggtcaagcactgcatttgtcatgtctcttagtttcttttaatctggaacatttccatagcctttctttcttttgtaacagacatctttgaagtatacagtccccttttgccattttttttgttcatagaaagttcctcatgttgtgtttttatggtttttaaaaatgatactcattctcagctggactactaca

SEQ ID NO: 9649 - DNA, 1049 bp, Homo sapiens
tagggaaaataatcttatagggggatttactaggtcaagggcaatgtacaatttaaaagttttttttatatgtgttgctaaattgccttccagacttattgaacagatttaaattctcatcagcagtgtctgagattgtcatgggaaaacttttcaatgaagtaaccccaattgatctatagcactttcggttgctgagaatgtctaataaaagcaaaagaacaaatgaaacaaactatttcccaatgcagtgcttcataacctggatgcacccatttcctattccttatgttattccttacttcttccaatgtctactttctttttaatttttatgagtatgtagtacgtgaatatatttatggggtacatgagatattttattacagacatacaatgcatagtaatcacatcagggtagatggagtatccatcacaccaagcatttatccttttttctttgtattacaaacattccaatcatactcctttagttattttaaaatgtacaataaatttttgttgactgtaatcaccctgttgtgctatcaaatactagatcttatcattctaactatgaatatatttttgtacccattatcctcatttgtctgcccacctcccacactgaccaccactatctttcccatttttctactctttatctccatgagttcaattgttttaatttttagctcccgcaaatgagcgagaccatatgttacggggtctttggggtgttgtttttctgtccagaaacctttgtggccggtagcttctttgcccaagttttgctcgggcccgctgggctcatttcacccactcagcctggcaggctgtgcttggctcactctactggcctgggtcccatgcctgccaagagcaagtcaggcatggaatggcaaggagagtgtgagcaaacacagggtctggctactgcacacagttgggcatgctggctgctgcagcaaggcgagcagctccagttgccagcacaggtgccagctctctgcgagtctgcagccagaccaggtgcatggcaagcagct

SEQ ID NO: 9650 - DNA, 1121 bp, Homo sapiens
tactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccggaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaattatatatatgtataatatataatattatatatacatatgtatgtatgatgcttttcatccccaccctttcccacatctcaggaacctgtcagcaacttatccagtttaaagctgctgttcctctacctcagtggtttgggagaacatggtcattatttcactcattctttacttcctgtctcttctaggattggaatgggggagggcatattaaacgaagaaagtctcagcttacgtgattaaggtaccattggtgtgttctgtgcagacaggcatttaactgttgactcctttgtgagctcttggggttctctggagctctccatgaggactggggcactaactgactttggttgcctctttttgatgcacagcccacactgcccttcagctcttcagcccctgaccctgacaatgtacccacagcct

SEQ ID NO: 9651 - DNA, 1049 bp, Homo sapiens
cctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgctaaaaaatatacccctcttctgtcttagcatgaatatccaccctagctaggtatctaggagtcatacctaacttctagagaaaccactttccttaaaaccacatctttattttaaatagatggattgtggctgggctcctgtagcttttcctcttagaccccagaaatatatctccctttgggacttccaacagttccctacatgctttttgagcatctgctagttcccagcatcaatttaggcagaagggatacaatatccactgttcatctaatagagactagagataagaaacaacctgtaccatcaatgagctcacaataacaggccactgccactaccacagtggcctcaagggacactgcttcccctttaatgttttggtccaaataaaagtacatgaatcctaaaacatttgctaaaggctcagggataacacaaggaaagtaacagcatcaagaattttactgccgggtgcggtggct

SEQ ID NO: 9652 - DNA, 1030 bp, Homo sapiens
aagtaattttttactgagttggtaaatactttcttaaagaaaataattattctagtgtaaataaaggtaacatttttctttgctgttatggtcattaaaagcacattcttatgtaataagttaaaatactttgaaatatacccaactattgcccagtctataaaatgaccaacataaaaaatagtcatggtttgaaaaaaaattgattgttttaaaattaatagtaagtttacagtatttttcttgagacatattataaccaaatgatataaaaacaatctggatagaggttaagatgagcaactgaaaattaatcttcctacattggtggacatataagtgaatttttgatgttttattttagaaaacatccatatataatgcagtgtgtgcatttcattctcataacctttttccaatatgtattaataccatgtaaatctcttacttgccccaaccgcaaagactctttttgccataattgactgaatcaagccagatattggagtggactttgaactaagctgagccagtttaatctcttgccccacttaccaaaaaacaaaaacaaaacaaaacaaaaaaacttgtaataggaagacaagcggatggggaattgttaatgctggcagttatgttttgtttttttttttcttttgatacagcatcttgctctgttgcccaggctgaatgcagagatggagtgacacgattatagctcactgcagactcaaacttctgggctaaagcaatcctccttcctcagtctctcaaggagctaggactacagacatgagccagcatgcccagctaatttaattgtgtgtgtgtgtgtgtgtgtgtgtgtgtgtgtgtgtgtgtgtgtgtgtgtagacaggaccttgctgtgttgcacaggcttgtctcaaattcttgtctcaagtgatcttctcacctcaccctcccaaagcactgggactacaggtctaagccactgtcctcagcaagtaacagtgttcttaagatcaggaaatgctggtgctaaaattct

SEQ ID NO: 9653 - DNA, 1026 bp, Homo sapiens
tttctttatcccgtctattgttaatgggcatttaggttgattccatgtctttgctattgtgaatagtgctgaaatgaacatacacatgcttattgtctttatggtagaacagtttatattcctttgggcatatacccagtaatgggatttctgggtatggtaattctgttttaagttctttgagaaatcaccacaccgctttccacaatgactgaactaatttacattcccaccatcagcgtatttaagtattcctttttctctgctactttgtcagcatcttattattttttgaatttttaataatagccatctgactggtatgatatggtatctcactgtggttttgatttgcctttatctgatgattagtgatgttgagcattttttatatgcttgttgactgcatgtatgtcttcttttgaaaagtgtttatgtcctttgcctactttttaatggggttgttttttgcctgttaatttgtttaaattcttcatcgattctagactttggaccttcgtcagatgcatagtttgcaaatattttctcccattctgtatgttgtctgtttactctgttgatagtttcttttgctgtgcagaagctctttagtttaattaggtcccatttgtcaatttttgtttttgttgcaattgcttttggtgtcttcatcatgaaatctttgccaagtcctatgtccagaatggtatcccctaggttatcttccagggtttttacagttttaggttttcatgtaagtctttaaaccatgtcgaattgatttttgtatattgtataaggaaggggtctagtttcaatcttctgcatatggctagccagttatcctagcaccattcattgaataggagtcctttccccattgcttgtttttgtcaactttgttgaagatcagatggtggtaggtgtgaggcatttttttctgggctctatattctgttccattggtgtatgtgtctgttttcatatcagtaccctgctgttttggttactgtagctttgtagttt

SEQ ID NO: 9654 - DNA, 1026 bp, Homo sapiens
ttgccttattaattcatagctctggtaaaattcccctgtgaggcaaccaatgccccatcccatgtctgtgcacggttattctacctctgcaatttgggactcaaatctctggtcatctctgtaatttcaattcctagaaagagctcctaaactgatcattgtgttcctagtaattagaagagtaactgtgacacagaaagggttaacaaataagaattataaatgatgcttttgtgtaaactttatttattcaagtgcaatacacatgttgttatcccaatttttgtttttaagctaaatgcttaacaatctgatacactagaaaattataagattcatgattttaatggacatatttagaataacttaactagttaaatttatagtcaccatttaaatgcttaggaaaatctattatactacatttataaagcttatttttaagatattgaaatgcttaacatcatttcacctaaatgtataagattttatttgttagcattataagagttacatgattgagaacaattttgtttaacacctgcattagatgtttggagtgtttaatataatcacattttaaatttgtgattttagcttgaaatattcacagaaatgtagttaatcaattgcttaaacaatgcttaaaaatttaggagaattttactcactagatttatatcttttttctcatttaaaaatatttaagagaatttgattaaacgtaaaattggtgtttaaaagtttaggaaaatttaatctgtcaaattaataagctaatgagaatttagcaaagaacaagtgaaaaaagtgtttttatttcaaaacagaattattagatctataatcattataacagttaacattatgtagaatttggtatgtactattataagaatattagatatattattaatccttaccacaatcctctgaggcaggtacttttattcctgttctacagatgagaaaatcaaggtacagacaagttagtgactgcttcgtcaagtgtgttagtttcttagg

SEQ ID NO: 9655 - DNA, 1045 bp, Homo sapiens
tccatattgtcaactttattgttagtataaagttgttcataatatagtctaattatccatttaatatacgtaagatctgtagggtgcaccctcttctattcttgatcctggtaatttgtttcttttcctgatcaagctgcccagaggtttatcatccttgttgatcttttcagagaactgtaatttggtttctttttgtttgtttgtttcttatttcattgacttgtgtttctttctttctggtacttttggtttaatttgcctttctctagtttctcaaggtggaagcttagacccatgatctatatttttggccattattttattaatgatctgtgtctttttgtctctcttttatttccttctggctctccagttgcatatatgtttgatattgccccacaggtcatgtgagttctgttcacttttttttttcttaccatgcttagttttgaatagtttttcttgctatgtcttcaggtttattgatgtcttcttctactgtatctaacccactgttaatcttattcagtgttttttaatttcagacattatcatctctagaagtttcatttgggtcttttttatgtctcatttattcatattttactctcttaaacgtatgattcatatctgtaatagctttcttgactgttttaattgctaatttcatcatccatgccatttctgggaatgtttctgttgactaatttttctcctggtaatgggtcctaatttcccttttttttttttttttttttttgcatacctggtaggttttgattggatgatggatattacaaattttgcattgttaggtgctggattttgttttagtactttaaatagtgttggatttattaggttagcatttaggttagtagaaaatagttgaatcctttaaagctttaacattttttagtttgggtccagaacagcctttattctagggctaattatttagttatatgcttataccataatttgtccattcaccagttgaggaacatttgggttgttcctagctttgcactcttatgactca

SEQ ID NO: 9656 - DNA, 1050 bp, Homo sapiens
cagttcactttttaatatattagcaaattaatatttcacgtttggaatgacttctcattttcagacttcaaaatattggtagcagagagcaaaatggaggcagagaaatcatatcattgccaaaatcagtttttagatctagggaaagagtttaacacttctgactgttgaaacatggccatcagatacttattatacaactagaatattctgtgttctctagggaaattaaatttatacaacatggctctttcctcaagaatttatagactagaatgtatgtcaggaaaaataacctatgaaaaatttaccacccgcaagtaagagacttggcaaaagcattgcaggaaatcatgtttatctgggctgtaactgctttttggatttacttctggattttctatggaactaaatatcccagtcacactttgcatcctttttggaaatcttaaatattcacagaatcctttaataaaactgcggtgttcttcaatgagatagtaatgggaagttagacagtacaatagctttttaaaaatttgtggtctctttaacaggtttagggagttgtctctgatggttcttagattgttgcttattttttagccagttttgagcttgctcaactgcaagaaaaactgaaggagacagaagcagccatggaaaaattaatcaacagagtgggacctaatggtgagaggtaggttttcatgtaacgggactcagactatttctcatttagaaaataaattcaggctgggtgcagtggccgaggcctctaatcccagcactttgggaggccgaggtgggtggatcatctgaggtcaggagtttgagaccatcctgaccaacatgatgaaaccctgtctctactaaaaatacaaaattagccaggtgtggtggtgcacacctgcaatcccagctactcgggaggctgaggcaggagaatcgcttgaacctgggaggcggaggttgcagtgagccaagattgtgcccttgcactccagcctgggcaatgagagcgaaattctatctcaaaaaaagaaaagg

SEQ ID NO: 9657 - DNA, 1023 bp, Homo sapiens
attgtgaggactcaaacatgatcaggctctttctgacatcactgttgagagcagggggaaagaggtcaaggatggaagtggaaggggtctggattcaaacccccgcttggccacctactggctgtgtaaccttggactattacttaagttctcaggatctgtttttcaaatgtaacccagggattgataagagtgtcaacttcataggattgtggctaggttcaaaatagtgcattcacctacaagagtcatacacttgccgcaagtgcctggcttgtggcaagcactacatgagtgttagtcactactgtttttaaaaaaggagagacaggtcagacctcctggtccaaagctcattgaggctggcgttgggaggaggggatacagagggcggccctgaggccgggagagtggcttttgcagtaacccaggagagagatgaaggtgactggactgaggggtcggggtaagaggcaggggtggggagaactgggaggatttgagagaaatgtgtgaggtgaatatggttaacagtcagatgggggaggttgagggagaggtggagaaatgagatcaggccctccttgcgaggaacacgggttccagcagctgccttctcatcatcactctcccttctgccctcagggtgttcttctcaggcaggtccttccttcccctgcccggaggaccctctacaggttcaagtccacactcctctgttcgggagtcaaggcctctctcactctgaccctggccagcttcatctcttgctgttctctctctctctctctctttttttgagacaaggtctcactctgtcgctcaggctgaagtgcagtggcgcgatcttggctcactgctacctctgcctcccgggttcaagtgattctcccacctcagcctctcgagtagctgggattacaggcaccctccaccacgcctggctaccttttgtatttttagtagagatggggtgtttaacatgttggccaggctggtcttgaaatcctgatctcaaatgat

SEQ ID NO: 9658 - DNA, 1079 bp, Homo sapiens
cccccatctctattttctaaaattaaaaaaaaaagagattaaagctggcaattaattaagcttctggatccagtcttgcctgaagtcatatcacatggactgttcacttatgtaaatcttttttaactttttttttttttggtctaagctagtttgaaatcttgactaagacaaggctgaattgatctacagttgatgttcacactgatggcaattctcatctcccttgtcttattggaaaataagtcaaatcattttaaaattcatttcaactctcaactcctttaagaagtctctttttcaacaacatgattgtgatgtgatacccctactccacagcttaattcctactgtggcaattaccatttctgcaaccaaatatgatcattttgatgggaggactcctgtctaattcaactctatattctctgtacccagcacatgaccagacaccaggcagaggatagaaaatacgattccattaacataaagatgaaaaacagtcaaaactcatcaacactgtttaggaacacatacacaagtggtaaaacagtaagaacaaagcacaaaaatgagtaccctaaagatagggcgagggatgattagattctcatagaagtttgcaacctagatccctcacatgcacagtccacaatagggttcgagatcccgtgagactctaatgccgcgctgatctgacaggaggcagagctcactggcagtaatgctcactggcccaccgctcacctcctgccgtgcggcctggttcctaacagaccacagactggtactggaccatggcctaggggttggggacctctgccctaagagtcagagtggtggatacctcttcctagggaacaggaagagaatacagctggaaaggggtatacataaggtttctgagatcctggaaatgtactgagttttgttgttgttgttgttgagacagtgcctcgctctgtcacccaggctggaggtgcggtggcatgatctcggctcactgcaagctccacctcctgggttcacgccattctcctgcctcagcctcccgagtagctgggactacaggcacccgc

SEQ ID NO: 9659 - DNA, 1040 bp, Homo sapiens
cccacagagatccatccacccctgaaatctgcaataaatagcaatgatagagctttctcttgtttactccatcatggccacggcaaaggagaagccagaacaaacggtgggacagccacgaaagggcctgccttgttttgcaccccacgtgcctcatctgtcatcctgcacagataaaaaggccctttgccacctagtacccaggcatgaggatatttgggatgggaacctgtctctgccggcagggactccatgtggttaagactgggacatacatagctgtctctgatcttatttcaagatgttttttcctttagccattggtcaaaagttaatccttgaccccattctagatgggggcacctccatctgtgtgatgttgctgattgggtggtggtatttgtcacgggcatccatacgggtgatctccaaactgtcttgcttattgtgcatgtgattgctaaagtcttcggggcacatgcaccctgcattagagaacactgatccagtcaggaaccattacataattttctgagactggtgcaaaatgaaaatgtggccccaggcccagatttgggaagtcagcctccccttttcagaggcccgtcaccacaacccacagctggtatgtgacccccagggattacgacctccatgtcagagcttgctcagtacctgattctgggatgagggagaggcccccatggagctgactgtggaacacaccttagtttctcagaccagggtggatggctgccaccttgccccaccctagaagctgtgggcacacacctggtcttccctgcttctttgcacggaacactgccagggtggaaggtgaccgtggaatgggagcctttccttgccactctgacggaccctgcctggtgtggagggcggtggcaggcacagccctaggacaaggaggctgaggaggctggggcactaggtgggaggaattaagccactgagaagtcctcccttccagggaggtagtgggaagtaggactgtgctccaagcccgggcacagcctccatgt

SEQ ID NO: 9660 - DNA, 1081 bp, Homo sapiens
atggtgaaaccctgcttctactaaaaatacaaaaattagctgggtgtggtggtgtgtacctgcaatcccaactactcgggaggctgaggtaggagaatcacttgaacccgggaggcggaggttgcagtgagcctagattgtgtcattgcagtccagcttgggcgataagagcaaaactccacctcaaaaaatatatatatatttgcataaagaaaggtaagtagatttgaattgatgttaccagggagtgaaggagcaaatactgtgatttgtttcggggtagccagcgttaggctgattttggagctcaattaaaatatggatgactgtattagttttaacatgtattaaaaccaagttgaaaaataagaaaacaggcactcttgtatgctactggtaagattatacatcagtacaactgcagtggaaggcaacatgatgatatctttcaaaattacaaatccatataccatttatccgaagaatttctcttctaaaatatatatcctgtagaaaaacttacgaacgtgcaaaatgtcatgtgcaaaatgtgcttgcaaaagattggaaacaaacctgagtgttcattgtgaagagactggttaaataaattatggtacttctaaacaagagaatattgcatagccagaaaaaagaatgaggattttttctttctatgaattgacatggaatgatcttcaagataatcattagttgaaaaaagtcaaggtgtaaaagagtgtttatagttggctactatttgtataaaaagcaggaagaaagcatgtcagtagatgaatgtatttgtctgttctcatactgctaataaagacatactgggtaatttataaagaaaaagaggtttaatggactcacagttccacatggctggggaagcctcacaatcatggtggaaggcaaaggaggagcaaagatacgccttaggtggcagcaggcaagagaatgtgtgcaggggaactgccctttataaaaccatcagatttcgtgagacttattcattgtcatgagaacagcacaggaaaaacctgcccctgtgattcaattacctcccactgggtcc

SEQ ID NO: 9661 - DNA, 1047 bp, Homo sapiens
gtgaattaaagaggttgctggatgcaagatctatatataaaaattgtattgttatatattcgcagtgaacaattgggaaataaaattttaaaatactaattgccacaaaacataaaacacttagtgaaaaatctaacaaaatatatgcaaaatatttataccaaaaccatgaaatgctgttgagcaaaattgaaaaagactgaaatagttggagagatataccatgtttatggtttagaatatttggtactattaagatgtcagttctccccaaattaacttacatgtttaaaccaatcccagttgaaatctagaacacttgcttttttgttataaattgacaagatgattctaaaatttatttggagatacataaaacctggaacagacaaaataacctaaaaagaacaaagttgcaagacttatatgacttgatgtcaacatttactacatagatacagtaattaatacaatgtggtattgatgtaaggataaacaaatagattagtagaacaaaattgggagtctagaaatagacccatgtttatacagtcagttgatttttttttttttttttttttttttttgagacggagtctcgctctgtcacccagcctggagtgcggtggcgcgatctcggctcactgcaagctccgcctcccaggttcccgccattctcctgcctcagcctgcggagtagctgggactacaggcacccgccaccatgcccggctaatttttttgtatttttagtagagatggggtttcaccatgttagccaggatggtctcgatctcctgacctcgtgatccgcccacctcggcctcccaaagtgctgggattacaggcgtgagccaccgcgcccggcccagtcagttgatttttgacagagatttcaaagcaattcgaaggggtaaatgatagtctttttaataaataatgctagaacaatagtagatatatatgagggaagatgaaatttgaccccctagctaaaactgtacacaaaaattagtttgagaagggtagaactaaatctaaaagcga

SEQ ID NO: 9662 - DNA, 1053 bp, Homo sapiens
accacacctggctaatttttgtatttttagtagagacaggtttttgccgtgttggccgggctgatctaaaactcctgacttcaagtgatctgcctgccttggcctcccagtgttgagattacagacgtgagccaccatgcccagccctctttgcatttttttatccagtttcatcgccatcaaacagtttttcatggagtactgattagatatattttgtaaagaaagcagcagtttcctatttttctaaatgtgagttttaacagctttattgaagtttaatttaaataccataaaagatatttgtgcatcctttacaatgtaggatatatttttgttttacaataaaaatacaatgatttttcatacatccacagagttgtgcaaccatcaccacaatccagtttcaaaacaaatctactccaaaaagttccctcagctcgtttatactcaatcttattcctatcccagtcccaggtagccactaatctctctagatttgccttcttgtctctctaaatgtgcctctttttttttcttttctgcacatttcatataaatggaatcataaaacatgtagtcttttacatttggcttgctttcacttagaataatgcttttgaggtacgttcatgttgtagcatgtatctgtagtctgctcttctatattgttgaatagttgtccattgcgtggatataccacattttgtttatctacttacccctgatgcacatgtggatttttaccagtttatggctattatgaataatgctgctatgaatattcatgtacaggtctttgtgagggtatgtggtttcatttagaagtatttttagaattagttactaagagtgaaattgttggatcatatgttaagtttatgtttaattttttatgaaattgccaaactcttttacaaaatgatcgttaccttcccaccagcaatttgtgagggttccagtttctccatatcttcgacaactcttgatattacctatcttttaaattatacagttctagtccttaggactagtatcttaggaagtggtgtc

SEQ ID NO: 9663 - DNA, 1046 bp, Homo sapiens
ggtctgacaccctctgcctcataaatacacacaagcatgtagactttctattgaagctatcttaagtattaatagaaattgccacctgattggttgtgccatggtactgatcatccagtctgactatgctatggtttcttgtgagtctaagtgttctccaggtctacacagttgtttctaataattataacacagttataacttatataactttgaccaacttatatatttaaaattgaccaatttatatttcaagtactgctaatccaacctttccttccaaatagttcacttatcattttatgtaccagtgaactgtacagtcctgtcaatggaaaaaatatggtccagttcaaaagcttatttatgtgttagattttgcagttacttttgaaattctaaaactgcctgagattcagtgaatctgaattgcgctataggaagaaaggatgttaaccttcgcttcctgttttcatacttactgattgaacacagaattgcactaacagtgcttataagaacaaaatcagacttcaagatcttaaaaacaacaaaaatctagcagcataggttataaaggagacataaagggtaccctgtgtttgaatagaaatatgtatgaaaaagacttgctttttagttgactgtgaatcttttttgactcaatagatgacttggctgttggaatacctaaagtgatcttaatatggccccacatgaacagcaaatatggaagaggcatttcagctatgacttcttaccactcacacccaattagtcactaagtcccactgtttctttcttgttggtatttttaaatcttttcatttccctccttcttgtctcgattctatgcctcacatctaccctctagaaacaaaagtcagcatactacagtttgagagccacattgggcctgctacctgtttttttttttttttaatggcccataagctaagtttctgcatttccaaatggttgcaaaaatgtaaaagagtaatatttcatgtcatgtaaaaattctataaacctgaaattttcaagtc

SEQ ID NO: 9664 - DNA, 1022 bp, Homo sapiens
gggccaccattctccagaccctagaatagtagatccaccgacagcttgcaccatgcacctggaaaggccacagacacttaatgtcagcctgtgaaagcagccaggagggaggctgtaccttgcaaagctacagggacagagctgcccaagactatgggaacctacctcttgcatcagcgtgacctggatgtgagacatggagtcaaaggaggtcattttggagctttaagatttgactgccccactggattttggacttgcattgggcctgtagcctttttgttttggccaatttctcccatttgtaatggctatatttacccaatgcctatacccccattgtatctaggaagtaactaacttgcttttgattttacgggctcataggcagaagggacttaccttgtctcagatgtggacttttgagttaatgctgaaatgagttgagactttgggggactgttgggaaggcatgattggttttgaaatgtgaacatatgtgatttgggaagggccagagttggaatgatatggtttggctctatgtccccacccaaatttcaccttgtagctcccataattcccatgtgtcatgggagggaaccactgggagatgattgaatcagaagggtgggtcttttccatgttgttctaatgatagtgaatgggtctcacgagatctgatggttttaaaaacaggagtttctgtgtacaagccctctctttgcctgcttccatccatgtaagatgtgacatgctcctccttgccttctgacatgattgtgaagcttccccagtcatgtggaactgtaaatccaataaacctctttcttttgtaaattgcccagtctcagatatgtctttatcagcagcgtgaaaacggactaatacacatggtgaatgtgaaagtgatcacacatacagagagagagagagtggcattttgagagtggcatttctatggaaggctttgactagctgacccaaccagggcattacctagtggcattagttcagctgct

SEQ ID NO: 9665 - DNA, 1046 bp, Homo sapiens
ggacttctctacacctcagagagaaagcactatttttcccaaacagaaagcctatcatttgcagatctactccactgctctgagtcattgatggttatgggttttatatttaacctgaaatgcaaaacattttcttctaggcctgaagttaaatcattttggaaagtgatacaggtacattctgaattttctttgtcttgctacatattcttgaaaaaccaggttaagtgtttataagagatgtgtatgtgtgtgtgtgtgtgtgtgtgtgtgtgtgtgtgtgtattttgagtggcatcagttgcattcttttcttcctctgcctgtctggagggcacttttaatgtacctgtcctcatactctccattatgagttttaatcacaatagaaatttttttcccaccactttgatgaaaggtcatatttattgggcagacttatctattctatttaataatcttataatatactatatacattacctggggtaaatgtaagtacagcatttaggattttaaaatctatttacaaatgagactgacctgtaaatcccccttttggggaatactactatggtcagattttggttattttaagtgaataaaatgaaccggatggctttgcatgctctgaaaccatttatataagaatcatctgttcaataaaagtaggagaggactctgctatgaaacttcctgagtgaaatgataagtggcatgaagaaaaacaaagcaaggtaaggggggagagggcatgggcttgttgttttagatgaggtggttaggaaagcctttcaaatgagcagaagccacagtgaagcatgggagcagaccgtgtgaatgtttgagggaagagcatcccaggcagaggaagcagaagggcaaagccttgagaagggagtatacttggcatattagaggagcagcaagaggctactgtatctgagagaaaggagatatgaaagctgagaggtagtgaagagtacgtttatttgggaccgtataggcaaaattcaacaaaatttctttgtcatttctgtttctta

SEQ ID NO: 9666 - DNA, 1045 bp, Homo sapiens
tttttaataagacaaatttatgtctacatgacttttgttatctggttaaaaagtgtgctttgaaacaacgttctttgaatttgaaggcctgtgtaaaagtatataattttatcactaatacatgaaaagagaatcacttacaatttttgcagaagaggtctggaaactcatatttttagactttatattcttctgcatggactttttggaaattataaacttataacctctacttcccaaattattctggtatttgttaaatggctatgtggttggatacagtattgttcaacaaaagtagctttcagtttaattttaatcagaatcatcaatgtatttttattttaggaaataaaggaaaacaatattattttttcaaatgttacagaagacatttttaatcttcatttttaaagggacatgatgatttccttttagaagagaaaaatcccttggctccaaaagagaaatcctctctcttctcagttgcctttaaaatcttgaacctgtcagtgaaattgtataatctactaataacatgcctaaggcttattgccttttcttgggcaacagaatcaccaattgatgtgctctatcgattttaatcacactgtttttatagttccattgcaaggtttcaaaaactcaccaaataaatctgtggatacagatgcctcctttctctgaaaacctaatcatatatatactattccttctcaatcagttgttaaggtataatatagtcaaataatttttatttgatagactttggtcttggctaaattaaaatgttctctttgctattcagcatttacatatttaaattatacaattcttataaatgtggtatctgagtgccttgtagcattcagaatttagcatgacaagttgctcgtaggctattccatcaagacattcccactacagctcagctgcaaacatctagagcaagctcccgtagggttgtattttaagctagctgtgagctaattatatggcaatttgtatcttagaatccatgtagaacaatatttggagcattagg

SEQ ID NO: 9667 - DNA, 1137 bp, Homo sapiens
ccctcattaactatatgatttgcaaatattttctccaagtctgtgggttatttttcactttctggatagtgtcctttaaagcacaaatgtttcttattttaaagtccatgtatctatttttcctttggttgctcatgctttaggtgtcatatctaagaaactgttgcctaatctaacatcgcaaagatttacctctatgttttcttctagaagttttatagttttagcccttacaattaggtctttgatctattttgagttaagttttgtatatggtgtgagatatgggtctacatttattcttttgtgtgtagatatccagttatcccagcaccatttgctgaaaagactgttctttgctcactgaattgtcttggtacctacccttgtcaaaattcaattagtcacttgttttttacatgtatatagtctcatttctggactctcaattctgtcctatgatctatatgtctgttgtaggccagtaccacagtgtttggattactatagttttgaagtaagctttaaaatcattaagtatgagtgctgtaactttgttctttttcaagattgtttttgctatcgtaaatcctttcattttcatatgaactttacaattatcttgtcaatttctacaaataggtagatggaatttcaatagggattacactgaattggtagatcagtttggggagtattgattcttccaatacatgaagacaaaatgtatttccatttgtttctttaattcctttcaatgaagttttatagtttcatgtgtacaagtcttgcacttattctgttaatttattctttttatactattggattgaattgtttacttcatttcattttcagattgttcattgtgaatgtgtagaactacaactgattttttatatattgatcttctataaccttgctaaactcacttattagctggtgtgtgtgtgtgtgtgtgttggggggtgtttctgtgtatgtatgtattccttaggattttttccatacaggatcatgtcactttgcaaatagagataattttttcttctgccatcataatctggatgcagtttattttactttcttgtttaattgtgctgtagtgtaggacctccagtacaatcttaaatagaa

SEQ ID NO: 9668 - DNA, 1034 bp, Homo sapiens
aagcaggccccagtgtctattgttcccttctttgtgtccatgtgtactcagtgtttagctcccacttataagtgagaacatgccgtgtttggttttctgttcctgcattagtctgcttaggataatggcctccaatccatctatgttgctacaaaagacatgatcttattcttttttatggctgtgtagtattccatggtgtatgtgtaccacattttctttatccagtctaccgtggatggacatttaggttgattccatgtctttgctattgtaaacagtgttggtgcaatgaacatatgcatacatgtgtctttatagtagaatgatttatattcctttgggtgtatacctaataatgggattgctgggtcaaatggtagttctttgagaagtcgtcaaactgctttctgcagtggttgaactaatttacatttccaccagcagtgtataagcattcccttttctctgcaacctcaccactatctgttatttttttacttttcaaaaatagccattctgactggtatgaaatggtatctcattgtggttttgatttgcatttctctaatgattagtgatgttgagtattttttcatatgcttattggctgcatgtatgtcatattttgaaaagtgttcatgtcctttgcccactttttaatggggttgtttattttttgcttgttaatttaagttccttatagattctggatatttgacccttgtcagttgcatagtttgcaagtattttctcccattctgtggattgtctgttctgttgattagtttctttttttcctctgtgcagaagctctttagtctaattaggtcccatttgtcaatttttgtttttgttgcagttgcttttggcatctttatcatgaaatctttgccagttcctatgtatagaatggtattgcctaggtgatcttccaaagcttttatgttttgggttttacatttaagtctttaatccatcttgagttgatttttgtatatggtataaggaagggatccagttttaatcttctg

SEQ ID NO: 9669 - DNA, 1050 bp, Homo sapiens
catgcacacacgtttatagcagcataattcttaattgcaaaaatatggaaccaacctaaatgcccatcagtcaaggagtggataaagaaaatgtatgtacacagcatggaatactattcagccataaagtggaatgaaataatggcccttgtagcaacttggatggatctagaggccattattctaactgaagtaactcaggaaaggaaaaccaactatcatatgttctcacttataagtgggagctaaactatgaggatgcaaaggcataagaatgatataaaggactttggggactcaaggggaaggatggatgggggtgagggataaaagactacatattaggtacagtgtactctgctagggtggtgggtgcatcacaatctcagaaatcaccactaaggaacttattcatgtaaccagaaaccacctgtacccccaaaactattgaaataaaaaatgtactattttgtaacaaatatgatggggtcattaaaacatattcatcattagattcaggatctgctggaaaacgtttaataagttatttaaaccctacccgtattttatttgggtgtattttcatggcccaagtattatgtttgaagtgctgatttcattgggaattttgaaaagaaccatttctacacatacaaagttatagaatgggagtcgactatagtcacatggaaggttttcattaaaatgtctcttcctgtagatttaccccaaaaagataggatttaatcgttgaactcttatcctttatatgagaagtgtacttaatatagatcagactatgccatttaatgtctgaacatattgtaatgagtggctttttttttttttttttttttttgagacagagttttgctcttgttgcccaggctggagtgcaatggcacgaccttggctcaccaaaacctccgcctcctgggctcaagtgattctcctgtcccagcctcctgagtagctgggattacaggtgtgtgccaccacacacagctaattttgtatttctagtagagacggggttcctctatgttggtc

SEQ ID NO: 9670 - DNA, 1455 bp, Homo sapiens
cttccagttcagctgagtttaatctgctattatgaccatcctttgagtttctaatttttgcaattgcatttttcaggtctttaatgtccttttgttcattttttgtgttttctcatttattataattttcttgtctgtatttctttgatagttagagtctctatctgataactttaatgtttggagcctcagttggtgagtttatattcctggttttattcatgtttgcttgtctagtcatgtggctgttttaaaaaaattaaattgtttgccagacattatatttgaaacattgtttgcagagataatctgaggtccaggatggtgtcatcaacattcagagaaggattatgtttgttcctgctagcgcctgtgggtataaccagtccaggatcacgtcaactcaattttagagaatgagatgatttgatgcctattgctgtaggttggaagtccttcagagttctacctcaatgtaataaggctcctgaggtactcaaccttggtggactttagactgtatttcttatccgcatgatccctggaggctatcagtaacatcccactcagtctatctgttgtttcctcaggaattggcaagcatctccaaatagaatctataaattagttttagtttaattttttacagctcagatttttttcccccatagagtggttttattcacgatggctaagtttccaggctaacccacaaaggtttaatctgttattgtgttaaaatgaaatagaaaatttgtagaaaatgtgttaataataattatagtcatttatcaaaaaatagaagttaccataaatttggaagcaacctaagtgtctgtcaacacatgaatggataaagaaaatgtgacacatatatacaatggagtactattcagccatatagaagaatgagatcctgtcatttgcaacaacatagttagaacctgaaatcattatgttaagtgaaataagccaggcacagaaagacagacttagtatgttctcacttatttctgggagctaaaatactaagacaagtaaactcatggagatagagggtagaaggatggttaccagagctggaaagcgtagtggtgtggggtggggtggggaagtgggggtggttaattggtacaaaaaatagaatgaataagaactcgtatttgatagcactgcagggtgacagtagtcaataatcatgtaattgtacatttaaaaataactaaaagagtataattgaattgtttataacacaaaggataaatgtttgaggtgatggataccccatttatcctgatgtggttattacacattgcatgcctgcatcaaaatatctcatgtatcccataaatatatacacctactatatacccccaaaaattaaaaaaaaagttaccgtgattgaagtaatgttttaaagtcttgagtacttttgatttaaaaaagcagcctcaa

SEQ ID NO: 9671 - DNA, 1029 bp, Homo sapiens
aaatattatcttgtctttatctcagaatatttgggttcaagattactgatagatatcattgacctaagggaagaaactgaggcaaaattaatatatttgggccatggttgaaaactgaagctcaggagctatagattgaagttgccctgagtatatgcttggattagcagcagttaccagtgggaaaacaagaagttagggagcagttcctaaattgtttaccaatcatttacattggttcattaaaataacataagttgtttggctatacattgttttttgtatcacaagttccaggaatatgaggataatggtgaaggacaattgtacaacttacggtaactttttagatactttatcagctagtctggaaactataggaaaggaaagaaaaaacaaaatgcctttaaacaattacttgcaggcatgggtacagggaacctgagggaagtctcatgctcctgactctctgggcttgataccttttgcataactcgcattcctcagactgctctgagccacttttctttctcaatactaacaaagctcgtgagaaatccatgtataacactacccaatgcatattatacttacatggacctgactagtagattctctccctgtaggtaaacatcatgaaaaaacacattacaactagaaggttgtgtatggaatatgaaataagaatggggataatttatataattcaaatatttaattagataatctatagttgccttttgcatctatttctatgatagcaccatagggattaccttgtcagaggaaatgtagtagtggaagtgttttggtaaatgggctgtttcctctggaaaatactcatatagtcattgctattgtggttgcttctgtgattttactgtttcttctctatgcctcatgtctatggaaacttcttcttagatataataatttttctggttatcttgctctggtctaagagccaccatctgtttactatgtattgttttgtataaataaaccctcagaaaagcacagtattttgtt

SEQ ID NO: 9672 - DNA, 1097 bp, Homo sapiens
attattaggtttttattacttattttgcactgatactacacattcttattcgatttcaggacactgtgtgatgctctccacattctcatctttgtagatgcaaagcctctcttccatcctaaggagcaggcaggacttcatacaccttttccgccccctctcgcaccagctcatctgggccaggaagaccagcatgttcatttaaaaacatccagctctgtctgttttttgggggaatatactagttttctcttgctcacgtaactaattaccacaaacttagtggcttaaaacaatatgaatgtattatcttattgttttggaggtcagaagtctgaaatcagtttcactgggccaaaatgaaggtgtcagcatgcctgtgttcttcctcggggcttttgaagaaaatgcattgccttgcctttctcagcttctagaagccacctgcgatccatggcttatggtccctttttttcatctttaacgagtctttctcatactgtatcactctgagactcctattataacatctcctactattacctttgccctttttttccctccttatagggatccttgtgattacttagggcccaccagataatcacatcaacaacagctttttgccatgtaaggaaacatattcccagggtcagagggtgagctttttggatatcttagggggagggaggcattattatgtctaccagaggggcccataaatctctcaagaccaggcttttcctaggaaccttgaattctgaatcttgtcctatggctctttgccactagacctcagtatatcttttgacttagcagagaaaaatttgtcttacactagctttctctgtgaccccataagagcagaggttctactcacactctctaggccctacctgcctctggcccaggaagtaaaagagttagtttggagttaggagaagcatcagcaattatgttttcaggctgccatgttcctagaatctttgtctctacactgtaaatattattgatgaatagatggcctcttatactaaatagttttagactgtagcagagaaaacagtttaatggttaagaacaagacggaatcagac

SEQ ID NO: 9673 - DNA, 1124 bp, Homo sapiens
aggctggagtgcaatggctcaatctcagctccccacaagctctgcctcccagattcaagtgattctctcacctcagcctcccgagtaactgggattacaggcgctcaccaccacacccagctactttttgtgtttttagtagagatgggggttttgccatgttgcccaggctggtcttgaactcctgggctcaggcaatccactcacctcagtctcctagtgtgctaggattacaggtgggagccacagtgcccagccagtttcttaattatttttaaacgtgcaatatgctattactgactatagtcaccctgctgtgcaatagatctcaaaacattcctcttgtctaccctttgaccagcagctttccattccttccctcctattcccctcagcctctggtaatcatcattctacactctacttctatgagtttgactcttttagattctacatacaagtaagatggtgtggtatttgtcttttttttttcaaatgcccaagggaggtaaacaaggctgcccagctctcagcagtcatgatgatgattctcaagggccatcttggcctccaaccctggctgaagagaaaaaagatcccctacagccctatgagagagaggtcctctgtctttctgtgcttggctcatttcagttaacataatgtcccccaggcttatccacattgttgcaaatgacaggatttccttctaaaaaaggctgaatagtattccattgtgtatatatatcacattttttatccattcatctgttgatgggcaccaaggttgtttccacatcttggctattgtgagtagtgttgcagtgaacatggcagtgcagatctccttctgacatatggattttggttcctttgggtatgtacgcagcagtgagattgctgaatcatatagtagtgatgtttttagtttttttgaggaatctccataccgttttttataatagctgtactaatttacatccctactaacagtgtacaagtattccctttctctgcatcctcactaacacttatctttcatctttttgataacagccattctaacaggtatgaggtgatatcatctcatagtatttttaatttgcatttatctgataattagt

SEQ ID NO: 9674 - DNA, 1045 bp, Homo sapiens
gactctttcagtttttattacagcaattattttctgattttatagtaattaaaagcaaacaaaaatattttaaccggtagtgactatgttgcttttgaaaatagaatttaatattctgggaataaaattatggggtagaatagtaaaacaaatcaagtaggttcaactaatgtttgttcaacaaagatttaggaagctcctactttgcatgacgtactaaactgagcttagcttgtggaacagataatacttgataaatgctaaaaatagcggttcagacatttctcctagaggttatattttcttaattaaaaccagatgaaatgaagtctgttagtgaacactgtttttattacatgattgtcatgccaccaacctagaaactagcatgaggggcaggaaaaaatgctaaggtttgtgaacttggctatgccattttgttggctttgtgctttggttgtcataatatggctgctgaaggtgttggggatatgtgagaaggtatattagtgataatgctcatgatgacaggagaagatcctgtattcctgagcaaaaactagatttgatcaaatgctgtatttaccagtgctatttatgttttgttgctttagaggcagcaattttatgaaggaggttgtagtttcatggaggcaagtggacctctacattttctagggtttggccatgtgaattataccaatctatttagaaattgtggctgttttctattagagagtctgtgattcttcaaaatcttgtgatttcattgggctcaagacattttgaggaatgggaaatgagtgcagtatccagttggcattagctttttgaatttgaatacccgcacagccagttgtgctatattaacacttgttttgaaaacgtgaatttgctgcaatgccattgatatattaggaagcgatttgagcataagtgaatttcatgtttgtgttatccatgatttttgtcagcaagaaacaccaggtgaacacagaatacagcacatagttgaaccgagcccagcaggaacacacaaaacgga

SEQ ID NO: 9675 - DNA, 1053 bp, Homo sapiens
gacaaaataatacagaattcttaacctagcagtataaagtaacaccagattcacaaggggcaaactcttctcagcagagcaggctcagcagaattgcgtaaggccagagtgcctgctttcttccataaggctttgggattaaatttattcatctctgtttttaatccatcaatgcccaaagtcatctgtctcttctatttgctatttcatagagaaggaagccatttgatgggaatttcctaaattccctacaaccaaatctatatacttacttccacctgttagcatccatcttcttcagatagctttccagctggcctgcctgctactttacactcttgattctcttacatcctgcccctaaagtcatattttacaaataaaaatctgattatgccactccgctcctgaaaaagtgtttatttgcatgcttgtaggatagagcctcagatctttaacataccttatgaggccctatagatattgctccttgtctacctcaccatctttgactgacagcaatgtagctcttttttttccccacagttcagccatactggtcccttttaatttcctcaaatctgccaggtttcttcctggctcctctttttggaatgcattcctcactttccctggccaactgattgctgtccttcaggtcactgcttgtgttactctttctgggaaatcccaatatagtcatacctcttgtaattattaagttagtgacattattttccaggtgtttttattaccaggaaattcagttctcactcttgaggactcttccttcactttgtgtattatgtaagaactgggggttccaaagggttagtctcatgtaccatgtggagggtgaacttgaaatccgaaaagtacaatatagctgttgctgataaagactgttgctattgaagaatggtcctgcacagcccaaagggactgattatttatgatgacctgcccaagatgtagaagttatattttacattcatatacctacagacttacgttcatacacttagtcattgtttctcaaagcataattttgtg

SEQ ID NO: 9676 - DNA, 1031 bp, Homo sapiens
aacttggaaggattaaatatagttggagagtctagcatggtcctgagtataaagttattaatcagttgaccaatgatgttatttatatgtaaataatgattttggcttctgtaggttaaataaagccttttaggcagccttcaaactaactgaaacaatctgacttgacttcagatttgtcacactggaaatgaatggcaacatgcggaacaggccaggacagggagggaagttacacaggagggatgggtcggcagagtttgtaagtttggatgggtaataacttaacccaggggattgttggtggaggaacgagggagtcctgtagctagagataggcagaagcagacaggatatttgggttctaggtaagcaaggtgcatctaagacctaagaagtcttcagaggcagcagagacgaacaaatgaacgtgaaggtgagagttaatgatttctaatggtacctatcccttactgtgtacttatttatgtgccaggcactgtgctaagagctttatgtacattatctctttttctccttatcataatcttgtgaggtaggttctaatcccttttcacagacaagatgactgaggctgaatgagtttcaataacttgccttcagtcgtagaacttgtaaatggcagaactgatatttgaactcggggcttatgactccggctgtgaaactctgttatcggatgcagaaggtatttctttttttgccccagttttatgctgcctgcaatgtagagatggccataggcttatatccaatgggaaattaaccccatgggtaaaccccaattacaacaaaagcagagagttacaacttccagggagatgggggttggtatttttgttaaaaatgtgaagttttttaacctttgactataaatcatggtgaaaaacctatatcctccatgtagcgctgattagatggtggcgaatccatctcctgtactttcactactttgttatttttttttcctcttttctaaaatccactaattatcttactaggtgttctct

SEQ ID NO: 9677 - DNA, 1018 bp, Homo sapiens
atttttttaatcttttattttggatagttcctattactatgcctttactgatttttttcttcggcagtatctgatctgctgttaattctatctattgcatttttcattttaggtattgtatttttcatctgtagaggttccatttgggtcatttaaaatatatctttcaggcaccaggcatggtgactcacgcctgtaatcacagtgacttcagaggctgaggttggaggattgcttgaggccaggagttcgagaccagcctggggaacgcagtgagaccctatttctaaaaaaataaaataaaataaataaaaaatctttcatttttctcatcatgtttatgtatttctctaccctgttagacatgtagaacatatttatatgattcttgtctgctagttgtatcatttctggggcatattttcgcagattttatatgcccattaacttttaactggttgcaagacattatggatttaggtgacttctttaaatagtgttcgctttgttctggcatgcagttaagttgcttgaaatcagatgaagccttttgagacttgcttttaagcttaagtagggcaggtctggagcagtctttagtctagggataatttatctctgttgtcaagatgaaacccttctgaaaattctacttgctgccctgtgtattaagatatctttcctctctgtctggcaggaataggaattgttcccaaatcctgtatgagatctgggcgttgttctgtctttttcttgcaaggctgttttccttcctctcccacccccaacacgagccttggatagtttttttaaaattaatttttaattttaaaattaattaattaattaatttattttttaaaattaaaatttaattttaatttaaattttttaaaattaaaatttaattttaatttaaattttttaaaattaaaatttaattttaatttaaattttttaaaattaaaatttaattttaatttaaatttttttaaaattttttttttattgtggtaaa

SEQ ID NO: 9678 - DNA, 1031 bp, Homo sapiens
gatttggtattgtgaaaccgaaagtcatcatgctggaagaattccctggtgactctctcactcaggcttagcctcgaccttccagactcaagtgatcctcctgcttcagcctcctgagtagctaggaccacaggcatgcaccaccatgcctggctattttttttatatatatgggggtctcactatgttgcccaggctgataagttatctcatatgcagaaatatacatttccaaacatatatacagaaatattatgagatgtgaataggaaaattgtacaacactgtgtatatcggtttctaagaaaatgggctgagttaaggctttctgtgtgagggggattgggttaaggtttggctcaaggtgaggaatgtgagttgatgggaaggaaggaaaaggcatcccaggaggaatttagagggagggatgaatgaagaggcagatacctttgcttggctgagaagtctgagcttccaagtggagggaaatgtcagggataataggctgagggggagatagggtagatggtggtgattataatgtcttttttttaccagaccaacttgcttccagattgcttacacctggggagacaataccaccatgaagatgacagataacccacgatgaagtgctaagttgtttgctatggtagtagctggaattcagaggggagagacttatggctaccagatccaagataggttctgtgaacaacgttttctttttttacaatttgcagtttttaatttctgtgggtacatggtaggtatgtatatttataggatacatgagatactttgatataggcaagcaatgcatagtaatcacatcatggaaaatggggtatctgtgcccttaaacatttatcctttgtgttacaaataatccatttatactctttaagttatttaaaaatgtacaattaaattatttgactatagtcatcctgttgtgctatcaaatactaggtcttattcatttgttctatttctttgtacccattaaccatccccctcccccttccccc

SEQ ID NO: 9679 - DNA, 1067 bp, Homo sapiens
ggacaggctagcatgccattttacagagaccctgttatgccaggttgggttgggatttgaagtcaggtgtttttttttttttttttttccgagataggatctggctctcttgaccaggctagagtggagtggcacgatcttggctcactgtagcctttgccacctgggctcaagccatcctcccatctcagcctcctgagtagctgggagcacaagcatgcactgccacacctggctaaattttttgttttttgagatggagttttgctcttgttgcccaggctggagtacagtggcgcaatcttggttcactgcaaactccacctcccaggttcaagcgattctcctgtctcagcctcccaagtagctgggatgataggtgtgtgccaccacacctggctaattttgtatttttagtaggacgaggttttaccatgttggtcaggctggtctcgaactcctgacctcaagtgatctgcccgccttggcctcccaaagtgctgggattacaggtgtgagccactgcacctggtgctaatttttaatttttgtattttttgtagagacagggtttttgccatgttgctgaggctggtcttgaactcctgggctcaagcaatctgcctgcctcagcctcccaaagtgcttggaatacaggcgtgagccaccaagccctgcctgaggtccattttgttggataagacagaaacacaatttgtagttaattaacatctgtcttggacttgctcttcttctaacgctagcttaaaaaaatcatttttggctgggcgcggtggctcatgcctgtaatcccagcactttgggaggctgaggcgggtggatcacctgaagtcaggagttcgagaccagcctggccaacatggggaaactgcatctctactaaaaatacaaaaattagccgggtgtagtagtgggcgcctgtagtcccagctactcaggaggttgaggcaggagaattgcttgaacctgggaggcagaggttgtagtgagccgagattgcgccactgcactccagcctgggtgacagagtgagactccgtctcaaa

SEQ ID NO: 9680 - DNA, 1050 bp, Homo sapiens
cttattcccataatggcccagttttgaagtcagccaagtccttttgtccttgacaacatcatgcagtggaaatacggtgagttctagattcttatgggacagcatgcagccctagaggaaaaattgacttcttgggtatgctgagaaataagacagtaaaatggcttcagttgatgcaaggggattttagttaaaaattggttcaggatttttaaattttattttattttttggctgggcgcggtggctcacgcctgtaatcccagcactttgggaggctgaggtgggtggatcacctaaggacagcagttcgagaccagcctggccaacatagtgaaaccctgtctctactaaaaatacaaatatcagccaggtgtgatggcacatgcctgtaatcccagctacttgggaggctgaggcaggagaattgcttgaatccgggaggtggaggttgcagtgagctgagatcatgccattgcattccagcctgggcaacagaacgagactccgtctcaaaaaaaaaaaaattggttcaggatgaacttgcagagcactcttccacagaacatggttaggttagccctgcctgacttctagcaattgctaactatacaccttgcctgcctctaggacccctacctgagtggcaaccataccttccatatgctctgttccatggcagtccctgccatcccccaccagcggactctggctccctccctgtacccatttctagcaacagctccttgcctggctgctaagacggaggcgcctccttgtttgttcctgggctctgttctgctccctctctcactccatggagtcacttatagtcttcctttctgaacgccagaattgagcctttgctccttctggatcaccccttcctgggcttcttctccatccctcagtactgctaaaattgccctgctcctttagtccatttccatgacctcagccctctctctcctctccttgtcttttaactttctcctggacttcttcctctccccagcatgaacccagagcctatcacacactgatgttttt

SEQ ID NO: 9681 - DNA, 1031 bp, Homo sapiens
gaactgtcttagtgacacctgttctgcttccctcactgtggccatggctgatctaggcatggccaggacttactctttttgtaacactccccatgcaaagagtcctgggggtctgcattatacctagggggaaacagaactcagcccaggagggctagccttgacaaaatgttatagggaaaagagcatgtctgactttggagtccgatagatggaatttggtaaaccagttctctctccctgtgatcccgggtaagatacctaacctccctcaactgatttctttctctctaaatggggccaatcgcacctacttcttaggctactgggaccagtaactatagtgaaatcatttgataacttcctctgagtagtaaggattttcctggtacctgacactaatgtggatttgtgttgtgcctcatagtgaaggcaatttggaccattggagattggttctgattcgcttctcagcttcccatgccccttctccaaccaggctaggctaagtttgttcttctgtggaaggtgagggctagttgggaagtcaggaagcgacttcctgatgatcatttgggacttttttcgttcaatgtatgatgcgtgtttaatttgtaatgattagtctgtttcctatatgtgtaataaatgaaaacgaaagaaataatttttctccttttttttcacactgactgaaaggccaactgaaaaatcgttggttcttattacacacaataatgtaactctgcattttatgcagttaaactttttagaccctgcttgcgcatgtacagtgcctaggaccttgcctggtgctgaatggatgctagtttcatccttttgccccatcactgcctcctgcccatctccatagactgcatactcaggggagaactccctgggagcctcttttccatggagtgtgagctggattctcaagcactgctggaatcccagcacttggctgacatggcagaggctggacaaaaagactcctcagaggaggcaacactggtgtactgagaacaagt

SEQ ID NO: 9682 - DNA, 1052 bp, Homo sapiens
caggtctttgatctcatttaaggtttttaatgtgaatgaattatgcatgtgtcaaggctgtgtttgactctaaaaggagaacattaaattcatattaatggtctgggtgctttggtggctcatgcctgtaatcccagcactttgagaggccaaggcaggtggatcacctgaggtcaggagaagaccagcctggttaacatggcgaaaccctgtctctactaaaaatacaaaaaaaaagttgccgggtgtgttggcaggtaccagtggtggcagacaccagctactcgggaggctcaggcaggagaaccacttgaacccaggaagtggaggttgcagtgagctgagatcgcgccactgcactccagcctgggcgacaaagtgagactccatctctgtctatatgtatgacaattacctgaatcatagtatttgttgccaagttattctaattgcaatgaagaataaaaacaaaagctttggtgtcagtatatttggccatctgagtgtcattcctgatctgcctgccattactagctgtgtaatttaggcaagttacttcatctctctgcccaagaggttttttttgcctgtaaaatggggttaatggtggtagttactaactcataggactgttgtgaagatgaaatgaggacatatacataaagccttctgtactatgcctcgtttatagaaagaaggtaagaaaggtaaaaaaacaaaaagtgctgttatttagaacttgagaacatgtgaaataggggaaaaaagcctgttagatggaaacatgcttaatttggaaccagagagtcaatttctcatataatatgtataatatgtggcatcttatattcttttttttttttttttttttttttttttctgaggcggagttttgctcttgttgcccaggctggattgcaatggcgcgatcttggctcactggaacctctgcctcccgggttcaagcgattctcctctctcagcctcccgagtagctagaattacaggtgcccaccaccatgcccagctaatttttttgtatttttagtaga

SEQ ID NO: 9683 - DNA, 1067 bp, Homo sapiens
ggttggtggcagtcttcatttaaggcagatggttatcttgttttttgctatttcatcagctcattcgagggctttttcatctcatcacaatttttctgtctaacctcagggttagtacttcttctgtcctctaatactatccatttagtataacaacctttttggaacaacatggtagagttgtctgaaggaagctagagatgtccacttggggcagctctgaactgagaagcagcctcctcacctagtgcagcttgggaatgtgcatggggaggcagggtggcagcagcaaaccccggcaagatgtcactaatgatcgccttgatgagccagcccgaattctagtaagatgctcctgcaaattatcatcccagatgttttctttctccttttttggcatctgtgctccatggttcccttcatgtaggcctctccttcccttcctccaatgactgttctcttccctgtgcctgtttcttttacccaggcctttttgagcagcgagtggagcagtacttagaagaactcccagacactgagcagagtggaatgaataagtttctccgaggtttgggtaagtggccttgttactgatgagatagatgttcagcaagaaggaaggggctgggagatttgtgttcccgaatactctaaatcaatgtcaacaggtgttatactggggctgtagacagaacaggatgtagacatcccatagtgactagaaggttctcagccagaattccaagggcattttgcacagtagtggtccttcaatatctgtgggggattggttcctggatacccaaggataccaaaatccacagatgctcaagtcccttctataaaatggcatagtatttgcatataacctgtgcacatcttcccatatactttagatcatctttagattacttataatacctaatataatataaattttgttattttattttatattttatttattttattttagaggcaaggtctggctctgtcactcaggctggagtgcagtggtgcaatcctagctcaccgcagcctcaaacttctggcctcacgtgatcctc

SEQ ID NO: 9684 - DNA, 1059 bp, Homo sapiens
ggagattggggtgggaggatcacttgagcctgggaattcaagaccagcctgggcaacaacatagtgaaaccccctctctaccaaaaataaaaaagttggctgggtgtggtggtgcatgcctgtagccccagctcctctagaagctaaggcaggaggattcttgagcctgggagatggaggtagcagtgagccaagattgtactgcacttcagcttgggcatagactgaaaccctgtcttaaaaaaaaaaaaaaatcaggtctggatgtagatgagacttttggggcgcaggttcattccttgtgtgcagctccttaagtactgtttctcttgctgtgaagacctgtaacttaaagagaatgtatatctgctacccaaaagacactggtgggacaggcttagggtaaccactgaataggcttcttttcaaaaaggggaaaataagaggtacccagcagtcactggtttgatgtatttcttatattcagtgggacagctgttgctaattctttgactaggtgttgactcatttaccttgtctctagctgcaccctctgggcttttggttctgctctctgactcatcttttcttttccatagaagtagctcattattgcaggtgagtagtttctccatctgcttcatgcccataatatgttaagggcccaaagtcttttcttcattttgtactatctctgctctttttactccaagctgatacatttcctttaaaaacttcatgggttggctgggtgcggtggctgatgcctgtaatcccagcactttgggaggccgaggcgggtggatcacctgagatcaggagttcgagaccagcctgaccaacatggagaaaccccatctctactaaaaatacaaaaattagccgggcatggtggtgcacacctgtaatcccagctacttgggagcctgaggcaggagaatcccttgaacccaggaggcggaggttgtggtgagccgagatcacgccattgcactccagcctgggcaacaagagcaaaactctgtcccccaaaaaaaaaaaaaaaacttcatgggtttc

SEQ ID NO: 9685 - DNA, 1044 bp, Homo sapiens
cagtttttccatctataaaatggtcataaggccagtatgctggctcacgcctgtaatcccagcactttgagaggctgaggcaggaggattgcgtgaagccaggagttcaaaaccagcctgggcaacatagtgagaccctgtctctataaaaataaaaattaaaaaagtagccaggcgtggtggtgcatgcctgtagtcccagctacttcagaggctgaggcaggagggttgtttgagcccaggagtttgatgatgtagtgagctatgattgcaccaatgcattccagcttgggcaatggagcaagatcctgtctctaaaagaaatttaagaagaataataaataaacttgaaaaaatggtcataaaaatatctgtgcagtgtatttcaaaaggttatgaggatcaaacaaaatgatacatgtaaaaagaatgttacaaagcagaaatgtatgctgggtaggggggagaggaagggacaggatggggatggggatgggactaaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggtttgtcgtctgggttgtgactctcgacttgcccaggattcttcctggtcctgaccgagttgtctttgctctccatttcaggaagatgagagactgcttaggcgccaccactagtaccatgagtccctgcactggttaaagccatcgccacaacctggacaggcagcaaggtaagcagagaggccagtccaggcgagctcctgggatgtgagtgcatttccgccccaactgctgcccggaaaaatcccaagtgcacaaacaagtcaaggcagcgcatcagggtccctcctacccgagctccaggacccagaggaagctgggtccccttcaagcgcttcagctagctccctcccccctggcagggattcttccaagttataaaaaatgagacact

SEQ ID NO: 9686 - DNA, 1044 bp, Homo sapiens
ttttgagacaaggtctcactctgtcacccaggctgtggcgtgcagtggcatgatcatggcccactgcagccttgacctcctgctaggctcaagtgagcttcccacctcagtgtcgaaagtagccaggcctacagctgtgtgccaccacgcctggctgttttttattttttgtagagatgggggttttgccatgttgcccaggctggtctcaaactcctgagctcaagcgatcttcctgtcttggcctctcagattgttggaattacaggcatgagccaccaagccccgcctctccttaaacttctacctgctataaaacaatactaaaagcatacaaaaaacgtaacttctttagtattgatctaatcagtgagattggtaataatgaggttagtagctggctttgttcttctatacattaagtaatataaaagtattaaaaacttaaaaaaagtttgtccatataccacttataatcatcttgtatacacaccccatcttggacactctggactactgtgaggtgttaagcatcaaatggtctaggttctgtggtgacattattaataccctttttagttggattgattagttggttggttttattagttcattcatttaaaaatttattaattgtacgtggtacacagccctaagctagaattcagagttaagacatagttctttctctaaagaatattacagctagcaggagaattaagctgaatgagctttggtgcagtcacacaaggcagtggggcatggctggcattggagtggcagcctgttctgaggagtactggggggtagggctagagaatcagtctagccggggagaatgaggggagctaggattgaggaggttggcacagtctgggctcacacttcctacagccttgcccagatcttactcttaggggtacttctttcccaggctgaaggtattttcttgggtagatcatagaaaagcagcttgagtccacattcctcttaataccctacctcttccctttccctccactttgcaccttgcctccgcaatcc

SEQ ID NO: 9687 - DNA, 1083 bp, Homo sapiens
cccagcactttcggaggctgaggtgggcagatcacaaggtcaggagttcgagaccagcctggccaacagaatgacaccccatctctactaaaaatacaaaaattagccgggcatggtggcgggcgcctgtattcccagctactcaggaggctgaggcaggagaatcacttgaacctgggaggtggaggttgtggtgagcccaggtcgtgccactgcactccagcctggacaacagagcgagactccatctcaaaaagaaaaataaagggaaacaactgagtaggtgtcctcttggtgttcctgagaggcaggcctttgaagaagaaacaaaatggtttaacttctgcctatgtaatccccatccctcctccccaaatacacttactcagacagagctacatttcttccttatccctgtacccttctgaaatgactgagatttaatcagatcttgcatagtttagacttttttttttgttccagttaaagatttgcattggcttcttccagtacagaatgagttggacaaagacaatctccaaagtattttgctgttctgtggtcctttgtcgggcagaaattctcctaaagaagtactgagggccgggcatggtggcccacgcctgtaatcccagcacttcgggaggctaagacagacagatcacttgatcccaggagttccagaccagtctgggcaacatggtgaaaccccagctctataagaaatacgaaaattagccaggtgtggtggtgtgtgcctgtagtcccatccactcgggaggctgaagtgggaggaccacctgagcccagggaggtcgagactgcagtgagctgagatcgtgccactgcactccagcctgggtgacagagtgagaccctgtctcaaaaacaacaaagtagccgggcgcggtgggtcacacctataatccagcactttgggaggctgaggcgggtggatcatgaggtcaggagtttgagaccaggctggccaacatggtgaaacttcatctcaactaaaaatacaaaaattagccgggtatggtggcgaatgcctgtaatcacagctacttgggaggctgagac

SEQ ID NO: 9688 - DNA, 1046 bp, Homo sapiens
cttaaaaaacaacaacaaaaaagaatgatgttaattcacaaaagagataatcttatatttgaacagtgccccatatcactttaaaccattttaagtagttttccttagtaactgaacaagtctaaaggtgacttgatttgttaagtagtttttcatcccatttgggattttttgtgtgcgtttttgtaactgttaacagtagcagctttgaaaatagacactactatatgtgtgactttgtggcttcttaaatggttaaaacttaccaaaatgctaatattgagagcagaaattattttactttatcttattgattatttgttttttatgctctttcattgggtaagtttagtgattattctagatttcaggaaacttttggtcagagcaagcagaagagctagctgggcttaagcagcattttatctttgttttttcagtgattgccttcatgttgtggagcccatgcctgtgcgggggcctgatgtagaagcatactgtctacgctgtgaatgcaaatatgaagaaagaagctctgtcacaatcaaggtaaaatatatatccctctatctacctgtctgtctgtctgtctacgtcttttctgcttctggatggtttctagacaagacagaaaaatttggacccctaccccaaaaggaataatgggcctgttctgcctgcctcactgacatggtttgtggattagttagggtatgttagatagatatgtgaaatggcacaaaaatgccctatgtgtaattagcatattccagaaagatatcccagcttctgtgtaggccatgtgtgccagaggctgagagagcagcatttataagccctcctctccttgcctttccagccctttgaaaaaattaaatatatagtaattattctagaactattacttctggattttaagatttcccctcttcatttcctgtaggacagtggtccccagcccccaggccacagcccagtctgtggtctgttaggaactgggccactcagcaggaggtgagcagtgggcaagtgagcaaagcttcatc

SEQ ID NO: 9689 - DNA, 1053 bp, Homo sapiens
attggcctccatcatttctttgtcttgaggtcagttttgtgtacatggctcttctgctatttaggaatcttggatttttcttcttgtagttgcctttataattataaccttctatgatgtcctttgctctccatttctttttcttttttttttttttttttttttttgagatggagtcttgctctgtcgcccaggctggagtgcagtggcacaatcttggctcactacaacctctgcctcctgggttcaggtgattctcctgcctcagcctcctgagtagctgggactacaggtgtgtgccaccacgtctggctaattttttttgtatttttagtagagacggggtttcaccatgttagccaggatgatcttgatcttctgacctcatgatctgcctgcctctgcctcccaaagtgctgggattataggcgtgagccaccgtgcccggcctactggccgtttctttaggtagtgtctatgacttcctggttacgagaataataaaacgagctcagatcctaatactttattcttgagaacctgtatctactctttcaacaaaccttttctgagtgtctgctgtgttccagacctagctgagcctggaaaatgcagaggtgaatcatagagaccacatgcccttatgaggctcgaagtccataacctgtgaaggcagtcatggactttgacggctatgactgtatgttggatgctatgattagaatttgtgcagcagactgtggggacacacaagagaagtgtccaccccaggccaggagggggtttgttaggaaagactctgggaaggtgatactacagcaagtctcaaaggatgagctgtggccaggaagaatgttcgaggtagaggggctggacaaaggcttggagttgtggagcagtttgggagggctggaaattgggtgcacttgtttgagagatggggcctcacaaggcttggatgaaagacaagaggcagattataagggctcttgatggccaggcacagtggctcatgcctgtaatcctgatactttgggaggccaaggcgggcag

SEQ ID NO: 9690 - DNA, 1034 bp, Homo sapiens
tagctgggactacaggtatgcaccaccatgtccggctaattgttgtatttttggtagagacggggttttgccatgttgcctaggctggtctcgaactcctgagctcaagcaatccgcccaccttggccttccaaagtgccagggctacaggcgtgagtcaccgtgcctggcttgccaacttcattctttttgcttaggatcattttggctattctggctcttttttggatccatatgaatttttggatttttttttctatttctttgaaaaatgacattgatattttgatagggattgcattgaatctgtagattgctttgtgcagtatggtcattttaacaatattaattcttccaatccatgagcataggatagctttccatttgtttgtatcctcttctatttctttcatcagtgttttatagttttcctgataaaggtcttactttggttcttacatttctctgatgagtgggttatgaaagaatctaggtagaaatagtgaccatgtctagggaaagaaaactcagaatttctaagaagggacgtcacagaactaagtagggtttcaggacagttatgcttgcatgtggtttcttaactggcctgctgcttctttccaaagtttaatcagccaggtaggtactgagcataaattcagtgctggcacctttgctggctgggatgtgaacagaaataaataatatcaggccctgcttcccctaggcagcctcccacacaagaccaagtggatgtcttgatcaagggcagattccatgggcatggtggaaatcataatggtgatggtgatgatgagtaacatgatagagtactaactctaagccaagcaccgttacaagtactttacaaatattactcatttgattcttacaaacattcttatcctcattttataggtggggaaaccaaggcatgggggaggtgaactaacttgccacacagctgataaatactagagctggtgaagaaggaggccgtcagggaaggcttctggggaaggtgctgcacctgt

SEQ ID NO: 9691 - DNA, 1087 bp, Homo sapiens
tttcaccatcttcaattctttgcatgcacacagtttctttgttgctttctcgcttgctctcttacttggtgatctcacccaattctcatgacttctctcacctctaagcaggagatgcccacatctgaagttctagccctgacatgtcttttaaactccactcctgcatttatttccattctgatattctatctttagctcagagagaacaaaagcaagcttcacagagtcttcaccataactactttactctcagattttttgttaatgtcaccactgtgctctctgaaaagcttacccccacttcttctccgtacctacactgaaaatttggagtcagttttgactccttgctttgctttatctcccacatacaggtttcaggttcttcacctctgtcccacctgtctccttaccatttttactgcacagacttagtttaatcctcatttccctttcacttctcacctgcactaaatttaaatttcctgaagttggtcatggctgtctctttttctagggcaaattgcagaaaccccttacttactgggcagattgcaaactccttagtttaaaattttaggaccttccttcatttgaatagccttttttttttttcatttgacacctttggtacagtagcttaacttcttagtctcattgctaactgatcacttccctgaaccctcaactccagccaaactggtttccaaacctgtctgtacaacagttgtctaaatttctgctgcccttcaggtccctcttgttctagaaggccttccaggaccactgaagcgtatggctctttaaattcccagaaacagccttttgtttgattattcattgtgagcagtcctataccatggcctttacctgatttattcacttagactgcatttgaggataggcgctttcctctccagcacctggacataacaggcctgggttgataaattatctgttgaaagtgccttgtaaacctggctaggtagaacctcacagttctgaattctgtacccgtctggccatggtgattgcagcttggacaaccaggacagttgtcttcttttgttctttgtgttgaagg

SEQ ID NO: 9692 - DNA, 1055 bp, Homo sapiens
attattgtaatcttactaaaacaaacataccacctttatattattttattatctgcatgggaacatttaccatgaatctgaaataaagttatcacttaacaagggttatgatgtactgaacgatgattagaaagagacaaagcagttgctgggtgaccagctgggctcactcattacccaggtgaattactccctcacatcaggcttgcaaatactattcaggtttgtgccttggcaaaatgacaaattgctacatatctcaaatggtttaaagtgcagttcttacctttccaaacgccaaggttctattatattgactgtagtttatttcagccatgcagttaagtaccagcctacctttctgcacatttcttcaactataccttcaatagtaaatccttgttatagtgatgacttactctccctggcctgcactaacaacttataaggtagccaaagataccacagtttcccccacttaacagagaaggaaactgacattcagagaagttcaccaaactgctttgcctagttcaccaagtagcaaaatcaggactagaacaatatttaaaggaataactttaaatattttaggaaattcaggagctaagatggaagcttataggctggatatccactcctctgtgcaaaagccatcaagctgacataaaaccagcagaccatttagaggatgataggtcatttgcttcttttttttttttttttttttttttttgagagggagcctcattctgtcacccaggctggagtgcagcggcatgatcctggctcactgcaacctctgccccccaggttcaactccctccacctcccaggttcggttcgagtgatcctcttgcctcagcctcccgagtagctgggacagcaggcgtgtgccaccactcccggctaatttttgtatttttagtaagggttttgctgtgttggctaggctggtcccgaacttctgacctcaagtgatccgcccgccttggcctcccagtgttggggttgggattacaggtgtgagacactgtgcctggcctgcttttttc

SEQ ID NO: 9693 - DNA, 1080 bp, Homo sapiens
tcctaacaccatgttctccctaggcctccattttgctggctttatcctgctgagacattcttcagttatcttccaatccagcggtcacaccctggttacctgctgtcctttatcatacacccagattgtgactaaatttgctctcagagggtgattttattatgcccttgtgggggtaccttcctaagcaaccgcccattattatctgctcagaaagtagagagaacccaaacagcatttttgctgctggcctcttaaattttgttactagccttgactgcttggatgtaaggctgcctgcagcaagtcttcataagaacctctgttatcctcaccactctctttggctttcagtgacatcttccaaggagatgggcttccacctatagtatgtttttctatcagatagaggtttggtttttcatactggttttgtaactgctgccatttagggttgacacatgaaaaggagttgttacttatctttcttgcttatgacattcttgtagaatctgatgcagtttattgtgtgtccatgtccataaatggatagtcaggctgtattgaaccttgcaatcccaatcagaccctttgcaaaagaggaaaaagagtaggccatgtctcttgaactagaaagaccaaagagcagcccagctgctgctcttccactcctgcccttgctctttctcctcacctctgtaaacattgtgagccaggggcttccttcttctggtatagtggcctgattttgcccttgtccttggctctttagtgttattgcatgtcaggctctctggtcaccagctgtacttaatgtgtgccacattcagacagttctattaatttatcttaggctgctttcctagtctgcctagatgctggggagcctactttctaatggttgtggtagatggaaggatgaatggatttctagaagttgaattactaagtcaaagaccataaatattttaagctcttatattatctgttagatacattaatagacctttttttttttttaaatggagtctcaccctgttgcccaggctggagtgcagtagtgccatcttgactcactgc

SEQ ID NO: 9694 - DNA, 1033 bp, Homo sapiens
tgggtataaatatattctgtgtccttggggctaattcatcctgtccttcccagcccaacagatgtactgtgcaggctgtcagaaccctctccggttgtatgtaatcctgctcactgtggttatttaatcctgttgactgcttccttgtagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggtaatgtatgtcttgcctctcattgctgagcaaattgtcttcctgttttcagttactagctttcccacactctttttgtccagctgactggctttgaagaatggtgcacagtgccctggagtgagatttgaaataaacaattaaataaatgtgatccaaactattttccttaaagataggctttataaatctgtgtgtttgtcagacttttaaaaagaggcatctttcttcctgggggtagagctgaaggccaacctgataggtcctgtttggcagctggccctagtctagagatagaccagaaagagagaagttggagctcaggaagtaccagtcatacactaaaggttcttcactaatcatatattcacagtggaaaaaaagtctgtcattaacatttcttttgtatgcagatggtttaactaaacatttgagagaaggcctcaggaagttgagtaagtttgatttttccacttaatacccagagaatttccttatttcaaaatactctgttttcaattggtagtcaagatagataccttttatttttatgtatttttaaatttgaaaataacttgaaattttttgaaaagaagttttatcatggaaaaattagaaaatacatattagtatccattggtatttctcaagggcctactatgtcaggtactgttgtaggcactagaaatacctcagtgaacaaaacagaccaagatctcttgccttcctg

SEQ ID NO: 9695 - DNA, 1438 bp, Homo sapiens
tttatttgtgtgtgtatttatgtgtgtgtgtgtgtgtgtgtgtgtgtgtattctcatccagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtgagtcaaccccagggattcactaatccaactccctagctgtaatagggtcatctagtatctgggctagggctgttacccctagaagaccttgtacttttctaaagcagatatggagaagacccagactatctaggtggtttgcttatttgaacaagaaagtatgtgacagaatatctttcagttctgcctccactatgcagattgggatagctccatatgtctaggacctgcaaaaagctgcagatgggttaaaatcatctcatgcctggatcccattcaacagcaagctagcattgtatttaataaatggcagttgaaataatcagaacctgaactgaaaagtaggtaagttagcagaattactcattagttacttttgaagatgactgtatcaaagcccagatagagttaagtgaatatagttttagatctatatgtcaagtgtttgtagatgtttcaagagagacatgttccatgaggaggtgtctctctcatgtccagtcactcatctttaatctgctcttcctcaaggtctctgagctgtctctggtgacatctaggtcatttcctgtgtccagcattgactcgtagtcattcatgttttctcctgttagttgacattgctttttaagtgagacattattaattgcctgctttggttctgattgtgttaggtggacgaaaaggaatgcccctgcccagtggaggcggaaagatcggcagaagcagcacacagaacacctgcgtttagataatgaccagagggaggtaagataccttaagaatgataaggatgaccttgctatcatgctgtgcactccttctctttctcatttcctgttctctggtctgattcaaacgtctcagcaatgacctcaccccataaagaagggttaataataggtctagttcctgatatctaatgctgggcctgggttatcacaaatcagaatgtgggatgttttgcaaattccagctagctactaaccgattgtaatttctcatgcatgatgctccctgaggagttcaataggaacctcagaagttaagagtctgaaacttgggagaaatcctttaaaaattggtgtgagttttgtgtgtgtgtgtgtgtgtgtgtgtgtgtgtgtgcgtgtgtatataggaaaaaagttaattttttttaattctttttttgtttgagacagagtctcgcttttatcgcccaggctggagtgcagtggagc

SEQ ID NO: 9696 - DNA, 1021 bp, Homo sapiens
tttctccagagggacagagagtgtacatttcctagcccaccaaatcagaattcatcagttactgccgtctttgggcatcagaagtctgtaaaaagctttttgttcctttttgcaccaacacatgagctcagctggccctgagcaagtgaaggtactgagctgcctttgtgaggcatcctttgtcttaggcttctctttggagcttcgttgtctgagttcaggaaggaggcatttcatccacagctatattacagaattaagcaaaggatattagagtaaagaaaggggtaccatttttttctatcttggacccctttttcctacttttcccccattttctcaggacactccttcaatagctttttcccagtcatctgtgtgttgaactccttttcaatgaataacatgaggatagactggagaaacaggctggctgttttttggtattaggaattgagcattgggaaagatcattgtgaccttgagcggaagatatttgggagacttcttgggatttgggggatccatgtgatcactacctcagagcagctaagtctacccatcatccctctcaacaaggcaggaggttaacagaggaaaactgatcacttggcattcggtacctcttccaggctactctccccaaagctgttaggtaagaagtaacccctcgtcagctgaggaaggaggatatatgaggagttcctagtattttgtaagtgcttctgtgtgctagagcccctctgtatgatgggaggaaacagcatgaggctattgtatgagtctagtaattgactattgtatgagtgtagtaatttgcttttttaccactccctcctttagctcaattctttcttctcttttttttgtttgagatggagtcttgctctgttacctaggctggagtgcagtggtgccatctcagctcactgcaacctctgcttcacgggttcaagcaattttcctgcctcagtctcccgagtagctgggattacaggcacacaccgcaatgcctggctaa

SEQ ID NO: 9697 - DNA, 2047 bp, Homo sapiens
gatctctgtgtgtgaacataactgaaccattgagagttattgtgactcctaaattctcatgtgtttatttcctaagaataaaaacattctcttaaataactatcattgatcaaatttggaaaacctaacattgagacaatactatattaaagtttctctggtacccgataatgtctgttatgataatttaaaaaaattccttattcaggatctagtgccatatcatgcattgcttttagttgtgagtttctcagcttttgtctttcatgacatagacatttttgaagagtacaagcaagttattttatagactgtcccttaatttggttttgtctgatgttttcatgattagattcagattataaatttttgcctaaaataccatagaagtgatgtgcttctctcagtgcattatattaggaggcacatactgtcagttttcatgattacaggaggcaggcatatgatgtcattttgtctcatttttggtgatactaatctgcttacttggttaagatggtgtctgtggtttcttaactggaaagttataatttttcccttggtaattaacatgtaagtcatggggagatactttgaaactaattattctgttcttctttaaagttttgcctaaccattttttttttagtttttattttttgaattatatttgcagtttatggatgcctaatagtttagcatttattgatgattctattctgaatcagttatttcaagaatagtagcaaaaaggtgattttctttttcttttctttttccttttgagacagggtctcactctgctgcccaggttggagttaagtggtgccttcatggctcactgcagcctcgtcctcccatgctcaagtgatcctcccacctcagcttcccgtgtagctggaactacaggcatgcaccaccatgcttggctaattttttattttttgtagacatggggtcttgctacattgcccaggctggtctcaaactcctgggctgaacctcctgcctggtttcccaaagtgctgggattacaggcgccactgtgcccagccttaaaatttttttttttttttaaagaaatagagtcttattctatcacccaggctagagtgtagtggcacaataatggctcactgcagtcttgatatcctggactcaagtgatcttcccatctcagccgcctgagtagctgggactacaggtgcccaccaccatgcctggctaattaaaaaaaaattttttttttttgtagagctaggttcttgctttattgcccaggctggcagaatagtggttttcaaactttatctttatttattaattggcattataccataatgaagagtgtttctttctcctttgtttattattgtatggattcatagatttttattttactcaggttataattcactataattatttattttgatgctcaaatttcccagatttggtccatgggcaaaggaatggacctccacaatggcagggcttttgctttttgctcattgatggattccaagcactaaaactgtggctggtatataagggtgctcaataaatgttgttaaataaatgaataacttaggcttttaacaggatcactctggccattatattaagagtatatccccaaagggagaatggaagaaagcaaagagttccgttaagaggtaatttgtaataatccaggtgagaggtgatgtcagttagaactaaggagataacagtgaagtggtgtggaatggttgggttctggatatagtttgaaggtgaagtaatggaaactatgttgaactgaagagcacatacctcatataaagtggatagccgctaattagctccagttaattccttgtgggtatactggcctgatgttactaaatattccaataattgatgaggacccagattttttacatgaaatctctgatttttaaatattggcaataatgttctttttaaacactgcaggccaaacaaaaagcatctgctggctgaatgtagttcctgaggcttcactttgcaacttctagtttaagat

SEQ ID NO: 9698 - DNA, 1005 bp, Homo sapiens
gacatttgtctaactttggcaccccgtatagtcctttatttagaaccagactctttaacaagacttcttcccttagctaatttaaagaaggggcagatgtggagaggtggtggtggggacagaggctctaacaatcacttctccagtgattcatagcctttctctcccttttgaccacacttcagatcagctggtcatgctcacctttggctccattcttcatctcacttttaaaaagttctccccttaatcactcagctttcctatcttctcacacatgcatgtcatgtcttagggagctccttacagccattttagatgagatcaggcgcatttagggtggttatggccatagacgcctagagccattttaggaaggcgtctttcctttacagagaacggtgatagttgtcctgattcctctctctgttgtgatatttcgtggtttttactgaggggattttctggctagttaggaagaaatgaacaaactgataactgaaagtgaagaagcttaggaggaagaaacagttatcttctttcagacatgaatgcagtttaaaaatacatcccaagaatttcagactgtagacgagatcattatgtcagcggcttgctgcttaattactttgtacagtaagtgcaggcttaccatgggtgggctctgcaggtgttacagaaagctctgagcctagctctacataagctgtaggccttgttgctgcagctattaccagctgcctgctgatttttgccagtctttagtgaagattaccaaatgtattttgagggacgaaatttactcaaaaagaaagtttcagaagaatttgtttggaagaaggatcaggaaataagaggaatgaaattgtggcacttgcttttaataacagaaagaaggttgggtcctatcagaatttgaaaattgtgaataagtgagctgctgcttctgatgatggacaaaacctcagagaaaatagaggagagattgtagttataaaagcagta

SEQ ID NO: 9699 - DNA, 1050 bp, Homo sapiens
gagttcgtgccactgcactatagcctgggcgacagagcgagactccatctcaaaaaaaaaaaaaaagaacacaggattgggtttcttagactggtctaaaagaccatgaattggacagctggttgcatcacccactaaacaggaaataatgtgagttccaggtgttacctgacagatgtgtgctctgcagggcattcggctgggctaaaaggaaggcaatgtgaacaaaagtgctttcagtttgtcctagatgcagtttggaacagtcctgactggataggctctcaaacctagtctctctaaaactggtcacataagaagttcagccattttagaaatactaggtacatgagttggatcatgtgtggtgcctggaagatgttaagcaggaggcaaaacatcaataaaaataatggctgtgtatacaaacctaaaactatctgacaaagtaaatgtattgagaaagagagtgaacaaatctgccttgagaaaataggagtaacagggtttctcttaaatttacattgaaaagcctggtaagcagctttcctgggttagtgccttggaagaggacttagaagtggcctgcggggctggtgcggtgactcatgcctgtaatcccagcactttgggaggccaaggtggacaatggaccacttaaggtcaggagttcgagaccagtctggctaatgtggtaaaaccccatccctactaaaaatagaaagattagctgagggtgatggcaggcgcctgtaatcccagctagttgggaggccgaggcaggagaatcagttgaacctgggaggcacaggttgcagtgagccaagattgtgccactgcactccagcctgggtgacagagcgagactccgtctcaaaaaaacaaaacaaaacaaaaaagtcttgtgggtgggggttggggggcagtggacagttcactgcttgtattctgggtacttacttgtgaatgtctgactcctgagcatcacagtcagctggtgatgtgggccaagttacagcctgtctcttcaaggaacagttaccttctttt

SEQ ID NO: 9700 - DNA, 1026 bp, Homo sapiens
ttttttttttttgagacagagtcttgctctgtcgcccaggctggagtgcagtggcgcgatctcagctcactgcaacctccatctcctgggttcaaacaattctcctatcttagcctcctgagtagctgggattacaggtgcccgccatcgtgcccagctaatttttgtatttttagtagagacagggttttaccacattggccagctggtcccgaacttctgacctccagtgatctgcccatcttggcctcccaaagtgctgggattacaggcgtgagccaccccgcccagcctagcaggatgtttttaaggttcatccatgttgtagcatgtgtcagcaccttattccttgttatggctgaataatattgtattattgggatatttatatggtatgaataatacgtaccatattttgttccttcatctgttgatggacactggggttgtttccactttttgcctgttgtgaatagtgctgctatgaacattcatgtacaagtttctgtctgaacacctgtttatgtatatatccaagaatggaattgatgggtcatatagtaactctgaactttatagtaactttaagaaactgccaaaatgtcttcacagcagtgcatcattttacattctcactagcaatgtttcaggtttgcggatgccagctgggtcagggagaccctaacccagcggcgctagaggagtaaaagacacacacacagaaatatagaggtatggagtgggaaatcgggagtctcacagctttcagagctgagagccttgaacagagatttacccgcgcctttattaacagcaagccagtgataagcattgtttctgtaggttatagattaactagcagtattccttatgggaaataaagggatgggccgaaataaagggatgggttcggctagttatctacagcaggagcacgtccttaaggcacagatcgctcatgctattgtttgtggtttaagaatgcctttaagcggttttctgccctgggtgggccaggtgttcctt

SEQ ID NO: 9701 - DNA, 1049 bp, Homo sapiens
ataaaagtattttaccccaaaatgtatttctttgagatgttttaaaatggccctgcaaagctgtcttttgtgggggaaatttgagtctgtagagaatctccattagtacagacagggctttcccagatctagcagattatctaagagttggataccttttaaggtctgaaaagagatatttaccatctatactcttggttacctggaggcttcatccaaaatttgtaaaccaaaaccaacctgtaacatgagcatctcaggcacaagaacgtgttgagactgttccctgggccatggtcgttcatattgattcaaaataaatctctttaaatattttagagcttgtttttttttttcttcactaggtgtctctctccttgtttttcttagagtttttatttgataaaaacattttttatttttttcttgattttaaaagccataggtcagtatgaaaatggaaacattatagagctgtattataaactcctttgtctcagagttgttgtagaactaaattggagtctgcttgcccagtgcagtagaaccagttatctacactgatatttgcagtcattgaaagaaaggcttttactgcagggtgccaagcaaggaggacgaggcagctgaatgttcaaatcctggcctccccagtggcttgcaggcaagggttttttttttttttttttaagacggagtctcgctctgtcgcccaggctggagtgcagtggcacgatctcggctcactgcaagctccgcctcccgggttcacgccgttctcctgcttcagcctcccaagtagctgggactacaggcgcctgccaccatgcccagctaattttttctattttttagtagagacggggtttcaccgtgttagccagatggtctcgatctcctgacctcgtgatctgcccacctcggcctcccagagtgctgggattacaggcgtgagccaccgcgcccggccaaggcaagggtttttaaaggtatgggtaaatttcaggaaagcaggagctgcaggcaaaattgtgaatcaatacttggag

SEQ ID NO: 9702 - DNA, 1074 bp, Homo sapiens
ttagaaagaataattgggccaggtgcgatggctcgatcctgtaatctcaccactttgggaagctgaggtaggaggatccctggaactcaggagtttgaggctagcccgggcaacgtagtgcaacactgtctctacaaaaaaatttaaaaatgaggccgggcacggtggctcatgcctgtaatcccagcactttgggaagccgaggtgggtggatcacctgaggtcaggagttcgagaacagcctggctaacatggtgaaaccccatttctactaaaaatacacaaaaattagccaggcatggtggtgggcgcctgtaatcccagctacttgggaggctgaggcaggagaattgctcgaacctggaggcagaggttgcagtgagctgagattgcgccattgcactccagtttgggcaacaagagcgaaactctgtctcaaaaaaatacaataaaatacaataaaataaaaaaatataaaaatgagcccagtgtgatggcatgtgcctcagctccagaggacgagctgggaggatcgtttgagcctgggaggtccaggctgcaatgagctgtgattgagccactgcattccagcctgggcagcatagctagaccctgtctcaaaaagaaacaaaaaaagaaataatcacaggccacaattataagacagtaaatgaataaacctgatttataacaaattacatgctttttcgttacaacacgttagaattactttccaggagtgtcagaggacttggttctttttctttttttttttgagtcggagtctcgctctgtctcccaggctggagtgcggtggcactatctcagctcactgcaagctccacctcccgggttcacgccattctcctgcctcagcctcctgagtaactgggactacaggcgcccaccaccacgcccggctaatttttttgtatttgtagtagagacagggtttcaccacgttagccaggatggtctcgatctcctgacctcgtgatccgcccacctaagtgctgggattacaggtgtgagccaccgcgcccagccaggacttggttattttttcaggtgtat

SEQ ID NO: 9703 - DNA, 1034 bp, Homo sapiens
gactccttctcaaaaaaaaaaaaaaaaagaatactgtgtgtgattatcattaaggatatcttttttttttttttttttaagagacagagtctgtctctgttgcccaggctggagtgcagtggcacaatcatgactcactgcagcctcgacctcccaggcccgtagctttattgctttatctttttttataatttcatatttaaagaagcattgagggctagacatggttgctcacgcctataatcccagcactttgggaggctgaggcaggtggatcacttgagaccagcctggccaacacgatgaaaccccgtctctactaaaaatacaaaaattagccgggcgtggtggtgggtgcctataatcccagctactcaggaggctgacacaggagaatcgcttgaaatgggaggcagaggttgcagtgagccgagatggcgccactgcactccagcctgagtgacttggtctcagaaaaaagaaaaagaagcattgacatgaatagaacaaagaactccagtatatctcttaaccagattcaccgattgttaacattttgccccatttgctttatcatttatgtgtgtgtccatatataaacaattttattgagatataattcgtataccatacagttcacttatttcagtgatttttaatttatttttacaattagttttacaatcacactacaatccattttgaaatgtattaatcactctcccctgaaaacctgtacccattagcagttactcatcattttctcccaaccctctaaccctgaaccctaggcaaccactcatctactttctatctctatagatttgcctgtttttgacatttcatataaatggagtaatatgtgtggtctcttgttactggcttctttcacttagcataatgttttcaaggttcactcatgttgtagcatgtatcagtttgtcattcctgtttatgccagaaaaatatgccatggtatgaatatacaacattttatttgtttatccattagtggaaggacattggattgtttt

SEQ ID NO: 9704 - DNA, 1015 bp, Homo sapiens
tcttatctctacagaaagtacaaaaaattagctgggtgtggtggcatgcacctgtggtcccagctgctcaggaagctgaggtgagaaggtcacttgagtctcagaggcagaggttgcagtgaactgagattgtgacactgcactccagcctgagcaacagagtgagaccctgtctcaaataaacaaatacaactaaaaataaaaaataaaaaaacccaaataagcatagagcttgctgtgtttaatatagactgaggtaattggattttgtaggaatctcttcctgtcacttctttccctttcttgcagactcagcatttaggcaagtaatgtagttgttttttgtgcaaggaattgaggaatgtgtgaaaattaattttgttttctggttgaggaagctctttgggctagaaggagaagaaggtaatatgtgagcaaagcacagatttagccaccttgaggatatggtgtctgcttgttggctttttgaacttgtcagttaggtaagcaaatctggaagaattgcttctgatttatgttttccattatttttggcacatcgtaagtggggaggcagatgatagtggagttcagtttctttttctacctctgatgggcgaatgtcctggtgaatcttctttttctttgtttctgatggtcaccactaggtgaccccaggagaaggttttactgtgaaatggggttcatgagtttattttccttgtctctgcttgagaattaaggttcccaaatacttgtgacgtatttcttaccttggaatctgtaagttcctctgaactgatctgcacctagcattgagatataagtatcctaggttctttcatcttgtactccaattttcccaggctctgtgcagaagctcttgccaggaattgaagagaagtggctagggataaggatagatgggaaactggccagtgtgctgtatgaacttactagaaaattgagactacactgaaatagtctctctcttttttttttttttttttttttt

SEQ ID NO: 9705 - DNA, 1025 bp, Homo sapiens
aaagtgctttttgctgcttggtaaatgggtaatgcccttgattccttgactgtaggacatagctgatctaaagtactctgtcagttttaccttcacccatgactgttattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattgtattggagaaaccta

SEQ ID NO: 9706 - DNA, 1050 bp, Homo sapiens
taagttctggggtacatgtgcacagcgtgcaggtttgttacatacgtatatgtgtgccacgttggtttgctgtacccatcaacttgtcatttacattgagtatttctacatttacatatgtgtgaaactatccataatatgatgttttgttttgttttgtttttgagatggagtcttgctctgttgccaggctggcttgcagtggcgagatctcggctcactgcaatctcctgcttcctgggttcaagcgattcccctgccttggcttcccgagtagctgggactacaggtgcccaccaccacgcccggctagttttttgtattttagtagagacggtttcaccatgttggccaggatggtctcgatctcctgactttgtgatccgcctgcctcagactccctaagtgctgggattacaggcatgagccaccccacccggtccatatagtacaatcttaacccaaaaagtgtgtgtgtttgtgtgtgtgtgtgtgtgtgtgttttgtttttgacagagacatgtaggagacaggtggaaaatttgaggctgatgaaccaaagagaatttcgagtttttagtactatatgtggttgatacttgaagccatggaaattgccaaatttatcaaagaaaagggattgtgtggccaacagaatgttagagaaatttcaagagttgagggcaaagagaaaaatctagagaagaaattacctgtaatgtagaagaaaaagtacagttcactgaagccatgtttcatgcaggatgaagtctaatcctatgcagggatcactgaaaggtgactattgagaaaaagttattattggctgtgaggaagtttcaatagcatagtggaatagtaaagcaggtcacagggaacgaggagagaatctcctctgaggaagtgaagatgagcggtagctggataggataccctggttgaggttgttttttaagttatagacaactgagtagttttgtagaggaggcatcctgtgaaagagaacagagttgaaggtgaaaaaacccaggaggaaggaggaggagattg

SEQ ID NO: 9707 - DNA, 1058 bp, Homo sapiens
ggcctttaaattttacaaagtacttaatggcacatgggcaaaaaaaaagaccctataaattcatgtttctccaaattccatttcagattctcttcttataaataagtgaagttggcaagtttcactccataacggaaaaacaaaactaaaatgcttcatgcagtttagtcttttaagtctgtatactttttaacctgcaacaaaataaatacaaaattattttgaacaacaaaatccagatgatacctgagagaagcctaaaactctattcatcaccatacttagggaaatgctgacatagaattaatttattagctgaaatacctatcattcccaattctacataatataataaggctaaatttatttgaagcacacttgcctttaggtccccaaaatcttgtggccaacaataaagaaaactaatgaaaccaaaagctgttctttgagaatatcaataaaattgataaacctctagctagactgcttgagaaaaaaaagacacatattaccaatataagaaatgagaaagatgacgtcactacagattctacaaatattacaaggctgatcctgggtatggtggctgaagcctataatcccagcattttgggaggccaaggtgggttcacttgagcccaggagttcaagaccagcctgggcaacacagcaagaccccacctctaaaaaacataataaatactttttttggccaggcacggtggctcacgcctgtaatcccagcactttgggaagccgagacaggcagatcacgaggtcaggagatagagaccatcctggctaacacagtgaaaccccttctctactaaaaatacaaaaaaattagctgggcgtggtggcaggcgcctgtagtcccagctactcgggaggctgaggcaggagaatggcatgaacccgggaggtggagcttgcagtgagccgagactgcgccactgcactccagcctgggcaacagagcgagactccatctcaaaaaaataataataatttaaataaataaataaatactttttaaaaatccctgttaagcaaatgaa

SEQ ID NO: 9708 - DNA, 1047 bp, Homo sapiens
ttttcatttttattatgaatatgttttacttgcataataagaaacaaatatgtgcatatctacaaactttaatacacgtacagtctggaactccaacagtgtgttacctatcccttaccatatacatcttgggaagacttagtttacactgttggagtaatcatactgtccatgtatcattagtttctctttaaacttccaggttcatggccttataattgacttatatttggtattatgagctccatcaagttccagtctaccagtaggctcttccagttctcagaatgaacgcattcttaggctaagtaatctacctctagtaaggactagatttgccattctgggcaaaccactagcttgtactgaatggctgttcccaccaacactgacacattgctgtacaagattgactttcttgacccattggcagcctctgcagctatttggccccaaataactttgtcattatgcactgccccattggaaacatcactcttttacctatagcacttcatctgcctaattctctgaatcttcatccgcagaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacaggtaatgtctgaagcagcttctttctttataactcaaagaaacagaggcccaagtagatatacagaactgtatttgagaaaaaaaatactttgttcccctactccccaacattctcctccttcattgtgtgccatcagtaaaggcctttcagactaaggaaatcatctggtataggaggtgagggagtagaagtcttgatcgctgggtttttatctctgtgtatttaaaagtttggtatctataggacactaaggagaaaattatttttagatggaaatctttgatgtaaatttaatcagcatgtatttacagggctcctgct

SEQ ID NO: 9709 - DNA, 1033 bp, Homo sapiens
gagacggggtttcaccatgttgcccaggctggtttcaaactcctgggctcaagcgatctgcccaccttggcctcccaaagtgctagtattacaggcatgaggcactgtgcccattactaaacttataattctcattcttcatggatactgaaaaatataatataatcttgtttagaattacatcgttttggcatgatatacaaatattaattccaaatccagcttcagattttagtagacttatgaagtttctatttcatatctttaaatgtcatgttaaattgaccaaataagcagaagaatgttccttacttttttcatgaagccctgagaaattgcataactcagcatttgccttcctagactttattagtacctcctgccagcatgttttgttttcagtatcaatgtactgtttctgcttaagatcttagtatttacttttaaatcctgaatttacatcaaaatataaaataggattgatttgggggatttgctaggtcattctgaggctaagattgtgtgattttgaaatgctatattggataatgtttatgttacagaagtagcaaatgaccatatgacttacggtttttagattaatcagcttgctatgacctctaaaactgtagctccagagcatgcacctttttccttagttagtggcattcccacattagattatctcactccacgactttggcttttgtgaaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatatttggtgaaaagtcgcaactaagggtaagatttcttttttctcacttagaaactttatggatacgctagggctgttgataaaacctgtatcacaaaccagctttgctagaattttttttacagcatgattcttaacctggagttaataatctcaaaaa

SEQ ID NO: 9710 - DNA, 1032 bp, Homo sapiens
ctcgatctcctgacctcgtgattcacccacctcagcctcccaaattgctgggattacaggtgtgagccactgcacccggccttaacaatctttttcaactacactatcttcttttttaacactggcctccaactcttggcttcttttatacaagggaattcccagtagtggttatattcttatgactccattctttgctaatcctaaaggcacccagaaggctgtatttaccttttcagattaaaatctcctatttaacttatgaccactatgtgcatatctgaggctataaatattatttctgacacccttctcaaatactttctgctgaaaattactgtgaatttggcttgtttccttatgacagttttttactcctaaccaggtgcttgtcattatggtatcttaagctaaaatccagaaacgcaaatctcattcttttactccatctcttaactcttcactcctaaagcctccaaaaccttgtgaagtcccagtgataaactggacaaagagatactgctgtttcctgacaccttcaacattctctgtgatctctagagctgctttctgtgtttcttctgatagtgtcattccttctcaaagtaggacgaatgaactgaggcaagcaagttaagggtctcaaaagattctctgttatgtgaacataccaggcagacacacatttagactggccagggcaagactaggtataaacatgcccatgccttgcaagtaattcatttccttgtaccgactcacagtacagagtctcttcattcttccagagttagataccactgtgagaggagcctcctatcatttaattcttcttcttctttttttttttttttaccctaacccctagttcttcttcctagcctttttctttttgctcccctattttcacaatttttttcattcttttcattgtcgtacagtcttagttccaagttttcttatgttatttccactgtgtgtctctcctggtctgatgagccagggttaaaattgaccttcacctctttttca

SEQ ID NO: 9711 - DNA, 1035 bp, Homo sapiens
aactttttgtcatttgagtaatgttaacccaaacaacatggtttttgttcttctttttggctgactttagggactgaaaggaggacttcaagaatgtccactgtgcttaagcaggtagtgccaggacatttggatgtaaacccatccaatagctttgctcaaggaggttagtaagattgattttataactgagcactgatgcaagcttaaaagcagaaagcatttttctagatagttgatattttaaatcaattaattatgattcaaattgttcttaattaccctcttctgaatgaatggtcaaatgtattactagcatgatgacagatgagcttagccttgtgggacaagaagtataataattgctgatgtcatatatattgataagtttgggagcattaagaggtaaggggagcatgtctaaatgatgagtcagccctgggagtactccctgatactccagatttgcagggcagaaagaccaatctatcacagaagtatagatagttaaggagaagtgattccagatcgaaggaactccaagtcctgttatttttgctcctgtcctctgaaatactggtttggaggataagacatcatgatatccaggtagctgctgacatgaggaaatagagaaaggctaagtattcattcttttaagctccaaaaggtcatccactttgttctctggaagtttatgtgagattcttttcactctgcagaggaaattccagaccagattcttttttttttttttttaagacagagtcttactttgttgcccaggctggagtgcagtggaactgtcatagctaactaactgcagcctccaactcctgggcttgagcaatcctcctgcctcaagctcccaaggagctaagactacaggtgtgtgccaccactcccagctaaatttttaaaatattttttgggacagagtcttactatgttgcccaggctggtcttgaactcctggcctgaagcagtcctcccacctgggcttcccaaagtgctgggattacaggcgtgagaaag

SEQ ID NO: 9712 - DNA, 1050 bp, Homo sapiens
tcagaaacaagttgggaatatagttttgagattgtggccaaataaacattttgcatgaagttctgaaaaattggcactctgagtatgcagtaatttttctggaattctccgtcattctaactaaattttctctgaagatgagtcatgttgtcggggtgtgatgtcctgctgtttggaaagtttgctatcaaaattatgccagccattgagaaaacagactcatttatcattccaatctgtcagaagtaaaataaaattttaatagatgacttattagaacactggttataaagcatttatgatggtaaaaagtaatatatatccattaagttattagcaggaaggaaatggaataataaaaaataatccaaaagaaggcaagaaaggaaaaaaaaggggacatagaacaaatggaataaataacaagtagtaagatggtagatttaaattcaaatatatccataattgcattaattattaattgactaaatgttccaattcaaagaaagagatcagggtttgctttaaaaaaaaaaaaaaaaaaaaagtggctgggctcagtggctcacgcctgtaatcccagcactttgggaggccgaggcaggcagatcacgaggtcaagagatggagaccatcctggccaacatggtgaaaccctgtgtctactaaaaatacaaaaattagctgggcatggtggcttgtgcctgtagtcccagctacttgggaggctgaggcaggagaatcacttgaaccctggtggtggaggttacagtgagccgaggtcaagctactgcactccagcctggtgacagagcaacactccgtctccaaaaaaaaagctttctgctgcttttaagggacaaatctaatatacaagtatataaaaaggtagaaagtaaaaggatagaaaaaatataccacgcaaaactacctttaaaaaaagttgttgtcactatatgaatatcaaagtagactttaaaagcagtaagaaaggatggttgataatgacaaaaggtttattttacacacagcaattcattaagatcaagt

SEQ ID NO: 9713 - DNA, 1050 bp, Homo sapiens
ggctcagggagagaagtaatggcagccaaatagaagctgggccttatgcttataaacattgagtttaaatgaggtagtataggtggcctagtgaagtcaggatattgtttatcctcagaagacaaagcaaataagtaaatctattgagggtaatggtagccaagtttttcacagatatagaagtgagtacaaatatggaaaaggagaaagctagaatgaatcatatggttttggatgaatttaagctaatgatgcttatctttttataaatactaaaataacagttggaaatgtgggtatacgtctatgtgtatatgaggggaggagttaggaatgcatacatatatttcctggctctgttctgagagagtctggcaacagagacaccctatagcaatgagcatgtctagtgtccagatcttggtttctaaatatgagtctactaaaaggaactaagaattcttgaagaaatggctagcagcaggagtagggcaaggaaaatataagaagggcttgaacatctttttatttcagaaagtacagaagtacttaaagaatcaatgaactctagttggatttttaaaaactgtggttaaatatatataacattaaacttactattttaaccatccttaagtatacagcttagtggcattacgtatatttatattgttgtgcaaatgtcaccaccatacatctccataactttttccatcttcccaaactgaaacttcctatctattaaacgataactcccgtttccccctgcccccagctcctggcaaccaccatgctaccttgtgtgtctatgaatttggctaccctaagtacttaatataaatgaaatcatacagtatttgttcttttgtgacttgctgatttaacataatattgtagcatgtgtcggaatttccttcctttttaaggctaaataatattccattgtatgtatataccatgttttgtttacccgttcatctgtcagtggacactttgggttgctgtcaccttttgcttattgtaaataatgctgctatgaacatgagtatg

SEQ ID NO: 9714 - DNA, 1048 bp, Homo sapiens
gtctcctcctctgaatttcatgatctcaggacacttttttttttttaatccctgcttacgagaagcattcctggttctccagttcataacacagtatcatctttggtccctgcaaggtcccttccttattttatttatttgtttatttttatcagcattatgctcccaatctccctcaagcatttaaatgtgcttttttaattgacagataaagttgtatatttatcatgtgcaacatgatgttttgaagtatgtatacattgtggatattttaatgtgttcaatatattattttctatgcaggtgtccttgaaaaatgtatattgtttactacatgtgtattttaatttatgtaaatggtgtattatgtatttcattgtttttgtcttttgtcagtcagcattatgtttttaataaaacgtgaatctcgagtaactctgattccaaaatcagatagatacaatataaagaaaggaaaaaaaagcccctttttcttatgaatgtaaatgcagaactcttaagaaaaatattggctaatctaatccagtagtgcattaaaaaagtaaagcgtcataatatagtggagtttaacctaggattctttcagtgtaatgcaccccattaatagattaaaggaaaagaattatgattatctcagtcagttaagaaaaggcatttaataaagtttaatgctatttatttaaaagttcttagaagctgttattagaaaagagcttccatgtttggtaaaacctacagcaacccttgtagttaatgaagaaactttatatgcattcctttaaaattagagcaagacaaagatgcttactattacactattaacaatgttattagtgtgtcagtagctgtcattatttttagatagaaaatcagatttctgatcctctacctagaaaatgtatgagaacaaactatttttactaataagatgactcagttaggttttcaaatataagattagcctataaaaatcaatagcatttattttcatcagcaaaaaacaactaaaaagtaaaattttttagaa

SEQ ID NO: 9715 - DNA, 1071 bp, Homo sapiens
taaggctgggcgcggtggctcatacctgtaatcccagcactttgggaggccgaggtcggcgtatcacctgaggtcgggagttcaagactagcctgagcaacatagagaaccgctgtctctactaaaaatacgaaattagccgggtgtggtggcgcatgcctgtaatcccagctacttgggaggctgaggcaggagaatcacttgaacctgggaggcagccgagatcgtgccattgcactccagcctgggcaataagagtgaaactctgtctcaaaaaaaaaaaaaaaaaaaaagtttaaaacattatttgacgaatataggttttgtattgatgagatgaaaggaatgctaatgagtaaaatatgatagtctttcttcttaggtatgggagaaggtgaagggattgtgcctttagaatccaaagagtagccataaaatataagtagtctttttggcttgagaaccattgatactattctcacttataaatgggagctaaataatgtgtacacatggacatcaagtgtggaataataagacgctggtgactcagaaggctgggagggtgggaagggagtgagggatgagaaattacttaatggctacaatatacatcattttggttgatggatacactaaaagcccagacttcaccactatgcagtatgtccatgtgacaaggctgcacttgtaccccttaaatttatgcaaaaaaaaactattgatactacctcatttaaacaaatggcatagtatagttctttgtgaaagtataaattttatataaatactactttcatttatatccttctaatattattttaataagttaaatttatttaggtaactagcttagtagcctaggtaatacactagaattttctaaccctatggtaaaaggtgaaaggtgctaggtttgcatgactaaaaagtgactttcctaagccagtgtaacagttcattgatcatgatcgtttctctttgtttgcactactttctttcaagtcccctctactcaaatgtgtaatatctaatattttgtggaatgtagtttttctttggtaatatctt

SEQ ID NO: 9716 - DNA, 1089 bp, Homo sapiens
tctattctgttccattggtctatgtttttataccagtaccatgctgttttggtgactatggccttatagtatagtttgaaatcaggtagtgtgatgcctctaaatttgttctttttgcttagtcttgctttggctatgcgggctcttttttagttccatatgaattttagaattgttttttctaattctgtgaagaatgatgatggtattccgatgaggattgcattgaatttgtagattgctttcagtggtatggtcattttcacaatactggttctacccatccatgagcatgggatgtgtttccatttgtttgcattgtctgtgatttttttcagcagtgttttgtagttttccatgtagcggtctttggactcctttgttaaatatattactaaggattttaacttttttgcagctattgtaaaggggttgagttcttgatttggttctctgcttggtcgctgttggtttattgaagagcttctgatttgtgtacattaatctcagatccggaaactttgctgaattcttttatcagttctaggagctttctagaggagtccttggggttttcaaggtaaatgattataaccgtcagcaaacagtgacagttttacttcctctttaccgatttagatgccctttatttctttctcttgtctgattgttctggctaggacttccagtactatgttgaaaaggagtggtgagagtgggcacttgttccagttctcagagggaatgctttcaacttttcccaattcagtattatggtgactgtgggtttgttatagatggcttttattacattaaggtatgtccctcgtatgccagttctgctgagagctttaatcataaagggatgctaaattttgtccagtgctttgtctgcatctattgaaatgatcatttgatttctgttttttattttgtttatgtggtgtatcacatttattggcttgtatgttaaattatccctgcatccctggtatgaaacccacttgatcatggtggattatctttctgatatgttgttggatttggttagctagtattttgttaaggattttagcatctgtgttcatc

SEQ ID NO: 9717 - DNA, 1055 bp, Homo sapiens
tatcagtgagaacatacaatgtttggttttccatccctgagttacatcacttagaataatagtctcctatctcatccaggttactgcaaatgctgttaattcattccttttcatggctgcacagtattccatcgtgtacgtgtgtgtgtgtatgtgtatgtatgcatatgtatatatatatatatatttggcacagtttctttatccactcattgatgggcatttgggttacttccgtgattttgcaattgtgaattgtgctgctgtaaacatgcatgtgcaagtatctttttcgaagaatgacttcttttcctctgggtgaaaccccgtagtgtgattgctggatcaaatggtaattctacttttagttctttaaggaatctccacatcattttccatagtagctgtactagtttacattcccaacagcagtgtagaagtgttccctgttaccacatccactccaacatctactgtttttttatcttttgattatggccattcttgcagaagtaagatggtatcgcgctgtggctttgatctgcatttccctgatcattagtgatgttgagcattttttcatatgtttattggctatttgtataccttcttttgagaattgtctattcgtgtccttagcccacttttggatgggattgtttttttcttactgatttgtttgagtttgttgtagattctggatagtcgtcttttgtcagatgtatatagattgtgaagattttctcccactctgtgggttgtctgtttactctgctgactgttccttttgctgtgcaaaagctcattaattaggtcccagttattcatctttgtttttattgcatttgcttttgggttcttggtcatgaaatccttgcctaagccaatgtctagaagggtttttccaatgttctagaattcttatagtttcaggtcctaggttttaagtccttaatccatattgagttgatttttgtataaggtgagagatgaggatccagtttcattctcctacatgtggctaaccaattatcccagcaccatttgttgaaaag

SEQ ID NO: 9718 - DNA, 1056 bp, Homo sapiens
cagattcatttttattcttttcaatatatgtagtatttcagaataactctctttgagagaaatatattttatgacagcatatatttatacatgaagggatttatataggctttgatctttttattgtatttctgttttgaccatttgtccgttaccaagtgataaattattatttcacattttcttttttcacagacagcattcttggggcagcgtggtttggtcgagaatgatttcctcactaaagtactcagtggaatggcatttgcaggttttgtttcagaaagaggtcctccttatagatcttgtgatctctttgatgaggtatagctcttattaaatgaaggcattatttatagacataattagactagtagttaaaagtaaaaagtaacattttccatatttatatagtcaaatataaattaggtattaaataatcccaatgttatttattatgcttatcaaatctcgatattttaatgtggattataaaaattacaaaaaattataagatgccttggaaatacatataatttttgaacaactgaattttaaataattgaacaatgtatactactcaggtgatgagtgcactaaaatctcagaattcgccactatgtaattcatccatgtaaccgaaaaccactcatactccaaaagctactcatattttaaaatattacattttaaaaaatggttgtttaaaatatttttgaaaatttaatagtgattgtataaatagaagtcttatttttaaaggccctaatacagtaattcttttgtcagtgttttagggagaaaggtctaatttgaagctaagatagctgaaattacttcaaactggagttacatttagtctatcaaaatcatagagccatagtttaagtttgtggcattctcactaatcaattatcaacatttctctacctgtcttaggagacattaaatatatggaagacaaatttttgtctctatcttcaaggaattagccatataaagggagaaatagggcagatgtgactcaaaataaggatgctgttttgcatttattgt

SEQ ID NO: 9719 - DNA, 1029 bp, Homo sapiens
ctccttttcctgagccctttcttcttccttctggtccttgatgtaaaagaccaaggcaactgttttgagaacatcaggcataggggtattggggcccagtgctagcttttggagtttcctctgaatatctggggctgcctgagttaggaaacggtcctgtaggaccagttgcccttctgatgtctctgggtctaggttagtatgtttcactagggcctcttgtagcctctctgtgaaagtgatggggttttcaagagggccttgatctattaaggccattgtattatagttcacagcctttgttctgctagcttttatcccttctaccagaggaacatgcggtttcttccccatatacctccctgggtattgtaatcccaattggagtcaaccggaggaactgtgatggctcctacagggtagccacccgggtcagtcatatgcattggatttgcaaattgttgggccacctccataatggaatcactttctcccttagacagaatttgccctagtatgactgagaaatccctccaagtgagttcaaatgttaatcccagtttacagaaccctttgatgtatttgtcagggtcctccataaagtcccatagttctgttgtaatttggctcaggccttacatagtgaatggagtctggtttctagtgggtccactggggctactgacctcttgaagggggcgtgacctaagagggtggtgtccagaggatagccctggatatggaggggctccgggcctgggagacttgaatataatgaggtagaaggggcagtggggtttgagccgtcatcttttgctcctctggggcttgaaaccagggtaaacccaataaggagtgtcccgaaccagccagagggggctgcctgactatggcagctatcatcactagatccattttacaagcccaacaaaggtcagggttgtttcatagggctatgaaggcctgtacataggggatttctatccatattccctgctggcggcaaagtaaatctagttgatagatcat

SEQ ID NO: 9720 - DNA, 1068 bp, Homo sapiens
ctggaatatcttcagggacgttacagaaattctatcctatgcttttttcccctgtttgtttataagaagtttttcctaaaacttacatgtcttattattcttgtgtactctatatctggcataatgcctcaggtacaaaaggcatcaatgtttattgaataaatgaaagaatgcactagctatgaggaagtggtaaccatattgtagatttttctgtgtactgatgaagtgtgccggaatacataataattggtcatttgaagatcaaattttattattttattttactctagtattttcagcttcattatcttttgcttgcatgttctaaattcacttttttctgggaaagaatggggaaaagataaggaagcaaagcagaaagaaagatgcagtgcagtgtgcagagttgttgtttccaaagcacatggtggtgataattctatataaaggcattctcttatcacctgtcattttgtttggactttgtcaaaggccaatattaggccattatcagagttcacgagctgggttgggggtagtggtggtagcggattttacaaagcacagacaggaagcagataagactataagatccttttgtaaccttgactagttttcctgtgaaaggtctaaatgtaatgatagcatttcctttgttcttctctctaagaattgttatgataatgaatttgtttttcacagtttaaaaggtctctgtgtttttctgaaataattatatggactctgccattccaagcttcactccctacaatttcctcttgatcgccttcatctcttgtttactgtcttgtgtttatttggtttttggtttttttgttttttttgtttttttggcagcctatgtgaactatttttgtttacctgaggattagtgttttaagtgtactaacaatgctgggatttttaatgttaataagtttgtattcacaggaactggtttttatagaccctgtgatattttaatctaatccatacccgtttaaacttgggtgtccctccctgccccaaataatcttgtaaaatgctcttgacatcttttgtcat

SEQ ID NO: 9721 - DNA, 1060 bp, Homo sapiens
cactaaaaaccactgaattgtatactttaaaatggggaatttatggtatgagaattaagaaaaaatgttactgttagaggcttgttaaaagaactcaggagccatcttgaagaggctcacaactgatctaagatgatagaatttgagcttcaaaaattacaataattgcagttggttgaaacccagcaaatattttaagatccatgaattcataatattaaaaagggattgtcacctacctcagaatatgataaagaacaatttatcttgaaaatttatcaataaagaaaaaaatgataaccaatagtagttgagggcaattatcttttttagaaagtcttctaattaataaagatgaaagaaatgatggaaatagagtatcattttgcaatcctcaatgaaccaagatctaagtatcaacagctgttaccacagaaagaaaaacaagcaagtattatgtgccgttataaccttaccaaacactacttattgttttgccaaagggattaaacctgagtctgatcacagaaaatgtagaaaatagaggaacacattaaactgcaccaagagaatgtaattaccaaaatgcaggctgttggaaactctcttagtcaaatgtcccaggttctttaacaatctagaggttcctcaacctcgagattgaaagagatttaaaagacatccaactttttaatagagtgagactaaactatagtgtctacggatgtacttttgggtgataaaaactgcctatagaaaaaaatcaggaaagtggataaatattaaataaaagcatggttactcttggcagtagagaggagattatgatgggggggtgggtacataaaaggggcttccaggggcttttacttttgctgggaaagttctctttcttgatgtgggtggtatttttaagataatttattaagccatacatttgatttgtgtggttttctatatctgtgttttataataaaaagatttttttaacttgtaaaattatttatgtcctttatgtgcataactaatatatttttaaaaccttaaaaatatgtattta

SEQ ID NO: 9722 - DNA, 1391 bp, Homo sapiens
taattttgtgggtcctgatcttacctactgttcattctttttaaaaattttaactcaggccccttttttccttaggtcagttagacttttagaaagtggatgggacgggtgtggtagctcatgcctgtaatcacagtactttgggaggccgaggcaggaggattgtttgagcccaggaatttgagatcaacctggacaacatagtgagaccccatatctacagaaaaaattttaaaacattagctgggcatgttggtgcacacctgaaatctcagctactagggaggctgaggtagatgtatcacttgagcccaaaaattcaagactgcaatgagctatgatggtgccactgtactctaacatagaaggaaagtggacatattttctttatgctaaaagatgaatagatgatatattttgcatttccatagatgaactgcttttgtggaagccttgtcagatgggactctgagtctcattcttctcatcccaccatctatctgaggactttatctccaatttttcggcaatggttaggatgaaagattgggaggattctagaaagtgtccactgtaccttggacagcttttacattatttaagaaatatataacttaaaaatgaggatatttcaaaccagggctgcccaaagattcccatttacgttacctctgacttgtcctttatatatcctgcctatgagtgtcccactctcattgctctccatctgtgtttgtcttttcctagttatgctgaaatcttcccttccctaaggtccataccctgcctcttcatggaattcttaatttcttgcacagaaattctaccctcttgcttccctcctgtctcttgttgaattttgcttgtagttttgctctgtatcttaccacccttttcatcagtgtccctatccatatacttctgctttaacttcaatcagtgaaagttagaaagccttagaggagattagtataaatataaatagagtcttctaatatctgaattaaaatgagtggtgatatcaatttcaaagtaattctttccagctacatttgcctcttctcatgccaactctaaaataatatctccctttggtcaaaagatacaaaatttcaattaggagaaataagttcaagatatctactatgcaacatggtgactacagttaataacaatgtattgtatacttgaacatcattaagagaatggattttaagtgttcttaccacaaaaaaaaagtatgtgaagtaatgcatgtattaattagttcaatttagcctatctgcaatgtgtacatatttcaaaacatcgtgttgtacactgtaaatatatagtttttgtcaattaaaaaattacatctcccttctcttctagtgcaagtttttactcac

SEQ ID NO: 9723 - DNA, 1040 bp, Homo sapiens
aataattttatcccaggagattaaacattctttggttcacatactgtcggactccaatttactaagcaattatttattaatttagccatcagagtttaaaacagagaatcactttaataaatgaagaaataatgtgaaaacagacatgtcaggttctcttatcaatgactttgaccagtgtatacaagataacagcatatcacttggttaagaacttttgaatctatttttgaccttgcagtggcctaagaacagttaaatgaacatttatttaacttaaacttttgctttgggagattaagtacagttcaactggaatagtgtttgttgcttatgcctttattgtttttatctgtatatctctttaattcttttctggattttttcagaaaaattgtctctactttattctttatactagtatttactcatgagaatcataaatggtaaatatagtccatgggaaaaacaagcggaacaggaagtactaagacaagctttgtcatataaagttttagaaaacatggtacaaactggagacttggacaaagtggcagacttagtaaaatatattaattagtaatgtaactaccatttaaatattctgagtatggaatttccaccttaaatatttgatcctataaaactgtttttttcaaacattgttctaccctgagaattgcaaaatatctactggcaggatatgaacttggaacagcagattgttctttttttagtagcctttttcctgcagatgtgactttaacagaggaagatgctgagtgttttttttttgtttgtttgtttgtttagttttgttttttttttttcttccagtacttcaggtgatcagcagaataaagacaatagttatttgctaaatgaaccttaggtaatttagagatagagggtgtataccatttaaaaatgtttgagattttctaatgttcttactaaattgcttattttctttgaaattcctctagggaaattttagaaattttaactcattcaattatgtcatctctgattttgggggg

SEQ ID NO: 9724 - DNA, 1055 bp, Homo sapiens
cgagaccacaaacccaccagaaggaagaaactccaaacacatctgaacatcagaagggacagactccagacacgccaccttaagagctgtaacactcaccgcgagggtccacggcttcattcttgaagtcagtgagaccaagaacccaccaattctggacacattaggacccctgtcgttcacgaaattacaagagttttaggagctttgtgttagaaccaggggcagaaaccaaatatatatatttggtttgttccattgaccactaggtcagtggaacagaacagcaaacccagaaatagcctatccaattacagccacctggcttttgacaaaggtacaaaaacaattcaaaggaaaagaatagtattcttcagaagtggggccagtgcaattggatatccatagacaaaaaacttagaccaaaaaaataatcttgacctaagactcacagtggtaccagagtaactcaaaatggataatagactgaagtttaaaatgtaaaactataaaacttttaggagaaaacatagaacatctttggaactaaaacttggtgaagagttcttagacatgacacaagaaacatgatctataaaaaattgctaaattggaatgtattaaaattaagaacttttgctgtgctaaataccctgtaatgagaatgaaaagactaggataaaatattggcaaaccaccacctgacaaaagacttgtatatagaatagataaagaactctcttggccgggcgtggtggctcatgcctgtaatcccagcactttgggaggccgaggtgggcagatcacttgaggtcaggagtttgagaccagcctccagcctgaccaacatggagaaatcctgtctctactaaaaatacaaaaattagccagatgtggtggtgcatacctgtagtcccagctacttgggaggctgaggcaggagaatcgcttgaacctgggaggcggaggttgcagtgagccaaggtcacagcattgcactccagcctgggcaacaagagcaaaacaagagaatatataaagaactctcaaatcac

SEQ ID NO: 9725 - DNA, 1066 bp, Homo sapiens
tgctacagaaaataatgaatcacaaaaagaactaaaaatatagtttattggctgatagctataaaagtatgtgttcctgaacgtttagtgaagatgacagtaatagttgattaatgttgactattcattggaaaatgaaattatgggtgatataggaatcatatgcatagtgacagcaatagacctatttaaatataaagaggaagatgggcaaaaattacctgcaaagctagaaatttcttctgtggtagccaaagtcccccagtccataattttatgttatactcaataatttaatttatgaaaaacagtagaaaggttattcaggaaatcatcacatttcttctaaatctaaaagtttcttattgtagtaaaagttgtacatttatgttttaagttaaaatgaacagagatgtttatcattttttctgatttcctacatttgtcaactagttggagtaatcagattaacctgctgtatactttgcgatctataaggaattatgtgaatgggagttattataaccaagaaaataagctctatgcagtagtaacatttgaataccacttttaccattttcaaagatattttgggtgtgctgtttctttgactttcaacaacatggggaggaaaggaatcctaattaaagatatcaatggatatatggaaccttgtgctcttcctccctaatcagcgaaaaaagatggatccagatggctgagcgagcaaagagatgccaagggattttctggttagcattatagaacctctttagaactagattactggatatttttagaggtataaagtattgtgtatgtatgcatagatgttttcaaatgttattgcgtccctgaaggcaagagactgtgtattttggaatataagatttgataacatatagacatgttctccaagggaaatacatgtcaacctttagcatagaaagttgggaagaaccttctacttttttaggagtcttacaagaaatgctgactggtgtttctataatgatttcatgccaattccagaaggtttaagtcatatgtgattaataatttaata

SEQ ID NO: 9726 - DNA, 1060 bp, Homo sapiens
ctgtgcttaatacgtttaagggggaagaagacttagtatgtggcagagaactagaaactaggaattacatcaaatacgagaactgaaaaagtatgataactgaaattagcaactcagaggattgacttagcaacacattgagtattgttgaagaaaattcgtgaactaaaatataggccagaagaaaataccgaaactatttcatagggattttcttaaaaaaataaaaaatacagaaaagagttgataaaatgatcctgtatgtggaatactttccagaatctccaaacactactaaaactaattaaggatttcttagaagttgcaagataaaagatcaatttacaaaaattatttttgtataggatagcaataatctattggaattcaaatttatatgtaaatgcaaaagacctacactaggcaaaacaactttgaaaagtaagagcaaagtttgaagacttccactaattaacttgaagacacattgtaatgattaaaatagtttaatactgtagacaagatagacgataaacaatattaatttaatcaatagaactaaatagagaatacaaacatagacccatacatatatggacaaccgatttttaaaaaaaatgtataaagattattcagtggagaaaggatagtcttttcaacaaatggtgcagaataactgaataagcatattaacaaatgatcttcaatccatctctcagtgtattaaaaatgatccaaataaatcatagacctaaatgtaaactctaaaattataaaacttccttctttcttttttccctgatcaatctataaattttgttgatcttttcaagaccagctttcatttatttttttctgttacttttgttaccactttcattgatttccattctcaactttattattttcctccttctgcttacttttgggttaatttgcattacattttcaagtttttaggatagaagctgaagtcattgattggagacctttattcctttctggtaaaactgtttagtgctataaattaatctttaagcgctgctttaactgcatctca

SEQ ID NO: 9727 - DNA, 1534 bp, Homo sapiens
gattccatttgtcaatttttgcttttgttgcaattgcttttggcatcttcatcatgaattctttgccagttcctatgtttagaatggtattgcctaggttgtctttcagagtttttatggtttggagttttgtatttaactctttaatccatcttgagttaatttttgtatatggtgtaaggaaggggttcagttttaataatctgcgtaaggctagccagttattccagcgccatttattgaatagggaatcctttccccagggcttgtttttgtcacgtttgttgaagatcagatagttgtaggtgtgcagtcttatttctgggttccttgttctgttccattgatccgtgtgtctgattttgtggcaatcccatgctgttttggttactgtagccccgtagtgtagtttgaagttgagtagcatgatgtctcagccttgttctttttgcttaggattgccttagctatttgggctgttttttggttccatatgaattataaaatagtttttttctagttctgtggagaatatcagtggtagtttaataggcatagcattgaatctgtaaattactttgggcagtatggccattttaacaatattgattgttcctctgataagcatggaatgtttttccagttgtttgtgtcatctctgatttctctgggcagtggtttgtagttcttcttgtagcgctcctttacctctctggttagctgtattcttaggtattttattctttttgtggccattgtgaatggaagttcattcctgatttggctctgtgtgctgattggtccatgtgtggccacaggcaggcctggaaaaagcaccatctggctggctgaacagccatcaatgaagttctcactctgagccccagacttcacccagaactgacgtgccaacttcacccaggactggatggcctggaccccaggcttcaggctatccttggcctgaaggtgggggtttcaccgaggaccggccccttcatgcctggtaacctttctgtcttccactgccatcgacatgctgtccacgatgcccaggctgttcgcgccgaggggcagctgcaagcctgcacccatctgtcttcaccccaggccaccctcccatgctcgctggttaccatggttaccaaagtccagaggtgggtgagtcagcaaagggctgtcatgtcagcaccaccctgagtgcacacacctggccaggtggcgacagcatccaggctcagccacagcttttctctgaaatcagagtgggcactgggagcgaggagaggccagggaacaggagcaggcacttccaagcctgtggggatagggggggcttcctgggcttccgagagtgcagggatgcccgggtccagagctgcagctgggcggctgcagctgtgcctggtagcacgggacttggtagggggcggggctcccacctgtcccacccccgtgggctctgtggaatgcacagccccagccacacgtccctgactgcagctggcatccccacaggggctcctccaaactg

SEQ ID NO: 9728 - DNA, 1050 bp, Homo sapiens
ccatttggtagtctttttagtcttcaaactgtctcagtgatactcagtggaaccaagatagattaaaggaagcaccgtgctcccgtaacagttatataaattaggattttggtaactgaactaagagcgccccactccaaagtgtaacttatgtgttaaaaggtcacttgattcagctactgtctttgactatcgattctattaaatatttccagtgctaaaatcttaaaggctgtgtgtttcttttgaataggaaatgtgattgatttcttttagtttaaagttttgcctatccaatttgtgtttggtatatatctggaaggaagagttaatatataggctggaataatggactgaaattaataaagtgaatttttttgaggaaatgtaaaatattttattataattatgtcctacaaaattatgatgtaagacctgcagttcatgtgaaaaagacctagatgttttattaataaggctggcatgagctattagcttatagaaaagctgatgcagtttttgactgtggaatatccaagatggtgacaatatgagtgggaatggagtatttaattgacagggtttggttggatgactaattgaatatggaatgcactgaggcaccaaaagttatctcactgattcaaatttggataactgggagagaagcactaccttgatagagtagtgagaagccagaaataatttcagctttgtccagcttgactctctaaatgaacttaaggtataacacttacaaagtaatttggtacagtggtcaatatcatggactctagaacagtcttgttgagttttagttctggcttctccacttggtaacactgtgaccttgggcaaattatttaaaggctctatacctctttttatcagtctaatggggataaacttcatatactatataccaggaaccattttaagcactctatgtatattaagtcatttgatccttatgtatctattaaatgtttccagtactaaaatcttaaaggctctgcatttcatttgaataggaaatgtgattgatttctt

SEQ ID NO: 9729 - DNA, 1098 bp, Homo sapiens
ataaagatcggagcagaaataaattgaaattaagaaaacaatacaaaagatcaacaaaacaaaaagttggtttttttgtaatgataaaattgacaaacctttagcctgagtaagaaaaaaataaagacccaaataaataaaaccagagattaaaaagaagacgttacaactgatactgcagatattcaaaggaccattagtggctactgtgaccaactatatgtcaataaattggaaaacctggaagaaatggataaattcccagagatttacaacgtaccaagattgaacaatgaagaaatccaaaacctgaacagaccaataacaagtaacaagatcaaagccgtaataaaaagtctcccagcaaaagaaagcccaggatccagtggcttgactgctgaattctattaatatcaagcttttaaagaagaactaatgcaatttcgactcaaactattccaaaaaattgaggaggagggaatacttccaaaccttattctatgagactagtattactatgatgccaaaaccaggcaaagacacagcaaaaaagaaaaccataggccaatttccctgatgaacattgatgcaaaaaatcctcaataaaatcttagcaaaccaaatttaacaaaatgtttaaaagatccttcatcatgaccaagtaggatttatcccagggatacaaggatggttcaagacacacacaccaatcaacgtgatacattttatcaacagaatgtacaaaaaccgtgtgatcattttaattgatgctgaaaaagcatctgataaaattcaacatccctttatgatacaaactgtttaaaaactgggtatagaaggaacataccttaacacaataaaagctatatacaacagattcacagctaatatcattatgaatggggggaaaactgaaagcctttcctctaatatctagaaggtgacaaggatgcccactttcaccactgttattcaacatagtactggaagttctagctagggcaaccagataagagaaggaagtctagggcatccaaattggaaaggagggagtcaaattatccttctttgcagatgatggatcttatatctggaaaa

SEQ ID NO: 9730 - DNA, 1058 bp, Homo sapiens
aaaaagtgggggaacaaagttaaagtatagagtttttatttttctttttgcttgcttttatgcaattagtgttaacttgtcattaaagtaattggttataggatattatttgcaagcctcatggtaaccttgaattgaaaaacatacaacaaatacacacaaaacaaaagggggtaaaaataaaaataaatgaaaacataccaccagagaaaattaccttcactaaaaggaagacaggaaggaaacaaggaagagaagactgcaaaacaaccagaaaacaaataacaaaatggcaggagtaagtcctgccacatgcatccaacactggagcacccagatatataaagcaaatattattagagctaaagaatagacaccagtacaataatagctggagacttcaataccccactttcagcattggacagatcgagacagaaagttcaataaagaaacatcacacttaatctgcactataaaacaaatgtacctaatagatatctatagaacatttcatccagcagctacagaatatatgttctcctcagcacatggatcattctcaaggataggccatacattaggtgacaaaaataagttttttttgtttgtttgttttgtttttgtttttttttgtttttttgtttttgttttttgtttgttttttaatttattattattatactttaagttttagggtacatgtgcacaatgtgcaggttagttacatatgtatacatgtgccatgctggtgtgctgcacccactaactcctcatctagcattagatatatctcccaatgctatccctcccgcctccccccaccatacaacagtccccagagtgtgatgttccccttcctgtgtccagctgttctcattgttcaattcccacctatgagtgagaatatgtggtgtttcgttttttgttcttgcgatagtttactgagaatgatgatttccaatttcatccatgtccctacaaaggacatgaactcatcattttttatggctgcatagtattccatggtgtatacatgccacattttcttaatccag

SEQ ID NO: 9731 - DNA, 1049 bp, Homo sapiens
ggtgaaaccctgtctctactaaaaatacaaaaattagctgggcgtggtggcgcgtgctatagtcccagctactcgggaggctgaggcgggagaatcacttgaacccaggacacggaggttgcagtgagacgagacatcgccactgcactccagcctggcgacagagcaagactccgtctcaaaaaaaaaaattaaaaaacaacaaacaaacaataacaacaacaacaacaacaacaaaaagacatagaaaaattagctggacatggtggtgcttgcctgtagttccacatacttgggaggctgaggtgggagggtcgcttgagcccaggaggcagagattgcagtgagccgagattgcaccactgcattccagcctgggtgacagagtaagaccctgtcttaaaataaacagacaaaaaaaaagtcaggtgattttgacaataagacttctttcttgaagttttgattgctgtaaatggtagccaacttgagatattaaaatcattatgtgaaagactttgtgatatgcaagaaagaatactgaactctaggattttatgtatctgtatgtttatatttatgtatatatagagaggtgtatatttaaatacataatttgcttataaaggacaacagcaatttgagagaacaccatctctctaggtcattcctgtaggtcatctctctaggtctactttcaaaggtacgtaaggaatgaatttttatattacctacccccccattttgatctcataaagctttttgtcgaattatacatctatacatccatacatcctaattactgtacgaaatatgtttacatctttttgcttgactttgaataattctttgagagtttccagttacggatattaccatgtatggtcatctccttgtaacttagcttaatttaaagtacctttaagctagccagaataacttgcaaatctgttgatttaataagatgaagtatttggtggcctctagtggtacttatgtgtctataaaaagtcaccaatgtacaaaattttagggtgagagttactaag

SEQ ID NO: 9732 - DNA, 1049 bp, Homo sapiens
aactctaaaaaaagccccaaaacaaaacaaaaatcccagaaaataacaaatgttagcaagattagggagaaactggaactcttgtgcactgttggtgggaacgtaaaatggtgcagccactatggaaaatggtatggagagtcttcaaaaaaaattgaaaataaaattaccatatgacctaacaatttcacttctgggtatatcctaaaagaactgaaagctgggattcaaacagatattcatacacatgtttatagtagcattgttcacagtagtcaaatggtggaagcaacctgaatgtccatagacagatgaatagacaagtgagatgtgatacacgtgtgcacgcacacacacacccccccccagaatattattcagccttaaaaaggaagaaaattctgacacatgttacaacatgtgccaacatttgttgtgttatgcaaggttcaacctgaaggatgaaccttggggacactatgttaagggaaataagccaatcacaaaaaaacacaaatactaggagatcgagaccatcctggctaacacggtgaaaccccgtctctactaaaaatacaaaaaattagccgggcgtggtggtgggcgcctgtagtcccagctacttgggaggttgaggtgagagaatggcatgagcccaggaggcagagcttgcagtgagcggagatcacgccattgcactccagcctgggcgacagagtgagactccgtctcaagcaacaacaacaacaataaaaaacaaaacaaaatactgtgtgatttcactaatatgagagacatagagtaatcaaattcatacaggcaggaagtagaatggtggttgccaggggctggggaaagggaggaatggcaagttgtttagtgggtatagattgtgaattttgcaagatggaaagagttttggagtttagttgcacaacagtgtgaatgtacttaacactatctgaactgtccacttaagattgttaagatgataaattttgtgttatatatattttactgtagttaactttttaaaacagtatgaaata

SEQ ID NO: 9733 - DNA, 1068 bp, Homo sapiens
acaaactaacatgtgaagaattcgaaggaaccagccatgtatgcagaaaggggagtaaaccagtttgaggggacagcctattaaaaaaactttaggtatgaaagaacttggtatgttcaaggaattgaaaggatgcttctgtggctggaatatagtgggtgacattgaggctagaattggatgaatgacgttgtggaggtaggggccagatcatacagatcttgtaagcttagtaaggagcttagattttattaaaagtgcaatgggaagcaaatgaagtaaagtgacatgatctaatttattttggctgttgtgagaattatggatggggagtggggagactaataagaagtgatggtggctggatctagtgtaaaagcaatagagattgagggaaatgtatgcattcaaaatatagttgaccatttaacaacatgagcttagacaacatgggtctacttatacatggatcttttttcaataactatattggaaaattatttggtgatgtgtgacaatttgaaaaaacttgcagacaaactgcatagcctagaaatattgggaaaattaagaaaaaggtgttgcatgaatacataaaatataagtagatactagtctatcttaccataaaatatacacaaatctattataaaaagttaaaatttatgaaaacttacgccacaaacactgtagactatacatgacaccattcagttgagaaatgtaaacaaatgtaaagatacagtattaaaactgcataaaatatactgaagtatatactgtagtattgttaataattttgtagctgcctcctgttgctattgtggtgagctcaagtcttgcgagtatctgcttaaaataccttaaaataccatatgatgccagtcatctccaagtgaacagtttatctctccagtaagttggatacgatagttaaaaattctcactcttgattatttttcatcatgtttagttgaataacactatgggactcatacacagtgccactagcgatgctggaagtgttcctgagaaacagacaaaagtcatgccattacaagaaaaagt

SEQ ID NO: 9734 - DNA, 1028 bp, Homo sapiens
acattattatgtttgttagaagtttgttcccttttttgctgaatgatattccattatgtgaatcaacaagtttgcatatccattctattgatgaatacccggactgtttccagtgtttggcaataatgaataaactgctatgaatattcttataagtgtttttgtgagtgtagtttttaatttcttttgggtaaatacctagcagttgaatttttgggttataggtgggtgtatgcttagttttataagaaacgaccacatcttttcccaaagtggtataccatcttatgtctccaccgacaatgtatgagaattgcagttggctgggcacagtggctcacgcctgtaatcccagcactttggggggccaaggtgggcagatcacctgagcctaggagtttcagaccagcttgggcaacatggcaaaacccgctctccacaaaaaatataaaaataagttgggtatggtggcatgtgcttgtagtccccactacccggtaagttgagacgggaggattgcttgagcccaggaggtggaggttgcagtgagcaaagatggtaccactgcactccagcctgggtgacagagtgagatactgtttcaaaatcaaaacaactacaacaaaaagagaatttcagttactctataatctcatcagtatttggcatcgtcagtctttttgattttagccattttgaggtatatgtactagtatctcattgtgattttaatttctagttttctctgctgattaatgatgttgatcagtttttttcttctgctctttggtgaagggtctgttcagatcatttgcctattttataattggattgccattttattacagagttgttactacttacgtagtggtgcttaaatattggctatttttttttcttttctccctctctccctccctccctccccttctttcttttcttttttgaggcagggtctctctgttgcctaagctggagtgcagtggcacaatcacagctactgcaatgtcagactcctgggctcaagc

SEQ ID NO: 9735 - DNA, 1050 bp, Homo sapiens
agaaagtaaagtgtggtttcttccagcattatgtcattataattcacacaaattaaaaaaaaacttgaatttttactatatctgatacttccagcttcataatttttctttgggggataaaaatgtgtaattattattaaaaccatataaaatatgaataatgtgcttattttcttttgtctgaaatgttgatttattgtgctgattttttttatttaaaaggataacagaagattcttgaatgatttatcaattggccttcaataggtatagaaagaaggtatctataaggaggagattttaagattctaaatgtatattgtatataattttttaaaacagggaagtagtacaatttctttaggattaaatgttgtattgaacactgataaaatatttattaattttaaagaatgtcattacttgttaatgcaagtttttttttcgtcttatatggtagtaaaattatagactccctgaggatccttttatcctcaggtaaagaatctgagacctctggtgtcatagctctttgcagaacatttagagaaagcatcaaccaattatttttgcatagatgaactattaagttgaattcagcaggtataggatatttcattaatcaaggactcaaaaaaatcaaggatacttggttaaaagtttttagctttcaatgtgtgtgtgtagtgtatgcatatacatctatgtatttacattttagttgactgacagttgtcttttggaagttacggtttataaaataaaataatttatacatacatagaaagcataataaacagatcactaaactcttttctaccctcgcatcagagagcagcccctaagaggcttatagtctattttataaggatgagatgtctgtggaaagataattatcatattgccaggtgagtgctctagacagtaagactaggttcagaaggctgagggtgacaggaaagggctcatggaagtagtttattttgagttgcactttgaaggattggatgaggctttttttcctctacaacatttgattatgaaaaattt

SEQ ID NO: 9736 - DNA, 1052 bp, Homo sapiens
tccctattctttcaggacaaatgtgacggtcacttcacagtgacatgacttgtcttttaactaaggacagccagctgaccgctgaaggtgatcttgtttcactttaatgtgttttcattgttctttttatttgtcacagaattttcgtcgtaaggaacaattgggcaaatgcattgtattttacactttaattgacggacttccacaacttaagagaattcagggttcatgcacgtttatttctgtatttgtattctcttgtattactatgtagctaagcataatgtaataacaaattgagctgggaaaccacttctattttagggcaattctagtcccacatttgcaaggaatttgagatatcagctctacagccccttcatttttcagagatgctgagattgtgttttcctgatggttacagccattggtagctcagaataccattgttctacccactcttggtccactctctctttcattattcctctcctaagaacttcctctcctttagtgggaacctttcatgttcttttctctttcaccagtcatgacctgattgaggtcaattgttaaagagaaagtttaaatgtttaaacttctggatccaaaattttatttcctagtaatttggcatagtctgatgtttcttttctatcaagattaagtgtgggaaatcagttttttaacctttagtttttagtgacattgttccgcctccccccctccccacttttaaacaattttttttttttttttttttgagacggagttttgctctgttgcccacgctggagtgcagtggtgcgatcttggctcactgcaacctctgtctcccgggttgaagcaattctctgcctcagcctccggagtagctgggatttacaggcgcccgccaacacgcccgctaatttttgtatttgtagtagagacgggatttcaccatcctggccaggctggtcttgaactcctgatctcgtgatccaccggcctcggcctcccaaagtgctgggattacaggcttgagccaccacgcccggccaacaatgttg

SEQ ID NO: 9737 - DNA, 1058 bp, Homo sapiens
tctttcttgaggcagcacggcacagactctagcagcaagttgcctgtgttcaaatcctggctccactcctgtgtgatttttttgacaaatcaaactgtttcctcagtttcctcatcttctaacagaggttgataactgtagtatatgctttataggatttttgagagaattaaaagacataagatgctcagaacagtgcttgacacataataatttgtctataagagttaactgtcattattattgttactatattctatttattgttttcaatggctgtgccctctggaattcctccaaacaaatctgttctcttttccagcctttcaaatatttgaaaacagtcatcaaattctcactgaaccttctgttctcaaggataaacacccccagttcctttggcctttgtttatgtgggtctcgtctacatactggaggctttcccagatggtcttttctctgtcagtatgtgtgcctttcagagtatgaggcatagaaccaaatattccaatctacaggtgatctaacaggaacaaacagcacaagactctccttccttctggtcactgtgctgctaagaaggtagcaaaaagttaagagaactttgtactggttccactggctatttctgtatctcccattcttttatctctctccacaatgctcttctttgtagtcctctgcttctcacttttaaagtccagccttcagaatattctttcactctgtacagattcagttatattctctgctactgagaaactcagatacattagacccatatccatctaggtttttattcagttttcccattccaattcagtgacttccctcttttccctgttactaacgtataacacttaatctattaccacataaaagatttgtcttttataatgcttcttagacctaattatctctcagatgaattgctgaaataagatcctaaccagttttcctctttctagactgtccctcatactgcactcccaatttatcttcctgaagtaccatatcagttggagttcacttccccttgattatacactgattgtagt

SEQ ID NO: 9738 - DNA, 1297 bp, Homo sapiens
gaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccaggtaagagaatgctgacttgtttgttttgtttttttaatattatatctagagatttcaggtaccttgagtggatttatgtaggtcagacagtctgattgtcctgctcagataatgataaacattaccacagatctcacctataaagagagatttataatttaactactttcatttgatccgtatgttgagtttttttcatttgctgggttggttctctattctgctacatggatcttacatacttggggacatcatttgtgaagctctgctctctggacaggacaacttggtaaaatgaactattagatgatgcaggtggctttgtctcttcagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactaggtaagacgaatggttttctgcatatggtaatgtttcatgtactggaaaagaagcgtaggagactaagagttgtctcttgagcaagaaaactcactgttgggttctaacaagacctctttctgtccagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggtgagaggacttgtatcagaagaacggcgtgaggaagttcttaaacagaacactaaataatgggcttattacttttttctttttttttttttttttaaggcatgttacttcgcttttttgtgcacttctatgacatggaaattattgaagaagaagctttcttggcttggaaagaagat

SEQ ID NO: 9739 - DNA, 1141 bp, Homo sapiens
atcatgcctcccacacaatcgcagtttggagagatgggaggcaagtttatgaaaagccaggtaagtaatatttgagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagctgcaaggacagtcgaaggatatgccacctcggttttctaagaaaggacagcttaatgcagatgaggtacatttgcctatgttacttatataccatagtttgtccattcagaaatttattgcccgatgattataaaaagacgcgttattaagaggactttatgctggagttcttgacgtttttctctcttttctatacttctttttctttctttgaatgtccagcgtcctgtgagcgaagattatgagatatgagggcaagtctcctaaagtctgttagagcaagaaaactggttgtcaaaatattgtggtttctttctttgtaagggtgatttaactaaggataaaacagggcattttctaaactgtagttaaatttgcagttttttatttgaatattttagtcatgctaattctaagagaatgtaagatttataatagtatcttactactgtatgcatcagatctttaaattttttgccaaaaattaaacctgttaatgtggagtaccttctttagtttttcaaaaagcttaatgtttccctagattctgtcactgtataggattttagaatgttgtatttaatatgttcgccaactgcatgttgttaatttagatatattttgttttcaattccagattagcctgaggcctgctcagtcgttcctaatgaataaaaatcaagtgccaaagcttcagccccagataactatgattcctcctagtgcacaaccaccacgcactcaaacaccacctctg

SEQ ID NO: 9740 - DNA, 1443 bp, Homo sapiens
ggaacagagagccattgctaagatcaagatgttgggaaacatcaaattcattggagagcttggcaagcttgatcttattcacgaatctatccttcataagtgcatcaaaacagtaagtgtgacagggaagttaggcgaatgtagtcagtcgtttggaggaaatgagtcaattattcatctaagagggaggttgactagttaaatacagatgtgcaacaaaatttactaaacagaataatttgaaatacgtggtgtgtttgacaaagtagagttagaactgatcaaccagactggtagaaagccctatactagattctgtaggaactgtgaatgagtcagtgcaaacataaagggaaagaaagtactacgcctaaaccagagtaactaaaactttgtcaccatggccttttattcttgtagcttttggaaaagaagaagagagtccaactcaaagatatgggagaggatttggagtgcctctgtcagataatgaggacagtgggacctagattagaccatgaacgagccaaggtacgtgtgtagctgatgaaagtagtacaagtagtttgtctttaaatcaagctattgatttttgtgacatcataagggattgccatatttagccattaactgggttataattttagaagtcttaaagctgtaaattgaacacatttgctttagctcttccaatgaatgtattcttctcttatcagtccttaatggatcagtactttgcccgaatgtgctccttgatgttaagtaaggaattgccagcaaggattcgtttcctgctgcaggtaatactggtttctttaaatttgttggtaagctgagtttttggtttaggaatattaaaataaaattatttttcaattaaaggataccgtagagttgcgagaacaccattgggttcctcgcaaggcttttcttgacaatggaccaaagacgatcaatcaaattcgtcaagatgcagtaaaagtaagattgggttttgttttgtttgtcacatagactctgtgtgtgtagaatagaatgggtttcctcctcacccaccccaaacgcttgaggggtctgtctcatcttagtggtggagcttaatgtttttagtgtctcgtcttccacttttatttttttattttttgagacggagtttcgcactgtcacccaggctggagtgcagtggcgcattctcgattcactgcagcctctgcctcccaggttcaagtgattctcctgcttcagcctccccagtagctgggactataggcgtgcgccaccacaccccgctaattttttgtatttttagtagagacagggttccaccatgttggccaggcttgtcttgaactcctgacctcatgcaaaccaaggcttgggcctcccaaagtcgggggattacagatgtgagccatcatgcccagccttgtctgccatttttgg

SEQ ID NO: 9741 - DNA, 1044 bp, Homo sapiens
cattagaaagtgtttattggcagccggtacagtggctcacacctgtaatcccaacaacaactttgggaggcaaaggtgggagggtcgcttgaacccaagagtttgagatcagcctgggcaagacagcaagaccccatctcttaaaaaaaatgttaattttcaaaatgtggttccacagcgttgatactgggaatatttactagacatgcaaattcttaggccccaccccaaaccagtgaaagcagaaactgggtgggcccagcaatctgtattaacaagcccttcaggtgattctgatgcacactactgttccagaagcactaatttccagagttggctttcttggaggggaagtcgagaaagcctaaattacttttttctatgtaagagaatttatgatgtttaacatttggtgtgtgacaataagtgtttttgctgatttttattaatcagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagagggtaagtttcaaggtctgttttactaaaagatgggaagtgtggattagctgtgtttggtgtgtgtgctgtattactaagaaggcaaggttcatgcccagagtatgtatgttttaatgaatcctcatggtagcaatttttaaaaatatcttgaactggccaggcactgtggctcacgcctgtaatcccagcactttgggaggccgaggtgggcagatcacttgaggtcaggagtttgagaccagcctggccaacatgttgaaaccccatctctactaaaaatacaaaaattagccggacgtagtggcaggcgcctgtagtcccagctactagagaggctgaggcaggagaatcacttgaataccccacaggtggaggttgcagtgagccgagatcacgccactgcactccagcctgggtgcagagcaagactgtgtctcaaaaaaaaaaaat

SEQ ID NO: 9742 - DNA, 1050 bp, Homo sapiens
acgcacagggttcgggggaggtaagggtgcgttttcttcccatattcccggtgagaaaacgaggtcgagggaaaaggggatgatacaactggagcatggcatatggactcagtgaacaaagggactggagcaagaagcagcagccacgccaacgcagactcaaaagggctctccggctttacgcacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtgagttgagccgctgccgccgccgagtggagcgctctaaaatggccgccgtccctggtcgcttcttctcgagtggtacaaaatggcggccgcaggcggagccgggtggggcgacccttttttagcatttcctctgcgcttcagatacctggaaagtcttggcttttgttctctcttcctgttgctgacggagtagaaggaaaacgtcagtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcgggccggcagggaaggccaggccgttggcgcggg

SEQ ID NO: 9743 - DNA, 1081 bp, Homo sapiens
aaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcatctctggtatttgggggatttaaataaaatgattccatttttttatactatttagattttaagaaggctaaagaatcaaacgttttaaacatattgtgttattattggtatttctttacattgtaattttaaagagttccatgatcataactgggaaataatgatccccaagataaagtcccagtcccttaacatatctcttcaggatctaatccctaccaatctttccgtgtctactctgcagctctccaatcccatggaacttcttgccattccctaaacatatcacactgttttatcgtttcaggtctcaaaaagcgattctgtccccatcttactttctggtaggctcctatttgcttcaacactttgacttgtaggtactttcattctctgtatcttcctattttgatgctgtttcacacttgtatttaatgtttgtgtctgtctcaactgtgaact

SEQ ID NO: 9744 - DNA, 1079 bp, Homo sapiens
ttgtgttgaagtacctggttgaggttaaagatcatgagtttgtggtggatttaatttacccagttccatgaattttctctggtggtgctagcctccagggaacaggtgtggagaaggtgaacaaggctatagaggtggggtttacagggtgtaaaaggcagaaaaagtaaggaatttaaaaattgaagctgctagcaagagtgccattattaaaaattgggcgcagcatttctagggagaggtcaggaaagagtggtaagtatagaaggaaagaaagaaaattattattccaaaggcctcaattaggttgatgagcaggcattgggaagtaagagagtgggtaatcaagattaataggtgtgtcattttgtgttgctataacctgaggctgagaaatttataatgaagagaaattcatcagctcatggctatggaagctgggaaggccaatatcaaggggccagcatccggtgagggccttcttgtggtgtcatcccatggtggaagtgtagaaagaagggctagagaggggactaaacttgtccttttacaaggaacccattcccttgatgatggcactaatccattcatgagggcagtgctccagtgatccaaacaccttccattaggccctacctcccagcaccaccacattaaggatcaagttttcaacacatgaactttgggggacacagtcaaaccacagcaaggtgattgggcaaaagtagggcaatggagtattagacttcagaggtaaagtagtttggggcactaagagctggggtctaggtgtgggtgggctaaagtggaacacagcataccaccccagaattgaggccacagtgcaacgtgaatgctgcccagtgtgatgtagaggaagctgtgagcctggtgccaaagaccttgatggatgtagctgactgcctggcacttaagtgagaagaacaacatgggcagagggcaatggtgtctgatgtctgattcttacagaggagatgttttttacactagggtggaagagtggaggtgtagaagaggcaccaggggagaggagagtgtcaactccaccttgaatcctg

SEQ ID NO: 9745 - DNA, 1025 bp, Homo sapiens
tctataattcattcccccattcaaaatggtcttgcaaaaccacacccaggagagtccaggatatgaacagcaagccagtgacagagtataagttgcaagagttccatctccctaatggcatgtataccgtgccctccccgaaggcacttcctctttcatttgaagcaggaagtggggaggttttcctatgatgtcccttgcaccaagtgtagaagtagaccttcaagaagttgggtacttgagttgctgctctttggtcccgtttcttagtagggtatcaccaactttttaggtggggcagttctttactgcgtgggactgtcctattcaatgtaggatgcttaccattctttgaccctgacaccagcagtgtccctacaagaccaaaacatccccatacacctccaaaaggcctctggaggaggtggtaccactcctggctgagaatctgagacgggagagtaaataaagaagctctgggatttgggaatggctggcggcattgagcgtgggtatctgaataatgtttatatcagggcaacttaaggaaatgcttgtctattgcaagacagttcctaaggagatgtgttcagaatatatcacgggcataaatggattcttatatttgattttcccaagtaacccaattgttaccacattgcctttgtcccagatgctttttctgaaatcggtttgttgctctgcattagccctgcccgggtagagctttggtggagtccttgaggttagcactgtcttaatatactgggaatttaagcagagctgggccctctaaatcaatcaccagaacagctttagtttttttcttgctcaaaagtgcactattaaatgcagaaacacgtatgggagtggaggttggcttgggtgaaggacactttttaaaagaaaaattttataacaattttttctgcaggaaaaaggacttgctggtcttgcttcttgtacaactgggctacggaatagatttacatctccgcagcatttttagcatccttggaatatgc

SEQ ID NO: 9746 - DNA, 1124 bp, Homo sapiens
gacattctgaaggatttttataccatgtaggctcttaagctaagaaattcctaagggctcttgcaccctggaattctatgactttttaattcattaccttgtccaaatcaaggtaacggcttgtagcagcataactccacccttcacatgacattctccatgtgtgtgtctgtgtccaaattgctccttttttatgaacagcattcatgtgccagatactgttcttggccctgggaaatggatgaaccagaaaaaaagtgactgtccttgtgaagctatattctggtgctagcaacagactattctctattttctaatcttcaaatcttcaccacagccaagatttgaacttgtttctctcttgagcattgcatatggggcaacatttgagcttcatgacttggatttcagccagcaatggccaagaatggtgaaggtgtaagaagggcaagaaggcaggactgcaggctggccccgttcatcttgctgactttgtaagacggttaagcaagtactgagtgcatttgaggaactgagtatctgtaggcattttctaagtaagacggttaagcaagtactgagtgcatttgaggaactgagtatctgtagacattttctaaagaaaaacgtcaaaataaaatggagagattaaatgcaaaagtggttcatgtcctatggggaaataaaattatagcctttcatgtgatcttttctacacagacagaaatctaggagttagcatacaacttcatagtgtctgagagagaatcaaaaggtaaatagcaaagtcaagcatgagtacattctcttggaaaattacatactcttggatgggcccgttaatgtcccaggataatattaaaaggacaggccacttcccctctttgtttttgccttatttctaggtttcaggtatttttcttactcttttcacaaagtttgttgaaggtcgagggacactccaggccactagtgactcagtgactcttatgggtcacagcctgaccatctgaccttttcccctgcagaagtttcccagggcttccgtaacaaagtaccacaagctgcgagacttaaacgacagaaaattactgtctcacaattctgaagcctagaagttcgag

SEQ ID NO: 9747 - DNA, 1049 bp, Homo sapiens
ctgctggaaatagaggttacccaggaaatgtcctattttgctcacacagtcccctgaaggctggctgggaggctctcctgtgcagcttttctccaagtagtgacttggggactctgattgcttctcttgtgggttcagcatctttgaacttcaagttcaccctggcttaaacatccagcagatggtggggtggggagtagaagtgcacctaaggagacacactggatagtcacctgccttccccgggaagtggcagaggccatgtcctctctcatctcatcgatttgcaccctcctgactgcaaggggtgcagggaaatatggaggagcacccaggtgtcagtgagcaataggggtctctgccacacctttggagaccactctactcctggctcagtttcccaacccctgtatgtcagagcctgacgtcttcctttttccaacttgtcttgagtcccatctggcctgagtttgaacaatagtaatcaggcctgttggctgatatgagatttgaggtaaccacgaataagcccttcttggtcagaaccattaaagataacttctagtctcaatgaccacacatttgcaaagcagtcctcctggaatgtccttccctgaactcctgtggcccagtcattataggcagagcactgggtccaaggaaaagccaggccccctgtatgggatgggccagtttgctgagaatgacacattactgttgcccctctaacttgaccctgggtttcctgtgggtaagcagctgtttcagcaaatcccagattcctgcaaaacagccttttaagtttttcttcatggaaagcttccagacattccagcccagcttgtctctccttggaattctgcccaatgaatcctgctgcctctgatagttatgagggatccctttcaaacagaggaactgcttcaactgtttgttagggctaacccaaatgttcagaccccttcagggacaccttccaagaaaaagcatcatttttttttccaagcagcaattccacacagaggactcttcggaagtgttgattgcaa

SEQ ID NO: 9748 - DNA, 1267 bp, Homo sapiens
ccacagtgtgaagaaaacaggtctgaaacaaggtcttacccccaagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagattgggttgtatgctggcaagtatgatctttcggaaggagccatttttccatggacgtgacaattatgatcagttggtgaggatagccaagtttctggggacagaagatttatatggctatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggccatggagcacccctatttctacactgttgtgaaggaccaggctcgaatgggttcatctagcatgccagggggcagtacgcccgtcagcagcgccaatgtgatgtcagggatttcttcagtgccaactccttcaccccttggacctctggcaggctcaccagtgattgctgctgccaacccccttgggatgcctgttcc

SEQ ID NO: 9749 - DNA, 1048 bp, Homo sapiens
tcatttaattctcacagcaactatctttggaatttatcacttttatctccatttcatagacaaggaaactgagtgttggaaggtgaagtgaattgcctaaagtcaccagttcagcaaatgggaaatgtaggacttgacaccaagactgtttggccccagaggctatgctctgaaccataatgacttcctgtcttccaaaaggcaggctcttggatccatatcttactgtgcttctaaattatcctgtgaccctgaaccttagtttgctcacctgggaaatgaagggaggtcctggttaggttcccttcagttctactctattgcagtatgctgatctcttttgtaaatctgtattaaatgagagtttgctatcggtgactttcagagatgacaccagtgatgatgcccatgctgacgattcattctgatgtctatgaaaagagcaaatcctttaagagaagatgtagcataccagtgtttataatctgagtttcatttgattaagaggggaagctctttagaacaaatatcatttctgagcgagagaatgttcagcatctcagcctcatttgtatcatttgataaaagggccccactgagccaagtgtgaggatgatgcttgagccagacacatagacaccagacattcctctgatgtctgctccccaggcttggccacattgcctcccaccaaccccatctcaatgacacatccattacctgccatcagttggctctatggtgctgggaatgacagagtgtatctaccctggatttcagaaagaaccctcctggcttatcatggcaacaccctttggacactcgtttaaagagtccttctttgggccagtgttatccttttgggggcatctggtatggacggccaatttgaatctgactgggacatgctaatgagccattcatatgtgtgggatttgtttctgattcgattaagcttcagagagaggaaagaaacagccactgattagagacataaaaaaagaaatactttaagtgagtaagtggttcatcttcatataggaaagta

SEQ ID NO: 9750 - DNA, 1027 bp, Homo sapiens
aggatgatggttgaacttctgcctctggatgaaagttggatgttttgatgatcacatatacttagcagtttactcatcagcaattcttgcaccaaattctgctcttagatgcaggtctggccgatttctcctgcattgcagaactcccagttcgcagatgtccattgtctcttccatatctgggacagatgtagtgtcttgccaaatctctgaagtcctggatatatttagtatccccaccctgcctccatcatcctgttcttcacccctttggcttgtgggatgatctagtcttattgctgcagtcaggcagggagtaaatgtacaactcagtgattccattcccatcaggtcatggtagaattcccatccacagagcccttatggacctgaattctttctgctgttcatttattcatgtgttcactcagcccatcaccaggtgcattctgaatttctactctgtgctgaacttcatacccagtattagggatacctgatgagcaaagcagacacggccctaaccttgtacagcttatagtctagtggagacactgacgtttgttaaatgatcacatataaaaacatgttgcaatagcatgtacatggcatgaaagaaaagcagaatctgtgagagtctcacaggggactggactccagcccaggaagggaattggtctttctctactgggttatgtacgtgttctcagggagcaaggaaccaaacctatgcaggtgaccacaggtggttgggattttttgaaggctgatgaaggcccacaatcacacaatgagaagccacacaggcaggctctggaggaggcagcgtggttcaagacatcctggacagctccagcctgccatcctctttgccccacttctgctgtgtttctaacagtgacttcatgtccacgtctacagttcactcactgacaacgcccttcttcctattcatcatttctgctcccctgcgcctcacttatcatcttcttaggatctcctacattcaacccctccattgtccagt

SEQ ID NO: 9751 - DNA, 1050 bp, Homo sapiens
ctcatgggaatttgcagatgaattgcctagtggagtgcagggggctgtttgggtggctcagctgctctctcagtcctgagcttactcaccagctatgcacagccacccagacccatagaaacctcctgccaggattccattggagtttccctctggaagcagtttgagcaaattccattagattggaaagtcggtgctgaggaacttggagaagatgatggaagacagcatttcctatggcacatcagtcctgggatgtgtccacaaagaagggctccccagtcacatgaggttgcccagggctgtaggtacatttcactcttggaggttcccaagaaaggcctgagaagtcctgagtcaggaatcattttcccctaaccaggattaagcagtaattcccttagccatttcaccacagaaccttctatcacatagcacttaataactctgcacggaactagggttctgtagagcacgctgtgagaagtgctgatacagggatgaagggactcatctggagagtcagggaagactctggaggctgaagccagcctctcaatgtcacttctctgctctcagtgatccccagtaggaaggtgccactgcattacagaatcagatctcaaaaccagtactgggaccaggtggtgaccagagactgctcagagcctctttctaaccagacactagaagcagagtgtctgatacgttcacaacgtgcttcatggaccactgcagctcagaaggcagtgtgagagataagagaaaccactacctggaaccaattcagaccattaggccagaggaagatggacagataactgagaatgaatagatttcaccattatccaagggacagagtagaactcagaatgagatgccccaaaagaacaaataacagagactgagggtcagttattgggatatgactgaggttggggcgaggggggcgagagagagagaaagagagagagagaggaaggaaggaagaaagaaagaaataaagaaagattgaccccttcttttagtttattttgtggctaccaccca

SEQ ID NO: 9752 - DNA, 1054 bp, Homo sapiens
gtgtggctatgccagaataatagtgcatttaggttgcattatccagttctagatgtgccagacaaacctctgacaatccgcgttggagtttcattagggagacccaggcccagccctgcatgatttggagagaacacaagtcaaatgcagcacagggcttcttggttacatctgccaggacagaccttctgagcacaccttctggaccttctgggctgtctctgacgcacaagtcagagatggttccatggaagacttgcatttccttgtaactctggtcacaccattggccatttgaaaacaatagtacctgtccctataggcccctggactgggctgagtgctctatcactgagcctccattcatttcttatgtgtttaatatttatcatatttggcatgtattatatactgttattatacatgtgagacactgcatacacattacatagatatcttatttaattcctaacagccttaggaggtaaggcattttcttagtctattttgtgcactgtaacagaatacttgacactggagaatttataatgcacagagatttattggctcatagttctgaaggctgggaagtccaagatggaggggccaacatctggtaagggcctttttgctgtattatcccatggtggaaggagtgtgtgtgtgtgtgtgtgtgtgtgtgtgtgtgtgttagagagagagagagagagagagagagagagagaatgagtgaaggagaagaggccaaacttgcccttttataagaaacccactcccatgataatggacctgctcctgcaacaatgaaacttctcccatgataaaggcattaatgcattcatgaagtgaatgaccccaggatgcaaacacctatcattaggcaccatgttccaacactgtcacattggagatgaagtttccaacgcaggctttttgggggacacattcaaaccatggcagccatgttgtgaggcagtatagagtagtggtcagacccctgaggctagagccagactctaagtgtttaaatcccagctctgaccaccgttggctc

SEQ ID NO: 9753 - DNA, 1034 bp, Homo sapiens
gcttggctgtgcctttcatcactgaggctcccgaggactaaagcagccagatggttctgggcattacaagttgctgcagggtgactgcaggaaacctcaataatacataattttgtccctgaaagctgagctgagctttaaatgcttgctaacctgtactgataaggaaggccataggggaggatgacttcctttcagaggagtgaggatggatggctggcttctctgactcggagattagatcagtaaggcctgggctagaggatttactgtggaaagggtccagatgtgaaacagtgggaagaaagcatagacagaacttgaaggcatgcaaatgaaggagagagagcaggtacactggattcagggaggaagcagcaagagtttgcaggaggaagcgagtgtggtattaaatcagaatggggacttctgaatctggtgaggaggaaggcaatggaaatcttagtgagaatgctttcattgggatgtcggagactgaatccagatgatgtggcattgatgggggaggaggtggtaaggcaatggaagctgtaatatgcaacccaggatgatgccagctcctattactttgtggtgatggcctagagctctttgctgagcaggttgtttctgggtgacactggagagagtgctgtgattgattacttggatctgctgtgggcataggagtcagtgctggtatgcatgccatctgcctgccatccttcatagagattcaagaatctggtaactcacactgttatcttagtgtggtctgtcctttcctgtcttcttgtttttacttaaggttgatattcataatatctcacaaccaatccatgactaatcatagcagacactggctataaacaaccagttgcctggagtgtgtgtactacaaaatatcatgccatttactctgcctggaacatcctttccctgtgttcatctactgaactccactcattcttcaagccctcttcaaatgtcatcccctcaaggtggcattttctttaaactttgctccttttcct

SEQ ID NO: 9754 - DNA, 1028 bp, Homo sapiens
ataagtttctagaagttggagtgaaatctgaaaccacatcagtaaatgttttatattctgttacatcaaaatctgtggtctgccttgtactttgcttatatcttttatccaagcatgattttgtaatattatacattagtcatttggaaaggataagctcacagagttaggcagatcttctaaatgtggacatattttattatacagtgtgaaaaatcacttccattaatattaccatttatatcatcagaagtctttaggtgttgggaagccgtcaagctcatagtggtggaggcaagttttccataattataaattttccttaaaagcttggattttatcactggggaaaaatattatcacttattttccttggagtgacaagactttgagaaaagttcaccaaattcccaagtatgaataattatgatttgttcatcagttgttcttttaagtgaaaatagtgtttcatgaaaaaagtacgtagttcattgtccacctcgattgtataagctctttctcttgagacaaccttcatacttcagtctgcagcagaagtgctttatgtgtatgtgtgcttataagatagcactgactaataggaataatttacactgtgactcattgggtttgcttctttgctctccacactcctcaggaatctcaaggggcaaacggctctctgtgggtgtttcactgaagactcgcctctcggtccttacgtgttcagacgtgcttctctgagctctgcctccatcattcactgctgagaatatggccagttgaaatgcactggagaataggaacccatttctcttacggcatctcccatcagctttccaacagtaacctgatggctccaaggttcctgtttactttgatttacttttccaagactttaaaatacaaactgtccccttgtgtttgcaaggtgttatttatttatttttcttcttccctggacataacttccaggcctttcctggcataggtcagtgtctatcctcgagcttcctgtccccagctgc

SEQ ID NO: 9755 - DNA, 1075 bp, Homo sapiens
aggtggttttagtgaacacacagcagtgtctgccacatgaccatgctgcattggttattacatatttgaatatcacccctaggtaaagtcacaaaggtagcaagtggcagagccaggagtaggacctaggtctgtgtaacctcagatctggattctttgcagggcctctcatactcctttaatggctggctcaggttctgcacctctggatgcagtgggtgttgtgattgcctatgtggactctctttccaggcaccaacaattctataaaacatgtgactgctctccctttcccttccatggactatctgggctacaaatttgagagtaggttgttgggaatttttgtgagcagccaactcaggatcaggtctgtgaagctcctggcttatgtggtgctcagtggctctcttgggagtgaggggcgatagacaaactgtgtcactctccccaggagggctgggctgtcattagcattcagcaaggctgtgagtcttgttgtacaaatcagctgtttaaaggccttaaaaaaaaaaacccctaaaactgctgaatgcctctcgtggttgaagctcttatgagtatggagctaacagtttcccacgactgctgaacagcaaaaggggagccatggtgtagtgttttccttttgattcatatttggagtcatttttagcaatacggcaaaatgtgaagatgctcttggaatgtgggcatttgttacctttgacaaaggagattgcttgtatttttgtttgtctgttttggtttttttctttacagctcttgatcttgtttattcagagaagcaagaaggatctgttggtttcataaatgtgcttctattcttgaaaaaatgctagagttagccacttctccccccacttcctcactggtctgtggcaggagactcaagttgcaaactaacgcagccccctttccttcctggcttctccctccactcctatgggggtcatcagggggaggggcagagagctaaccagcagagtccaaacacattatctcttttgtctgggtttcagagtcagtttattttcttccatcagttgggaag

SEQ ID NO: 9756 - DNA, 1051 bp, Homo sapiens
aaaacactcaataaactaggaattgaagataatttcaacaacctgatgaagaacatctacaaaaaatcccacaactaacatcatacttaatggtcaaagactgaatgaccattaagatcattcagtatcaggaacaacagaagcatatctgctgtcatcacgcctatttaatattataccagatgttttaaagaaagtaaaactatctctgtttgcagatgacataatcatgtatcctagggaatccactaaaaatcagttagaactagtaagtgagttcagtgaggttacaggatataagatcaatataaaaaaacaaattgtatttctatcactatcagtgggcgatctgaaaacaaactataaaaaatcatgtataatggaatcaaaaagaataaaatgcttaggaagaaattaagaaaaaagtgcagaaactcatactctgaaaactacaaaacattgttgaaaaagttaaagaagacctaaataaatgggaagacatctcatgttcatggactgcaagacttaatattgttaagatggcaatacttcagatatctttatcaaaatcccagctggcttttacacagaaattgacaggcttatcttaaaattctgatggaaatttaaggtatacaggctagccaaataatcttgaaaaacaaaaacaaaatggacaactcacatttttttgatctgaaaatgtactgtgaagctacagtaattaaggcagtgtgatacaggcatgaggacagacacactgatcaacagaatagaattgacagtccagaattaagtgcttaaatttatggtcaattttattttgataaggatgctcaaacaatttaaaggggggaaagaatagtcttttaacacatggtgctggaacaactggatatctacatgttaagaataaagttgtcccccatctcactctatccacaaaaactaactcaaaatggatcatagaactaaatataagagataaaatcatagaactcttagaagaagacaaacctaaatctttgtgactttagattaggcaaaggcc

SEQ ID NO: 9757 - DNA, 1049 bp, Homo sapiens
agtcaagaggtatattgtaagcttcagaccaaccactaagaaaataactcaagaagtagagttaaagatattctaaatgttcttatcacaaaaaagataagtatgtgaggtgatgagtatgttaacttgattgaatcactttacaatgtattcatatatcaaagcatcacatcatacactgtaaatatatataatttttattggtaaattctactttagtaaagctgggaaaaaagaaatgttaaaaattattaaggaaattaaaatgtacaagaaaatattgacttagtgcacaagaaactaaggaaaggaggaacaaaaaatatatgagatatagaaaacaaaaagtaaaatttcagatataaacccaactatattaatattaacattaaatatgaatggattaaatgatccaattagaatgttgagattgtcagattggatgaaaacacaagatgcaactacacactgtctacaggagacacacttttgattcaaagatataaataatttgaaagagaaaggatgaagaaagatacacaatgcaaacagtaattgtaagaaatctggaggggctatatttaatatcagacaaaattgacgttaaaacaccaaaaagttactagagataaagagcaaaattttataatgataaaaggatcaatccataaggaggatatagaaattataaacacatatgcaccttaaccacagaccactaaaatacatgaagcaaaaaatggaaaaacttgacagagaaatatacaattcaacattaatagttggagacttccatactttctttaaataatgggtagaacaattaggcagatgtactaatgatgatatagaagacttgaacaaaagtataaaccaattagacctaatagacacttataattcactccatttaataacagcagaatacacatttttttcaagcatatatggaaaattatccagaatacaccatacactaggccataaaacaagcctgaataaatttcaaaggattgaactcatcctttaaaatgaacaaagtacattct

SEQ ID NO: 9758 - DNA, 1736 bp, Homo sapiens
tttagtaataacaagagtctgggacatttgagccataattgcccttcctcccccaattccagctcaataaaacagaagctctcctctggacagatatggacaagaagacggggtgctgctttcccacaacttccactctagggctatatttctctcccagaagggccaggccaccaggatttctcatgtctcccagctctgtgttgcagagcatggttgagtggtctggggctgcccctacttacagggtggaagctttaccctgtgttgagaatactaggccctgattgcccctatccctggctcacatgtagggtggaggtttcataacaggagagacaattcaagaagatcagtgactaccatctccacccagcaccctactcatacagcagggatgtcactctgggagaaagaattaggctgctattcctacttacaactccagagcagtggtatagatattctgcccagggataggggcaggctgtaggaacacagagatttgtagcttttgactttatttggaatggagtatgaggaggtccaagcataaaagcaatttccgagcatttaagaggaggttagtagctccataatagcaacaaaacaaacagagtaggccagctagacgacctagcacagtaagttctcctatcaacacagtaatgctgttgataggttcttagaaattgtgactttaagcaaatcaggcaggtcctcaaataacgtcatttccttcaatgttgttttgttataacattgatgagaaaaaaacaggttttgttatatgttatattttgcttaaagtcacagtttccaagaatctattgatgatgttaagtgaggacttactgtagtttaacagacataatcaaagaaagagacatttcctatggtcaaagaaagcctcaaaaactggcctcaaagaaaatccctgccaaaagaacccccaaacccaaatttaattggatcagactgtggagcaatttatgcctaaaggcaccgttgaaaataatagagcaatcaggtagcaactagtggaggctaacagctggaggtgaaaccaatcgggcagtccagccagaaatgtaacagggagataagcaatagagacagttaaaaggagctctgctaaaatcactgtcatcctagggggttcgatagggagaatcaggacactgtgcacatgcctaaggtttcaccttcaagaagtagtattagagactacacactgttgggggaaaaggacttcactgaagtagcccatccaatgcggtaaacaagtaaacaagtatatagtgcaacaacaagaagtccttgggtgggggattaatcagtattcaaagtgtctaaaatatagtatctaaaatgtctggttttcaacagaaatttaagagacatcaaagcagatcatagaaattgtctttcaggggacctggatgtgagacttaccagaaaaagacagcaaagtagctattatatatttgttcaaagaactaaaggaaactatgctgaaaaaattaaaggcatcatgaaaatgtcttaccaataggtaataccaataaaaagatataagttatgaaaatagttaagtggaaatttgggacttgaaatgtttaagaaatgaaaagaaaaaatcactggggcacttaaaaatatatttgagttggcagaagaaagtatcagcaaatttgaagatagatcaatagagattaccacatctgaaaaaaaga

SEQ ID NO: 9759 - DNA, 1024 bp, Homo sapiens
ctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctga

SEQ ID NO: 9760 - DNA, 1860 bp, Homo sapiens
ttcagtatagactatgccgcaaggtttcattcccacatggaagtacgcatgctcgtttctcctgagactgcataaagtctgaacattccagtttcccttttaagtcacttcatagccctagcagcagtttagaaatgcaaaagtttggttgctttaaagaatagttcttgagtggattcttaattaagtacaataatattttctctttgattttaaagagctttactgcccagaatggatacacaataaaattttgaaaggaaaaagaaagttagctgtatcccagttttctaaaccctggcaagctggcagagctagaattagctttacagatggcatttggcaacatatctacatatctctaagccctcaactcctgcgttttgttatgcctgtctatcaattacaatatccaatcactgctcagagatggagaaatgggacgatcacagctcacacgatgctgttttgttagaaacgtcagtgctgcacaacccacggctgagtcagtgtctgtgagaaaataaactgaattaatatgtagagggggttgtatctctgaatatttaaagcctaaatattgcaacagcattattacacagtagagggaggaagctaaaggaagtctatggacaggtgaggtagggggagactggggaattttctgattgttcagaggaatcttgaagatgatggaaatatcagatgtgctaaagtttcctagtaatgcccaaggatgctgacctggctttcagtgcttcattgtttgaaagagcagagtccctttatactctgatttcaaaatttttttcttgtttttgtgtgtctaccttggcatatactaaaggaaggtgtgtattcatttattacatgatatctctgggttataattatttacatatatgaatttgaaagaaagattgagagggatatgtgtgacctttgtttcattatgatcatttacatgactaaagataaagatcatatgtctgattttcagtttaatggcaagttacttaaaataaatgaaatatgtttttattgttttcgtgggtttgatgctttgtgttttatttcaagtaacttgagaatgcattgtgtttggtactgttttttatgaatatcattaaaaatttatttaaggagagagtaattttgcaataatatttttgatttatttgaaaataaaattcaagataaatgaaataattgaaattttctaaagaaggaattgaatatatttttacatttgaatgaactaaggattaactgaaccatttatatatagtactttacagaactgaatgtacttaaatgataaagctctaattggttaaagtgactttctttcaagtcaaagaacccagaaactgaatagatgatctaactactgccactgaggttttggattagtgagtataaattttcaaccagacaaaatttctaaataaggataatggtttttcctgtgagattttaaatcttaacaggtgatattgctcactttattaggaaattttacaacaatttaaaacattttgactaatggtttttttccttctctctttattacccttatcctgctgatccttaatttttttggacatttgggatatacagcattttacatttactttgtttttaatgtatttatatggtttataacattctttccttgaagtgtcaggaagttcttttaatttcccccatttaatttctaaaagtttgaatggtcatcttatggttgtcatgacttatttatatagttctgttcgtggtatcttgtattgactttttttgtggtttagggtccagaaatgtttttgtcagcttattaaatagagttataaaagcagaatc

SEQ ID NO: 9761 - DNA, 1055 bp, Homo sapiens
acctcctgtaagatggttaactgcgagacattcttgtttcttacttagttttccaaattgttggagtttctcttttaaaagagaataattattagagagactggtgggattatgaaaccataatactgaaagtaactttaaaaccattaatactccaatttttggaagagaaaactaaagtgcaaatcaagccccttaactgattttgatcaaagatattggcaggcagtaagacagctgagactagaatacaaatccacaagtttcctgatttggagtagtttgttccagtgattccccctagtgggttgcatgtgcttttggggatatatgaaaaacttgttcattgtgctgtatgaagaaaacaatagaacttctatttattttttactgtatcctttttaaatttccatttcgtgtgtgtgtgtactatatacataatactggtgtgatagtatatgtgcattgtttataaatatacatatatacagctgtccgtgttacttgaactcaacatattaagaaaaggaaaaactgccatattttaaagtggtatggcatctttgatcatctttgcttccctagtgaatgatattatttaacagtagactggaacagtttttttttttttttttttttttgagatggagtctcattatgttgtccaggctgaccttgaacttctgggctcaagtgatcctctcaccccagcctcccaagtagttgggattataggcacataccgccacactcagcttgaatggctgttaattttgaaactgttttatgatgagtagtttgaaaaatttcctataaaaatagatttatttggagtaatttctttctgactgtaaaagtaatgggtattacatgcaactgggaacatttagcaaagggcaaagaagaaaatggtaccataatcccatgactcagtgataattgcttccagtcagaaatatatgtgtgtacacagatacatacatacacatatgaatattacatacaccccttattaatttatttggagtatgtaagtcattatgtggttcaaatat

SEQ ID NO: 9762 - DNA, 1031 bp, Homo sapiens
tgaggtttacgtgagataaaaagatatctgtagaatttgagtggttgtttagtattaccagccatctggtcccttaagatatgccagtcattttgtttattctgctaaaggtgtaggaagaaaacataggtaaatgatttgcttaactttgctaaaatatgaaagtaggtaaatataacaacacttgaatctgaaattaaatagcacagtatgttggcttagacagtggaatttcatgatatatctgatttcaagttccttgtcctcaactcagccctgtctagagatcaactgtctttgcttttttgtctttaccatctttctcctggcttaccttggttgttccctctttttcccctccttttagttgcttaattattaatcgttactattaatttgagaaaataacttattatacttaaaataatagatagctaagtatatcaatccagactcccatctgtcagtacttttgaccagtgtgccccctacagcctcctaggaaaaagaacccctcctcaaatagtagaggatcttaccacatgtggcgttatctgtgccttatgtgcgtctaaaagggtttagatggtgaatgtaggtgtaggtactatgagggtttctcggttttgacaggtcaattttgttcaggctttatcgttagcatatagaacagaggtatgcactaaataagtatttgttgggtggatgaatctgggtgccagtgagttaagacgttgtattaatgtgatgattctttttacataatagatgtttgtgaaaacaagttttgcttctgtaaacttcattaacttgacataactctgagcactgaaatgtagtttattctatttggaaatatgtagtactagatgagctcatacatgttattgtgaactgctgctgctacctgtgtttttgaactgagtcttactggaagcttccaaatgtagttctgtgaatttgttgcatcagatttgccctggttatttaaaacaaaacatgtctgggaagtgctaaaatctaccaaatca

SEQ ID NO: 9763 - DNA, 1030 bp, Homo sapiens
caagtagcttgggactacaggcgcctgccagcatgcccggctaattttttatatttttagtagatacggggtttcaccatgttagccaggatggtctcgatctcctgaacttgtgatccacccacctcggcctcccaaagtgctgggattacaggcatgagccacaatgcctggcccaagaaaatgatatattatcttaatgctaagatttggaaatgtccactgatgaaacttggtatagaataaattttcctgctaaatctcgttcaaatctggttataaagttagagtgaaaaaatttgttcttcatttcaaatcaatataaactgtttgaaataattaagaatatggcattgcttacattataaacctagcatagacagttcatctattttttttagatttaattttgtttttttttaagaccatttccttgaggtttctaaacctgattatatttattgatgttgcccagtggaccctgcctgtggctcttctcagttctttctagtactagaaactctatatgtcattgcatctgggaaataatggcaaagtagatgtgcattgaaggagttctcttcctatctctcgctgacttttgcctcacccctatatgcttcctgtcctgaatatagaaataggatctttctcaaaccttctcatggtggtagctccagtaaaggaataggtaggagacctaggataggtggagatctcctgtagggtaggcagtggcagattagggaagggaggagggtgtatgcccactagaaccccaaagaggctctgccattatcagcttgggtctatatgagttatttttaagttgtctatacaccagattgaggatccctagcccaaaaatctgaaatctgaaatgctccaaaatctgaaactttttgagagccaacatgattccacaagtggaaaatttcacacctgatgtcatgtgatgtcacagtgaaagctttgtttcatgcacaaaattacttaaaatattgtataaaattatctttaggctatgtgt

SEQ ID NO: 9764 - DNA, 1033 bp, Homo sapiens
cacagcgggtgaaaaataaaaaggaagtagatttggggaaattaaaattccttattttcaaatagtttttcataaaattttataagactttataagcctgcaagtgtttaaactagctttattcgcatgtaataatttcttggattacatccaaaactctaacttagttggataatttcaaagttaccactaaaggcctaagttattcggtgttaatactaaattaacttcatgtagagaatggctttcatttaaattgcagtatttggatttttttctaagtcactttaatgactgaattttctgttaattctttacattggctagctctaacacttcagtaacatttaataaaataatatttttagtatttagtttgcaggctaatttattctcacttgtttctttacccacttactgaaattttattagttaaaacaattttttggtaacattgcacattcatcttttttgtaggggaggggaacaaggtcagttgtatattaatgccggctgttcatttgtattagtccattctcatgctgctaaaaggacatacccaagactgggtaatttataaagaaaaagaggtttaatggactcacagtttcacatggctggggagacttcacagtcatggcggaaggcgaaggaggagcaaagacacgtcttacatgacggcaggcaagagagagtgtgcagggaaaccgccctttataaaaccatcagatctccgagaacaggatgggggaaaccgcggatgattcaattatgtccacctggtccctcccatgacacgtgggggttatgggaactgcagttaaaaaagatgagatttggatgggaacacagccaaacaatatcaatgttatatggctttttttaaaggtcttttgtctctaccccacatctgaaatgtattgtttaaattgtttattttgctggtatttaagtattcttgtttttatattatgttgtgtttacagattcttaggattttgttggaaaagtgtaaacatcaggaaaaattggt

SEQ ID NO: 9765 - DNA, 1750 bp, Homo sapiens
gccacagagttttgaaaaaagtatcagaagcagtgtgtatgcacacactgttttgatttcctctgtgggatggttcttggctaatccctttgaaaggaagtatcagaacctgtctgtccattgcatgcaaggctgggaaggaaagcagtagccacacaataggttacaattagaacactgaataagaaacaaggaagaattccttccatgcctaagagagatgcataaccttagggtgaccatatgtctacttgcctaggaaagtcctggtttatgcctgttgtcctgatgtaattattattagcatcctctttgagtcccagtttatcagtaacttatatggtcaccctacttaatctttcagttctttttttccttatctgtagagagagagcagtgcctggtatatagtaaatgtcatgtaagtgcttgctgtcactgttattatgattacttgacctatcagcaacccttatctttcgctccttcttaaattattttcttctcttggcctcctggctaccattttctttgttctcttcctacttttagctgctccttctcagtttccttgcctagatctttctcattttcctgacctcccaacagtgaagtaccccaggtcccagtctctgttgttttctctgtctgattcgtcttgtgacaataccatctatctcctgactcccaaatttgtcttcagccccaccttctcagtgaatcccagactcatttctgtaggtgtctaataagtgtcttaacagaacatgtacaaaaccactctgtattcttcctccattctctaccccaccagcctgttgcagcccaataaatggtaccaccattcttacagttaattaggcagaaaaacttggcatcatctttgagtcttttctgacagactctgtatctacatccagtttatctgcaaatgctgttggccctcctttggaagtaaacacggatctggccactttacacctccattccagtcacctcccttcaagctgcaattttcttttcatgatttattgtaatagcttcttaagtagtctctgatttcacccttgacctataatccagtcttctgactgcagccagtattacttttcatatgaaagtcagaacattttattcatctgcctcagaccctctagtggttttcatttcactttgaataaaatctgaagtcctcactctggcctgcaagtctccgcctgcctccctgttaattttctgaactcattaaccactctctcatgtttgttgttgtagctacactggctgtcttgctgttcttcagacatgttacagtactctcaccgcactgcctttaacttaatgttccctctgcctggaatgatactctagatcacagcatggctcactccttcagttgatccaggattcccttctccagtgtcacattgtgcgtggagccttctctggctatcttatgcagtatcatatcctcccctccaactcctgctgttgccagcccccttcatttttcttcagagttcctatcacctctgatgtattatgtttgcttatttattgatggtcaatacttcaagaaactgccagccctctaagagcctggggattagatcctcagctcctgacacaatgcttggcacattataggtgttcagttagtatttgtagattaagtggggtggtgagtgagcctagggaagattcttgtggcagttttagcagtttagtaatagaacatgtgctgtggaaa

SEQ ID NO: 9766 - DNA, 1050 bp, Homo sapiens
ttgagacagggtctcgctctgtcacccaggtcggagtgcagtggtgtgatctcactttgctgcaccatccacctcccaggctcaagcaatcctcctaccttagccttccaagctgttgggactataggcgcatgccgctatgcttggcctagtttttttgttgttgttttgtttttgtagagatgaagtctcactatgttgcccaggttgatctcaaactcctgggcttaagtgatcctctcatctcagcctcccaaagtgttggcattacaggtgtgagccactgtacccagccttctaattattcttgaatcaattttgagtttgtatttttctaggcgtatgtccattttgtctgtgcttcatatttattgcataaagttgttcatagtattctcttttaaatgtctcctctagctgtagttatgttcactatagtctgtcctttagttctccttagcagtgtttgaagagatacgctttttagtccatctattgaatttttaccattaggttatattttttatttccataagttctgtgtgtttcctcttaagatcttagtggtcattctttaactttttattttttaaattcacatttgtcttgattggattgatggtcattttttatagcctcttgctcacttgtttgtgatttcatttatttttaacatttaatccggaatcttgatgggtatggctgataaaattttaacaatggttgttatgtacttccctaataagttcaagataaattagactgtgactactttaacacatagatatagatctggattgctgtatttagccaataacatacgtattacagaggaattacttgttggatgattaaggttttcttaggtaaataatttggaaaaaatgttatttgtgggaaatataggaagaaagaaattaaacatcaaggaagagaagcaggaaatgttgctagctgtgtcttcctagatggaatgtgtttgtatagcatttgatatttctttgtgtttttttttttgagacagagtctcctcacattgtcacccaggct

SEQ ID NO: 9767 - DNA, 1027 bp, Homo sapiens
aggcacacgccaccacgcctggctagtagttagttcttttttattgtttggtagtatttcattgtatgatataccacaatttacttgtctgcttattgatagaacatttgggttgtttccaatgttcattaactgtgaataaagctgccccagacattgatgtacaagtcattgtttggacttacattttcatattgcttggataaataccaagttgtgattattgggtcgtatggtaagtggatgtttaactttgggaaacaggtggtttcttataaaatggttgtaccattttacattcccagcaactgggtatggaaattccagttactctgggtctttaccgatactgggtattttagccaatctaatggctgtgctgtggtatctcattgtggttttaaatagcttttccttgacgactaatgatattcagcatctttttatgtgcctattggccattggtatagctccttttgtgtgtctgtatgtcttttgtctcttttgaaaattggattgctttgtgttactgagttgtaaagtttcttaatatatttggaacacaaatcctttgtcagctgtgtattacagatagtttcttctagtccatatcttgccttttcatttgttccttcccttttaatacttacatcctctttctgtagtagacttgccagaacttttttttttttttttttttttttaagagttggggatctccctatgttgcctacgctggacttgaacttctgggctcaagtgatcctcccgccagtctcctgaatagctgggactatagatgtgcgccaccatgcccaggccagaaccttataacaaaatagttcaaacaaaatgaacacagtagataaccttgttttgttaactatttttttctacatcgtgtacaatggttttaaaattttttggataagttatataagtatcctattagtgttttcctttaatgttatttgcaatgtaattttaccagatgctgttttgatatctgtagaaatggatcctcttt

SEQ ID NO: 9768 - DNA, 1035 bp, Homo sapiens
ctggacaaagggatgattcattgtcctgggtgagatggtgtgagatttcatcaggctactcagaatggtaaacaatttgaaactttatttctgaaattttccatttaatatttttgaactgtggttgactgtgggtaactgaaaccaaggaaagtgaaactggggataagcaaggtactgtagttttctttgatcagcacctgaaagatactgtgccacttcttctgatccccatggtttctgatgagaaatctgctgtttttctcctgtaggtaagatgtttttcctaggctgctttcaatatttttttgtcttttgtttttagaagtttaattatgatgtgtcttggtgtagatttcattgggtttttcctctttggggtttattcaacttcttgaatgtgtaggtttatgtcttaccacatttgggaagttttcagctgttatttcatgtactttttcagctctattctccttgtcttctcattgtgatcctctgataacatggaagttagatcttttgtaacattcccaaaggctattgaggctctgttcattgctttcttttcttcagtgtgttttctgtttttcagatttggtagtttctactgttgtgcattctagtttgttgattcttctgtcccttccattttactgttaagaccatccactgagctctttattttgattattgtattttttagttttaagctcccatttgtttctttgtacttctgtgtctttactgagactttcatttctttgctgagacttttttttcatttgtttcaagctgttgaaacatttttatggagactgccttaatatgtttgccagataattctgacatctttgttatctcgatgttggtgtctgtcgattgtctttttgtcatttggtttgggatcttcctgttccttgggtttttcttttgaaatctgcacattttcatattttgttgtgtggctctgtatttttttagactgggttagctggcttttttggataccactctggcaggagaaagggaagtgct

SEQ ID NO: 9769 - DNA, 1018 bp, Homo sapiens
ctccagtaactgggagtacaggcgtgcgccaccatgcccggctgatttttgtatttttttgtaaagatgggggtttcgccttgttgcccaggctgctctcgaactcctggactcaagtgatctgcccaccttggcctcccgaagtgctgggattacaggggactactttatttttgttttattttattttattttatttatttttgagacagggtctcactctgtcacccaggctggagtgcattggcgcgatctcggctcactgctacctccttctgccgggtagaggcgatccttccacctcagccccggaagtagctgggactacaggcgtgcaccatcatgccccgctaatttttgtattttttttggtagagacggggtttcgccgtgctgcccaggctgttgtcaaactcaggctgagctcaagcgatctgcctgcgtgccttggcctcccaaagtgatgggattacaggcgtgagccaccacgcctggcctacagggaactactttaaaattatcaagtgacttaatgtgaaaaatttctgataaccactgcgaagatgttttatgacgaagcactttgattcatttgaaagttaattaagaatggagtaggaatggtgaggttgcatattagtaattcaaatttaagttttgagtctttgggttatttccttactattatgaagcctaagaggtgtgaaaatagtatggaaaactttgtcttctgtttcactattagtctgtaatttttagtttttaattttatatttagagacaattgtttattttgtctccttcctcaaatcattgcaaagtatatatttagtgtctatttctttgtagtgagagtttcagaaagaagccattggctgagctgattatccaatgaagttgtctgacatgagttactttagtttgtggttttagatgaacagtacatggtgcacagctgttgctcaaacagctttgttccagctgtcttactggcctgtcacaaaataccccacattcc

SEQ ID NO: 9770 - DNA, 1024 bp, Homo sapiens
ttatctttcttccttttgcctgctgttgaggagtctgctaataaaattaatctcgctaaaaagtgtttaacatgaaaagcaaatagtctttcagtatctgttcttgcaaattagccttaactaaaaatcatgtaagtagtttggtaatttgctgttataaattgattagagtagcagttctatagccaatctgataggtttagacattataggtaatattccatcccttctatgtatgaccaagagcttaccatttaatctagtgcccgaaaaaggctttacaaagttcatggtctgttgaggaactttgtccctttgagccttgacttttattagaaatattctatatgaggctgggcacggtagctcgtgcctgtaatcccagcactttgggaggctgaggcaggcagattgctcgtgctcaggagttctagaccagcctgagcaaaatggtgaaactccatctctacaaaaaatacaaaaattagcccggtgtggtagtcccagctactccggagactgaggtgggaggatcacttgaacatgggaggttgaggctgcagtgagctgaaatgacgcactgcactctagcctgggtgacagagtgagaccctgtctcaaaaaaaaaaagaaatattctatatgcttcatattgaatctctgtgaagttatctctattgggaagtactgataccaacctacagcttgttggattttatagatgttatttagtttcttggtgtctactctttccaacctaaacagttggaacaagtttttaatatgacatactggtgattcacagctttctcatagtaagatttatgatctccttgacttttttttcctctctacaggtgacagttaacaccaacatggttgatttaaatgactacttacagcacatattaaagtcaaccaatatgaaatgcctgactccagaaaaggtaaaatttgactaggaaattcagaaatctgatggaatggtagagtaggttcctggccttcctgtatttcctctagc

SEQ ID NO: 9771 - DNA, 1030 bp, Homo sapiens
aagggaaaacagatatataaaataaatatgtgcagtatgtaatggtaagtactgtgaaagaaaaaaataagtaaacctgtactaagtaaggtaggaatccataaagggatttggtcagttctcagagtggtgggggattgggagaaaagcttagaaaaggcttcatggaggagcaagtgctcagtagaagactacagatagacaaggatgcagttagaataaatgcaaatgatttgatacacttggagttcagaatgggttggaggatgatggcaggaaaaaaatgaagttaggaaggtttgtggaagccatattttacttgtcatgctaaggatgttagactttatctgtggagagaggaaacattgaggaattacaaatgaatgacttatagcattatatctttttgcgacagtactatagaaggttgattggaagaggcaggaagattaactagtagagaagcccaagtgagagatggcagaggacttgagccaacacagtagtggaatggagagaaggatgaatataatattaaggatatggttaatgattgaagaggaagtggctagagtaacactcagatttccagattaggtttattgggttgtttatgtcatcatcataacaggaaatacaggagagaagaacaaactttagagagacataataggttaaatcttgagcaggttcggtattaaagtgcctaaagatattcaaggacagtttgatgtgagtctgggacacaaacaagaggtctaaactagagataggccgggtgtggtggctcatacctgtaattccagcactttgggagaccgaggcgggcagattacctgagatcaggagttctcaagaccagcctggccaacatagcgaaatcctgtctctactaaaaatacaaaattaattgggcgtaatggcgcacgcctgtagtcccagctaactcgggaggctgaggcaggagaatagcttgaacccatgagacagaggttacagtgagccgagatcgcaccactgcgctccagcc

SEQ ID NO: 9772 - DNA, 1077 bp, Homo sapiens
attgagtaataaatacataatagccattcagttaatttaaaagttagttgatgaggttattatgtacaaataagtcggatttatttcattttagaaggatgagtactgttttggttaaaatttcaaggaaaggaatgaagaagaggaatacgacttaatgaccatctgctttgtgttagacactgtccaatgcatttttctattaggtaaaatgtgtagaaagaattaagatttccacttagcagattaagaaactgaggtccaaagtagtaagtggcagagtgagaattcaaaccctggaatatccatctctgaagcccctattctacctactacattatcctgggaaggaaataaattgaaagcagagttcccagttccaaaaatcccattagggtaatgccttttttagagaaacaatcaaatatttaaagataattttgcttgctgttgatactattactaaaatgatgtttccaattgacttttagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacaggtaatttatggcacatataccctgccagctgtactacttttattattactcttgtatgtaagacagtcaaatgatttctttcctcttgcttttgcaaccaaaatgaaaatctttgccatttaaggtacttgagaagcggaggatgtttaagttcttccccctaggaattgtattgatggttttaattctctgtcccttccagtgtttttatggaaataactgttctgtttaaactcaaattatttttactcagaaaatgctaagtgggggtaactgaagatatttgagttttgttgtttattagcatctgaaaacattttgaagatttttcaatttctaaatgatggaataaaattgtgcatttttctattaagtaaattttaatggtgaagatggtgaaatctttgcctaaaattttactgaat

SEQ ID NO: 9773 - DNA, 1048 bp, Homo sapiens
agttgtagtacagtgtgctactacatacttctctgcctttgagttttggatccagaagatttttagtactataaattcttcagtatgcaatgataatggtgtgaaattttagatagttttgcgtaaaatactttatgttgcagagtttttaggctaaataacagtaaactagcattttatctttaatgtgtcatccttaattctaaataatgactactaatctagaacatttgaattacctcccagttttccagatgatatcttaagaaagattctaaagttttacagcctgcctgcagaactatgatgagattttagaaataatccactactttagttttcagcctttttgagtatgacgtttctctttctaatgttaaaaaagttacatatttatcctcccataatagtagttttaactttgttaaaatgcacacaaatagctaaaagctgttttgaattcaaaatcaattaatagtatgtatttacattttgaaaaatagctatatgtgttttgaaacacgtttacttggtatgactgtagattcatggagcctgcattaactcaattggttaggaaccagaaatctaatccagcgccttcatattatatataaagagtctgatttccagagataaatgacttgagcaaagacagattatttggtggagaaccaggtggagaaccttgtcacttgggtttgtacttttattaccattgctgatactgaagtaagaaggtacattttattttgttaattgcttttaaatttatgtgatgaattttcttttgaaataattgtgcttttttttaaaaaaatttttgattcagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtg

SEQ ID NO: 9774 - DNA, 1048 bp, Homo sapiens
tcgggaggctgaggcaggagaatcacttgaacctgggaggcagaggttgcagtgagccgagatcatgccactgcactccagcctggccaggtgacagagcgagactctgtctcaaaaaataaaaccaaagatattgttatgtttatcattgtggaacatgcacctgttccacaaatacaaaccactagttggcttgtattcagctaaaaaaataaatattctgtattatactttgggagcaatttaagtaattttttcaatgtgatttttagtcttatatactgactttagaacttaaagtcctccccactccagtaatactcaaccccactgtatatacagttcattgtgatgccctttcatgtttagtctgttgtactcacatattccatttagtctgttgaataattacaaacagtaaaatcctaatgatgttttataaagcctgtcactttgatacaaagatactcaattcacctggaatttattgagcatgtatgtgtgcagctctgaagaactggcatggaataaaaggcagtggctgggtgtgttggctcacgcctgtaatctcaacactttgagaggccgaggtgggaggattgcttgagttcagttcaagaccagcctgggcaatatagtgagaccccatctctacaaaaatttttaaaacttagcctggtgtggtggcacacacctgtggtcccagctactcaggaggctgaggtgggagaatcacttgagtccagagtctgaggctgcagtgagctatgatcatgccgctgtactccggcctgggtgacagagtgagactcttgtctcaaaaaaataaaaataataacgtagatgacaggattcaggtcctagttctaactcagtgtttggccattacatgatttggggcaagtccctattctctaggccttgactttttagataccacaatttctatggtccttgataaaatgacaaggtctttgctctgcatttataatttaaaggcattcaaaattatataattacatcttagagtaaaacagcccaaacaaag

SEQ ID NO: 9775 - DNA, 1030 bp, Homo sapiens
agatagatagtggggctatgggtagaaatagttttaaggctattcaggtaattatgtgagagatgatagtgattgcagcagagtgacagagttaaagatgaagagtagtggttcaattttggatatcttttgaaattacagccaaaaaagtttgctaatagatttgttatagggtgtgaggggggaatgtctccaaggttttgggcctaattaattggaatgaaagatttatgatttactgaggtgaagaagatagtgggaggaacaggttttagagtaggcgttggggaggaaggtcaggcagtcagttgcggacatgtaaaatttgaaatgcctttttgtctaattgacggtacagagtaagcagttataagcaacacgtggagttccatggagagtggtccaacctacatttcaaatttttgaagtctttatatagaaatggcatttagagtctggactggaagagattcctaaaggaattgaatagttagacaagcattgtgaggactggaccaagaacactaacctttagcaactgggagatgagttaggtgttggcaaaaaagactgagagaggtggtcaaagaagtaggaggaaaacttggaaaatgaggcatctttggaggcaaacgaataaactttcaaggaggaggggcaatgaagttgtcactgaggacctgacaaaacaggcttaatggaataataaggcaaaaacctgatagtggaatcaggagagaatgggagacgaggaattgcagatagctttttggaggatatttctgttgacggtcactctgtcactctgctccaatcgctatcatctctcacatgaattacctgaatagccttaaaactatttctacccatagccccactatctatttacccctacaatctgggttttttttttttttttgagatggagtggtgactggaagaggagagaaataaattgttttgttttttaagatggaagaaattacatcacatttgctgcatgattgtgagagtaatccaagtaaattta

SEQ ID NO: 9776 - DNA, 1034 bp, Homo sapiens
ggttgctgtttttcttttgttcagccttctcttctctgttccataagtgctctgatacaaagattttctagagctaaaaaatgtttcagtcttttttaaaaaccttatgtggctccagagtttagcacaaaaacgcacccttgcaggcatgtctttcttaccttctgtttttcttatatggatgttatccatgtaaacgcttggaagaatttgaagtgaaatcaaacaatttagattggaatagttgtctataatttgaaattactaaactttttttgtttcttttttagtaattttatgcgtcaggagtgtttggattccagatttgtattcgatagaccactgcctgtgtctcgtcttgtatctctaattggaagcagtatcctttttatgttagcatttatggatatgaactttgaagggttttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagacctttgttaataatgtataatttgaaaataaagacagtacttcattccttgttaaaacaagctcgttaaccagtctaagagacccagataccaacacaacgatatggccggagaccatatggtgttggtctccttattgctggttatgatgtaagttcattgaatattgttatatgttaatgattttttttaattaactagaaatttttataattttta

SEQ ID NO: 9777 - DNA, 1047 bp, Homo sapiens
tctatctgtcaaacaagttacttaactactttgtactcagtcttctcatcgataaaactggtctaataataccatctcatagaattttgtgagttatgcatgtgaagtacttagaacaatgcctggcatatataagcactaaaaaaatccgtttaaaaaatccacttttaaaaaaagtgaatcttacatgttaaggctactgtaaagaaaacagtgtgatattgatggagagatagacacatagatcagtgaaatataatagagaaatatatcacacaagtatagccaaccgattttcaacaatgttgcaaaaaaaaattcaatggagaaaagatagtcttccaataaatagtgctagagcaactggatgtcaataggcaaaataatgaacttcaacctaaacttcacaccctatagaaaaactaactcaaaatggataacagatttaaaagtaaaatgtcacactataaaatgttttcacaaaaacaaaggagaaaaccttcaggacttagggcaatgtgaagagttcctcaacatgatacccagaaatgatccttaagagaaaaattgataaattagacttcatcaaacttaaaacttttgctctgtaaaatatcacattaagagaatgaagacagacacaggctgaaagaaggtgtctgcaaaccaaaaaccactgcagaaaatatagtaaaccaaacatctgacaaaggaccataaagaacactcaaaaatcaacatcaaggaaacaatctaattagaaaataggtaaaagacatgaaaatatatttctgcaaagaggatatacaaatggcaaataagcaaataaaatatgttcaatgtcattagccattaggaagatgcaaattaaaaccatgatgagatatcattatatacctattaggatggctaaaataatgacaatactaaatgcctgtggagaaaactgactctctcatatatcgctggtggtagtgtaaaatggtatagccactctgcaaaatagtttggcaatttcttaaaaatctaaacttatacttaccacat

SEQ ID NO: 9778 - DNA, 1030 bp, Homo sapiens
aaaatctgaagcattgacctagcatttgctatgagctgttgcaggggaaatacaaggttaggttcctgcaagcctctggtcacattttcatcaaccaatcaatacataacctagttttatgtgtgtttctgtttaaagacaccttatttaatatatattgttgatttattaacactgaactcacagcctacagggctataattcctacccgaaggaagcttatctaacacacgtttgttttctgtataaggcacatcacagccttcttactctcaggaacaccagacagcactgcaacgctattattaggaatcattgtaaagagcaaaatcaccaaaaaacacaaaaatgagaaaaacgtggcactaaatagactgcaaaaagattcttgtttacagtataagagatgaaacaagaaggcaaggcattgctttgttcaatctcagctgggaatattcatgttagacaactcacatttgtcacggatctgcgcatatctgtaaatgaccacaaaagttccatgagcactgatttgggctacaaataaattttggcaagtaggcaaatccattcatgaataatgaggatgaactgtactaagtttctgtgagccttagtaatgatacctccctcacactacagagtaaatgaaagaaggcatgtaaaatgccttgcatggttacagttagttcttctttataccagatatttacattttcacttcctgtaccttatctgccatgctcaaatctgagagataagtagatatcaagaaacttccagccaaatgtctcatctttatcctgggagcatagaccaaaaactactcacactagctaaaatagaaaagaaggtgttttgaacagacacaagaggcaatctcttgaggcaccaaagtgcagggttcagcatagctaggccaccctgcgttgggactgaaacaggaagatcagaagaagtcccaactctcaggtggatgcatcctctgccatctgtgcctctctgagcatctgctagctacacttttctg

SEQ ID NO: 9779 - DNA, 1069 bp, Homo sapiens
gagggaggaggaagacaataagcaagtaaataaatagaataatttcagataatgacaagtaatatgagaaaagtaaaacataatgatattataaagcacaactaggatgagaagggctgttttagataggaggattaggaaaggcatttctgaggaaggcattttatctgagacctgagatatgaggagactggaattatttatccatttattcagtcattcattcaaaaaatgtttattgagtacttactgtataccacaaattgttttaggcaccagggataaagcaagaaacaaaattctacaagaatatctgccctggccgggcacagtgactcatgcctgtaatcccagcactttgggaggcccaggcgggcggatcacaaggtcaggaggttgagaccatcctggctaacacggtgaaaccccgtctctactaaaaatacaaaaaattagcagggtgtggtggcgggcgcctgtagtcccagctacttgggacgctgaggcaggagaatggcgtgaaaccaggaggtggagcttgcagtgagcagagattgcaccactgcactccagcctggggagcaaagcgagactccatctaaaaaaaaaatatatatatatatatatagagagagagagagagagagagactgtgtcagagttgagacggggtcgatgaggctgaccccagcgggtagaagggacgaggaggagcgagcagcggaaggtcctggtgtgtccggaattggtgggttcttggtctcactgacttcaagaatgaagccgcggaccctcgcggtgagtgttacagctgttaaggtggcgcgtctggagtttgttccttctgatgttcagatgatgtgttcagagtttcttccttgtggcgggttcgtggtctcactggctcaggagtgaagctgcagaccttcgcagtgagtgttacagctcttaaggcagcatgtctggagttgttccttcctcccggtgggctcatggtctcgctgggctcaggagtgaagctgcagatcttcgcagtgagtgttacagctcataaaagcagcgtggacct

SEQ ID NO: 9780 - DNA, 1077 bp, Homo sapiens
ggtgattcctcaaggatctagaactagaattaccatttgacccagcaatcccattactgggtatatacctcaaggattgtaaataatgctactgtaaagacacatgcacacgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgcagggacgtgaatgaagctggaaaccattctcagcaaactgtcataaggatagaaaatcaaacagtgcgtgttctcacccataggtgggaattgaacaatgagatcacttggacacagggtggggaacatcacacattggggcctgttgggggttgggggctgggggagggatagcattaggagaattacctaatgtaaatgatgagttgatgagtgcagcaaaccaacatggcacatgtatacctatgtatcaaacctgcacgttgtgaacatgtaccctagaaattaaagtataataaaaaaaagaaacgttatgcattttttcaacccataagtagacccatataagttacctttaactgtaatatgaatgataactagaagctaacattgtgctatggaaaaataattccaagtaagttaaaatgttgtattatggtcaatatatgtggtaaatctcttatttaaaacacaaggaaagacatctacaattttgattaacagaaaatcagatattctcatccccattaaatcaatattgaacacttatttactgaatattgggttaaaggagtacgaaatgtttttttgcatgggaacctacatgtcttggtctagacatgatggaaatgtaaagctgaaccccccccttccctgtgccaacaatttatcaagcttattagtatcttttactgcagagatgtagatctctctatttggacttcccactgttgtagtgctccttccaaatgctcacactctgacctgtgtgaacatatggaggggatatgaggggttctatttcctaactatatcag

SEQ ID NO: 9781 - DNA, 1199 bp, Homo sapiens
gcaacggacaacttctgcagacttaaacgtccctgtctcatagctctgaagagagcagtggttctcccagcatagcgtttgagctctgagaacggacagactgcctcctcaagtggatccctaacctccgtgtaacctaactgggagacacctcccagtagtggccaacagacacctcatataggtggctgcctctctgggacgaagcttccagaggaaggaccagacagcaatgtatgctgttctgcagcctctgctggtgacacccaggcaaatagggtctggagtggaactccagcaaactccaacagacctgcagctgagggacttgactgttaggaggaaaactaacaaacagaaaggaatagtatcaacatcaacaaaaaggtcatctacaccaaaaccccatctgtaggtcaccaacatcaaagaccaaaggtagataaaaccacaaagatggggagaaaccagagcagaaaagctgaaaattctaaaactcacagtgccttttctcctccaaaggaacacagctcctagccagcaacggaacaaagctgggcagagaatgactttgatgagtggacagaagtaggcttcagaaggtcggtaataacagacttctccgaggtaaaggaggatgttcaaacccatctcgaggaagctaaaaaccttgaaaaaagattagacaaatggctaactagaataaacagcagagagaagaccttaaatgacctgatggagctgaaaaccatggtacgagaacttcgtgatgcatgcacaagcttcaatagccaatgtgatcaagtggaagaaagggtatcagttactgaagatcaaattaatgaaataaagtgagaaaacaagattagagaaaaaagagtaaaaagaaatgaacaaagcctccaagaaatatgggactatgtgaaaagaccacatctatgtctgattggtgtacttgaaagtgacggggagaatggagccaagttggaaaacactcttcaggatattatccaggagaacttccccaacctagcaaggcaggccaacattcaaattcaggaaatacagaaaccactataaagatactcctcaagaagagcaactccaaggcacataattgtcagattcaccaaagttgaaatgaaggaaaaaatgttaagtgcagccagagagaaaggttgggttacccacaaagggaa

SEQ ID NO: 9782 - DNA, 1071 bp, Homo sapiens
aatgggaaaataaaattaagaggatttgaatatgttataaaggaaaggcactttgagtaaaacattaattggggctgccatcatgtgaagatttttaaacttttgtagaacccagaggtgttgcaaatgccgctctctgagaaagcagatagtatgcagaagtggctcttcctctgatattggaagtaaaagattaacttcttgatggctgacttctcccaactgagtttaagctcacaatttcctgactcctgaaaattggctgtgactgccaccaaactgtatccagaaacccaaccatttgtcacctcccctgctatcacattggtccaagccacaatcatgtcttctttagattattgcaacagtttcctaaatggtcttcctgctgctgcacttaccctttagagtctcttctcagcaaagcatccaggtgatcgtgttaattcaagtcagtaccttgttctgtaccctgcactggcttcctatctcatcagaatgaacactacatggtctgccctctgtatccccctgatctcatctcatcactcttcaccttgctcactgcactccagccacataggattccttgctgttttgtaaacactccaggaatactcctgcctcctgtttttgcatttgctatttcctccaccctaaaatgatcattcactacataggcacatggcttgctctttaacatcctctaggtttttattcaaaatagtctccctggctctcctagctaaaattctaatcccctctcaacatctcataactccattcttttatttttttctccttatcatgtcactaatatgttaaatatttaattatcttatttaaaaaaggtcttccccaaaagaatgcaattttgctccatgaaggcaagaatctttgtctgttttattagctgctagaatatctcctgatacatagtaggtattcagtaattatttgcagtatgaatgaatgaatgaatcctgatgagacaagcctggattatctccatccacctatcgttatgcagataactttgatatggtctttggactcaccaagtgatgtgat

SEQ ID NO: 9783 - DNA, 1052 bp, Homo sapiens
taggtgtttgtttagtctaagataaaactttgtccattgaacatgtggtcatttgtctttggtaaattaggcttatagtaaaagttggataatatagtcacctgggcctatttcaccaggttaaattacacaggactgactagcttcttgtggtggtgcaattataggccttttctgccagtccacagataaggagtagaaaaactttatctgttataatactctggctaatgagttgctgagaacaggacccaaccatgtagttatataggaggacaatttggagaaggatgactaaccatccattaaaaaaattttgttccctttcattttttagatacagagaagtaggaattatacaatattttaatattttttttcaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggtgaggattctcttgatgatctcagggtctatcctt

SEQ ID NO: 9784 - DNA, 1048 bp, Homo sapiens
gtcccctatcatagttttattgctggtaccactgtttgagggaaccatggttctttacagagagagctcttgactacaaatgaaatagggccaaactgttactagctgcaatggggcagaggaaaaactgaaaggagcaaaaatgaaaaagaatgtatgcatcaaagagtagacattgtttgcctcactatgccttagatctagttgataaccaccaaacatattaactctaggctacagcggcatttgatctttatcctggtatgaaacatctctaaagatctcccattatcttagagatattttccaattctgacaaagtctcaaagttggcataaattgttaaaatactatacctttttttggaggttgaagaatattgttccctcctgtgcttccaaaaagttctggaaagttgtacctaggacttaaataaaatcttagttttccactgtcttttaaatttgagatgtatgctcacagaaaaaaaaaaaaaaacaactggactttaaaattgcttaggacagtcacttcaagtgacacccgcctttgtgttagtctgtgaattcaattctgctttgtgattcttgaaagttaaacagccagtcctcaggacttatatattcattttaaaggcaatcttaaatagaagtgtatcacactgaaaattaccatttccttggagattgattctgaatgtttaaatttctgcagtaactttaatcttagtctagatttcaagaggcattccctggctaggaaagccaatacaagtggctttatcgattattttcaggtaatggacttcaggacaataaaataattccattaaagcaagtagaattgacagcgtattaatttatttttacagcatttattgagaactttatgcacagcactgaatgagattctgtgtaaggattcaaagatgaaaaagatgaaatcactgctcctaaggagtttgtaatttagcatgcaggcagaagacaagaatatgaatgtttctggttcaagatagtgttaaataagtgccatgggagcttctaag

SEQ ID NO: 9785 - DNA, 1035 bp, Homo sapiens
aagtgcatatactgctcaacattttcatgcattttactgactacacaactgtggctgatgagttagttttttttattacttagctattatgaaatgaatttatcaataatatggaagggagcaatgttagcccttgccttggttttaacctcttcagttcgcagagtaagtatcagaatgttgtaataatctggataagattattatctggattattcaagataataaatgtgtgtgtgtatgtgtgggtataacacactattatatgctaatctattcatgtatgtatctggctttgtatatttgtttgtatgtatctggcttctccaactacagaattctctgaaactcatgtgtacagaaataatgcctcatttactatactaatttaataaagtgttggacacatagctggtttcaaataggcccttaccaattctgagtgtggtgtccagaatattccctctactattaatgtagagggaatattcattagggtacatgtagctacaatgacgtcttcccaaagaactgtgaccgaatatacttccatttatttgaaacttatttggtaatttacctatgaactcatagagaattatgcaggtacattcagccctctgtatctgtgtggattcaaccaattgtggatcaaaaatattttttaaaaaaattcgagaaaatgttacattattgctaaagtacactatgtagttaggtctacagtggttgcatctgtatggaacatctacagactttttttttcttgcgtttatttcctaaacaattcagcataacaagtgtttacataacatttatattgtattagctattataaataatgagattgtttaaagtatataggggatgtgtgtaggttatatgcaaatactataccactttataaaagggacttgagcatcctcagattttgttatctgtgggggtcctggaaccaatcccccatgatacagatgtaaaactactataaaatattaaatttggggctacttttttagcaatgataaagataga

SEQ ID NO: 9786 - DNA, 1085 bp, Homo sapiens
agtttttttttgttattaactagactgttaataactacactgttattaactagactatctgtgttaataactagactgagaagaaaaaatgttactactcattagttatggctcaaacagtataatttgtattagaaaattttaaggccatttgcaaaagtattctccccttctgcagattgtctgttcattctgttgattgattattttgctgtgcagaagctttttagtttaacgtagtctcatttgtctatttttgtttttgtttcttttgtgtttgaggttttagttatgaattctttgcctaaaccaatgcccagaagagttttcttaagtcttcttctggtattttaatagtttcagtcttacatttatgtctttaatccatcttgagttgatttttgtatatggggagagataggcattcagtctcattctcctgcatatgcaatccaattttcccagcaccatttattgaaaagaatgtccttttgccaatacatgttcttatcaattttgtcaaagatcagctggctctaggtatgtggctttatttctgagttctctattctgttccattgatctacgtgtctatttttacacaagtaccatactgttttgattactataggtttgtagtgtaatttgaagtcaggtaatatgatgcctccagctttgttctttttgcttaggattgccttgactcttggggctcttttttggttgcatatgaattttaggattgttttttctaatttgattaaaaatgacattggtatttttatagagattgaattgaatctctaaattctttgggggcagtatggtcattttaacaataccggttcttctaatccatgaccattggatgtttttccatttgtttatgtcatctacaatttttttcatcagtgttctatagttttccttgtacagatttttcacctctttgtttaaatatattcctgtttttttttttttgtagctattgtaactgggattgccttctttctttggttttcagctagatttttttaggtgtctagaaatgctactactgttcagtgaagctaacagttactgag

SEQ ID NO: 9787 - DNA, 1075 bp, Homo sapiens
aacaacaaaaatcaatttctagttaatattattaacttggagcaagtaattcatgatcacttgactagcagccttcgttgttgttgttaaaaatctctcccattaatatttattttataaaattaggtatttctatgtataacttcttaattttaaagaaactactattcatattctttgagttacaaagctattttttcatcaagtgaaataaagaaatcaaataacatgataagaatttgcaataaatattgaaagaggttggattgtcatcagaatttatcattatgggtattttttgagggggtgatatagcacttgctataaatattcatcatgttcttaaatctagagatattccgtgattaggtgattttatgcctgtttatgctggcaggaacaaaagaactttaaaaacagaaaacataaacataattgaaccactcacttaaaagagaaattggaatagatgttttccaggggagaacatgctttctgtataaaaagggctagtgtaacaagaagtcatctattcttgatttctttagacagttagagctttgtgccttgtctagtttctgtgttttaagagcttgttctgtgtagcagaaataatacaataaatgggtttaaccacatttgtctcagctagacagtctgctttgtcagagattgctggtacaacataaacaaattatgtgtttgtagtgcttttcaatgaaagcctatctaacagagctgagattgtgtttcagcagctgtagatttaatctcctacctgtcagttaaaacaggcatttcctgagccagataaggactggttgtagagcagggaagtagtcacagctggacaaagacctattgttattggctgataatttctatgtagattcaactccttattctactgtggaaactacagttgtagtgcagtattaaaggagctagcccagccttttaaaatgttaaatcaaagagaatcaaaactggattttgtgtcattcatttgggggaactgtcatgtggaactaaaaaaaagtctatagatttgatcatcacagttttagatcattgt

SEQ ID NO: 9788 - DNA, 1073 bp, Homo sapiens
caacaactggatattcattttatatggctttaaaaatcatgatattttgctttatttcaagaagctcagtttcctgaatttgtgagtacttttaccttggaacactgtatcttatcattttataaggcatataatagaaacgtattcattttatttttctatgccaaatatgtattctcttgggaaattctaacaatggaaaatacaaacaaatgtatattatatttgagggttcatcagaagactcatttgcttccgtatcaattgaaaacatttacagagactttaggtggttttcctgccatagcacatttgtattagtaatatagttgaaataacttttattgatttaggatcaggcaacatctcagaagtatctctgagtctttgtgatgatcataggatacagcataatagaaagtgtagaaaattgggtgaatttttcattcattcgttcacagacatttattgagctcttgttgcatattaagcacagtgacagtcactggcatgttgaaaaacaccctgacatttaaaattttttaaattccttctaaaaatatatataaatatatatacatatttgggatggagtttcgctcttgctgcccaggctggagtgcaatggtgcgatctcgactcactgccacctccgcctcctgggttcaagtgattctcctgtttcagcctcccgactagctgggattacaggcgtgtgccaccacgcccagctaattttttgtctttttggtagagacagggtttcttcatgttgatcaggctggtctcgaactcctgacctcagatgatccccctgccttggcctcccaaagtgttggaattacaggcatgagccactgcacctgccttaaaaatattttttacaattattctatcagtttaatattaaaacattcagttaattagcattttatttgttgtagtctagttatttgatattttaatgtcatttattttgttttttatatttaatgaaagaaaactggcaggtttgtttcatctgttgtccagttaggctcacttgactatactgcccttccaataaaacctag

SEQ ID NO: 9789 - DNA, 1015 bp, Homo sapiens
acatgaactcatccttttttatggctgcatagtattccatggtgtatatgtgccacattttctttatcgagactatcattgatgggcatttgggttggttccaagtctgctattgtgaatagtgctgcaataaacatacgtgtgtatgtgtcttcatagcagaaggatttatattcctttgggattgctgggtgtgcattagctctttaaattatttgggattagtcaaatctttaaaaaaatgtgtttgccttagcttttcaattgcatccattactgtcaccaaataatattcaccacagaaatatgcaactttagagttttagtgaattctttaggaccaggacaatttcttctcttttttttttttcttttctgtacaacacttagtgctttgaagtttcaagatctggattggtgttttggagtttggagaactgggttctaattttaactctgctactaatttgtaactaattacttgaacttgaacaaattgtttaaactctctaggcctcactttcatttcagttgtaacaatctctctggttcagtgatgcaaaaaatctgatttcaactggagagattaggtgtgatgagaagatgtcattattctgtttaataatatgtataacttttgtatgaatgcgttgggtggcaaattaattggtgtgggctagaaagtttgaaaaagctttgaagtgttagttaataatagtaaacttctgaggcttctttttttcacatgagttgttggaatttatacctatttttttatataacacctaatggcagcagtaatttttttttgttagatgttgcttcattttgaagttccattcttaaaagttgctaataggcatagtgttgcatcaagtttgactttcattttatgaatttggactgtagttgtctcctttttttaaaacagtgatagaaaatatagaaatgtcaataataacaaaaatgatcgtggagagaagtttgaagagtgagatgggaaagagagaatgtg

SEQ ID NO: 9790 - DNA, 1044 bp, Homo sapiens
ttacaacacttttaattttctcagtgttacaaagtgtttattttgataaagaatttgttgatgctctatcagcttttccatgtgcagaagtgcaactgggtgattagttaggcttgaggctagcagccaaaatgtagaaatttggtccccagttctttttctggaataagaaaaagctactgagttttcctgagccttgataccctattgcagaaattcttcactatcaaggatgtcagctcttttctctcttctcatttttcttctttctttctaaaattctttttgtctcatggtattaccatcttcatctgtgtttaattaagtaagtactaattttggaggtattgtagggtttatgttagcttagtcatatggaaattctttacatttgtatcaattttttctataattataaagctaaagaatctatttttttactgtaagtttaaagacaaggaatctaaaacttggagagattatttggcttgctcaagatcatatgtttagaaatcagggccgggacttttggcaatgccacactgccaattaattgattcctgttcatttattttttgtcttgctatattgatgaccagtgtcagtatgttatttttatcatctgtttaattatttcacaattgtcttattttgctatatctacctatctattagtagatggacacatatagaggtgatttgcttgattgctttttatgtctcatttgcaacttgatatagttgacatgtaagtggtttcatcattaaattaaatttatgattggttggatagaatacaccaataagtttatgagatttgctttttttagaaaaactatcatacttatttgtgcctgttttggcagtaagaagttattatgttgttttttttgcatttagccataattatggacttgttaaacaattggttggtagaatggatttagataaaagagtaaatatggtctttcttattacttttttttctgattaaaaaaccaaactatggttattggaaaaagtcagaaaatatgaaaaagaaat

SEQ ID NO: 9791 - DNA, 1035 bp, Homo sapiens
ggagtcttgccctgtcgcccaggctagactgcagtggcgccatctcggctcactgcaagctccacctcctgggttcacgccattctcctgcctcagcctcccgaacagctgggactacaggcacctgccaccatgcctggctaattttttctgtatttttagtagagacggggtttcaccgtgttagccgggatggtctcgatcccccgacttcgtgatccgcccacctcggcctcccaaagtgctgggattacaggcgtgagccaccgcacccggccgtaagcttcttaaactgcaatactatttagaatactataaatgaatctagagtctccacagcatagtggtcacaatgtctaagatataatccaaaattgctcaacatatgaagaaccaggaaaatttgaaaaaaaaataagacatctcagtagagagagataaattattaaaaagagccaaagggaacttaaaaaaacgatatctgaaataagaaaatcacttgagaggacaatcagcagaatagagatgacagtgaaactgaagatagatcaatagaattatacaatttaaagaacagagaggccaggcatggtggctcaagcctacaatgtcacctctcctttgggaggcttaggcaggaggactgcttgagactagtaagtttgagaccaacctgggcaatgtagcaagaccctgtctctacaaaataataaaactagctgagggtggtgacacgaacctatagtcctagctacttgagaggctgaggtaggaggatcacttgagtccaggagttcaagtctgcagtgaactaagatggtgccactgcactcttgcctggttgtcagagtgagaccctgtctcttaaaaacaaaaacaaaaaaccacaaaacaacagagaaaaaattggaaaagaaaagaagatgaatatagcattagggatatatgacaatattaaaaggtctaacatacatgagtcccagaaaataaaagagaatgatgttggggcagggaaaaaaattgaagaaataatgc

SEQ ID NO: 9792 - DNA, 1049 bp, Homo sapiens
aaactgtctttttttaagttaagaatccttttttcttcacgtgggcaactctcatcaaccaatttttgcactggctaaaacttccattttctccctttgaacatgtacatgttagccagttaaatcaaatcatggcacttgattgaatcttagggcaatgttggataaagtcaaatgtcatgtaacaaataccccaagcttttacttcttcaagtcagtctgaactctgtctttaggtagatggttttggatgagaaatgtcaccagtatcactccttatccctttcctcatctggaagtccttctgttaagaaccttaaggcttaagtatgaactgggcaaactcaggttaatctgattatttatctatactttgggatgattttgccttagtcttcccccaactaatattggtcatgttcttaaaatttccttaggagagacattttacaaacttccatttactttttcactgtatatggcttatattttcctttaaaaataatgtagtactcaggaggctgaggtgagaggatcacttgagtttaggcgttcaaggttgcaaatgagctatgatagtgccactgcactccaacttggtcaatagagtgagacccagtttcttaaaataaaataaaataaaataaaataaaaataatataaaacaataaaaatattactgctttaagttatctatggatgttaattataatcttttatacagtagcaatttatatagctacagtaatcccttatgtttatatggtatttatagtttcaaagctttttaataaacatgatcctgtttaattataaaaataaccctatgagacacacagacctggtttattatattcattttacagatgaggaactgaagcacagaaaagttaagagatttagtctagatcgtaaatctaggaagtggtagagaggccaagaaaaatctgttttctgagttctactagttcagtaatgtcttttctttgttttagtcactttaaccttctctcataatcatcttttgaatcatcatctttttgttgacc

SEQ ID NO: 9793 - DNA, 1060 bp, Homo sapiens
tagtctatctttggcagttcagtctggttcgagaggtttctatagggagagaatgattatttttaaaggccttgatatgtcattttgaatcccaaagcagaaatcatgtagccctataaaccttaaatattagaagattactggctgtacagcaagcccccacagaatgcccattgaataaatggttttaatattcgagtcatggatgtaagatgaaatgtactaggagctgaaactcatgggagaagaatagtttgttaagaattggtaggaaatgggctactactaccaatgctttctagatcagcatttctccttctatgatgtgagcacactaactggattaactaactgaataactggattttggtgtttgtttaaaaggcagattcttgatccttcaccccaactttttgaattagaatctctagatgcccaggaatcttcatttaaatgacttccacagatgattctaatcaccacaaatattgagacccactgtctagaaaaataacgtagtaaaaagctgagacttaaaaaaataagacaaatgtaaaactgggtttctgattacggcaatttgtatcattggatacatctaaaataattcgtattgaaaaataacctttttaatttattttgttttatatttaaaactcttaagagtgacagcatgtggacagctaattaatacattatttcagtatcattcataaattgcttttgaatcctttgacttaaagagagatagttacacttttgactgtaattaacttggcatatgcctttgaattaagaactggagttctgaactttcttaaagagcttttaaaatggtgctgatgtcttttcattgttcctacttcactcagtggggcgcagatatttgtcataagtgaattggtgctaattaaagacagtattgctatccatctctatcaatgaaggtaactatatttttgagttagtaggagtagaaggatgggaagtgaaagaggtgatctgagatgctgcgaaatgaatgccagttgaatatgtagagaaattataattggtagga

SEQ ID NO: 9794 - DNA, 1059 bp, Homo sapiens
caagaagccaacagtgaagtcaaactcataagcatcctatagaaaatccctcaaattacatctgtgctgttgccagctgtactgccagggaacaagaactgtacagatttctgtgcaatgactgggttacttaacacaacttgattagctctgtttctgccctgtctttggctgacagctgaccgccatactgatttggtggatgtaagactgaagtgaatacaaccacttatatgcaccttcttcttgtatgctatcactgtcttgtacagtagtcatgctgattgactccaaaaattcattttgtcactcattcaacacacagtttgaaaactattgcattaaagtaagcaaatttttttccctgttttgatcttcatattatttagtctgccattgttttcaaagaactaagtctcctccacaggaccttaattttattgcttgtttgaataaaatcattaggaagataaattttgtactctactagtagtgtataatctattaataacagtatgtatcaagtgattaactgtgccagttctgtctatctctctctctttctgtttctctctctatatatactgaagtgaatacaacagagagagagagagacaaagaaagaaagaaagaaagagagagagagaaatcgaaggagagagagaaataattttctcacttaatcctcataattaccctgtaaggtaaaaactattactgtacccatttttataattggggctcagagtggtagcacaaacttttctgatagcacagtaaatgatagagccagaattcatattcaagattggtttattcaatgactgtgctcttttcctaaatcctaataacttcctaattttagcttaaaaattacttaattttttaaagtaatttttaattttttgtgaagagttgtattgcaaagcaaataaaaacagacttttaatgatgattgttgcatatttttaataaagttgaaacttcttgataaaataattttttccctgcacagaagaaaagaaaaagaagggaagaaagggaggaagggagggtggg

SEQ ID NO: 9795 - DNA, 1049 bp, Homo sapiens
tgacttttttcaaagcacagcattagatgctgcattggaaacaaacgcaaatgtattatacaaagtccctgccctcaagaaccttagagtctagacataattattaaactctcttattccttttatttgtgtcgctagtgtctaagtgaaccaatgcatggctcaaagaaggaaaatgctaattaaattacatttgttattgcagaggagatacacagaagagaggagatggaatttcctatgcagaatgttaaatgccttaatagagttaaaaatactactctaggaggttcaaaaaatttaagatatatatccctttaagaggaagtacattaagaaatgactttttcatgttctctgagagttgggtgggattttgtcagtggaataggagatgaagaaaggagcatcctgctagtaaggggactagcacaagtgtggggaatatgggctagacgaatggaagcacatagtatgggataggaaacaataagttcaggtggatttaggtataggtatgtataggctagaaaatttagtgtgatcatatcatcgtgatccataaggctaagctaaggcattcggtagatcataggggaccatcacaaccaaatagtccaggagcatgccaagagcttcgcttttgaaaaattaattcagtgaatagttagtagagtggattagagggttaaaaaaaagagaagctacagaagcaacttgtgaggactactgcaaaatttcaggtaaaaggtaaaagatttaaacaagcgatgaataagactggtaagggtatatgttatgggaagcaaaagggaaaggagtcaaaatgactcctattgctttcttcttgttcatcacagtattgaatttttgaaaagtcagagggaaatgattgtactaaatatctcttgtcagtgtgcaaatccatttccatctcataaattagatcctctctgaaaattaacagttttttttcttcccacggaagactgggaaaaagacacagttttaaaggaatgaggatatccttgaaaatataattgccttga

SEQ ID NO: 9796 - DNA, 1046 bp, Homo sapiens
actgggtatatacccaaaggactataaatcatgctgctataaagacacatgcacacgtatgtttattgtggcactgttcacaatagcaaagacttggaaccaacccaagtgtccaacaatgatagactggattaagaaaatgtggcgcatatacaccatggaatactatgcagccataaaaaatgatgagttcatgtcctttgtagggacatggatgaaattggaaatcatcattctcagtaaactatcgcaagcacaaaaagccaaacaccgcatattctcactcataggtggcaattgaacaatgagaacacatggacacaggaagggaaacatcacactctggggactgttgtggggtggggggaggggggagggatagcattgggagatatacctaatgctagatgacgagttagtgggtgcagcgcaccagtgtggcacatgtatacctatgtaactaacctgcacaatgtgcacatgtaccctaaaacttaaagtataataataaaagaaaaaaaaaactctgacacaataaatattatatattatctattttataagtctgggaaaactgagaaaccataatattagtgacatttcagaggttacacagttagctaatagcagggaaagcaagatcatgcacttctttgggctagtggcaactattatgtaccaatgttactctgcttttaccagttttcttttgggctgacctacttttagtgaaataactgcatagatatcacagataactcctccgttgtctctaattcatttaaagaacatgtaacaatatgtacatggtggtattatttttttaaacacctttttttttttttttttgagccagggacttgcgctgttgcccaggctggagggcagtgttatgatcccggctcactgcagccttgaccatctgggctgaagcgattctctcacctcagcctcctgactagctggaactacaaaaatgtgctatcatgtttggctaatttaaaataatttttttgtagagacggaggtctcactgttgttgccca

SEQ ID NO: 9797 - DNA, 1060 bp, Homo sapiens
cccagacaaaactcaatgaatattttcttatagaaactggtgttagttataattcagtgctcagccattctatgagtgaagtggcatagttttctaactcctattggcatcattgtttctatgggaaagtacattccaaacttttgaaactaaatccatttgtgtgttgggaacttctgatatttccaaagactataaaactgcattgttttagaattggagggaacttggaagccctttatttcaagttcattttatatacaaggcaaagttctagaagaaacctaagtccaacttcgctggaaaaaaatgtgatcttatttaaaaaatgttttaaaactattaaaaaaatcagtgttatctataactttctttcttttaggttcctagtctcttggtttttaaagttttcaaggttctgtgatatgcaggcctaagaagtgctcatttgagaattttctaggtttttctatatgaagacttttgcatcaccaaccaatattgtatgatatatagattaagagatgaataagaatttgaatgaataagaatattggacttattggttctgctgtgccattctatctaatacagtgttgaaaatgtgttatggttgacaagtcattactttaaattgccagttattgattctgatttgatacatttaagaaaattcctaattatgtattaccttgaaactttatgtgcttttgagacatagactggtatgtaaggtgcacacaagacaaaaacatgtgctcaacagatgtagtgttatttgttttcaaaaactgatcatcaaaattatctttgtttggaactgtgaactttatttttatgtgaatttttacttgatatcttattggttataaataaaactgaaggaaatatatgtttattttaaaaaatgacacaaatttattgtcaccaaatgacataatatgattattcttgtgtttgggcactttcattttagtatttaggttttgtttattatctctctctctcctgttcaaacgtgcatcccaataggacaaaattaaaagttagcaatattact

SEQ ID NO: 9798 - DNA, 1066 bp, Homo sapiens
tagggaatcctttccccatttcttgtttttgttagttttgtcaaagatcagatggctgtagatgtgtggtgttattcctgtggcctctgttctgttccattgatctatatctctgttttggtaccagtaccatgctgttttggttactgtagccttgtagtatagtttgaagtcaggtagtgtgatgcttccatctttgttcttttggcttaggattgacttggcaatgcgggcccttttttggttccatatgaactttagaatagttttttccaattctgtgaagaaagtcattggtagcttgatggggatggcattgaatctataaattaccttgggcagtatggccattttcacgatattgattcttcctacccatgagcatggagtgttcttccatttgtttgtatcctcttttatttcattgagcagtggtttgtagttctccttgaagaggtccttcacatcccttgtaagttggattctttggtattttattctcactgtagcaattgtgaatgggagttcactcatgatttggctctctgattgtctgttattggtgtataggagtgcttgtgatttttgcacattgattttgtatcctgagactttgctgaagttgcttatcagcttaaggagattttggtctgagacaatggggttttctaaatatacaatcatgttatgtgcaaacggagacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggctgttgaatttcgtcgaaggccttttctgcatctattgagataatcatgtggtttttgttgttggttctgtttatgtcatggattatgtttattgatttgcgt

SEQ ID NO: 9799 - DNA, 1030 bp, Homo sapiens
agagtcatggaattttatgtttagattaactctcattggagattaccagcactatgttaattaagtcagaagaaactttacaaaagaaaggtaaattgataagctgggactatccggggaggacatttcagaggatggtgtatagtccagaagaaagttgaatgtgggaatgagtttactggatccatttaatgtggagtacattttctagaggggagtttagggtgtgagatagggagaagaaagagctaggaacaaattggagaagagtaagcatttcagaaatttgtaaaatgcaatacagatgccatatggaaaagttcctaaccttactttgtccatctttacacttcatgtgaacatatatgcataaactttaattatactcaagaggcttttgacatgtttgataacattttccagtatttaagtgaagttagggtggagagatgaaattttatgagaaactatagttgtatttactaattgtgatcaaagtatttaataagactaaagggaaacaccacattttgaaaataccatcagaagtcttgggcttctgaagcttggaagacatttaactgacattgaaaaaggaaacctatgtgtggcaatgaagttatggtatgtaagaataaagaaaaggtggattataaagtcagaaatttctgaagctacttaacttgatctcagaggtattatcagctaagacctatgaattgggctataaatcgttacgttattggtctacagaataaaatttgtgccttccgtattttatgaattaacttttcatgctctttattatatgcaaaagcaatagaacaaagtgcaagaacaataatgtttaaatattagcagcaatttgaatgaaagtaaatttatgattataaaatgttatttgatgaaagtgaagccatactacatggcttgatgctgggtatttcatcaatctgaaatgttaaacattttaatgaacatagaaaatgttaagggtatttttcttaaattaaaaactaatgttttaatg

SEQ ID NO: 9800 - DNA, 1024 bp, Homo sapiens
gaggagtctaacacaccgcttaattcctgtgtgccccatctagcacagcagctggccctcctcccgcctaaaggccccctgtcttccaggacggtgccaccttaccccccttttaccaacggactccactacacctttgtctaacaccttccaagtaagagcccctgtctggtgtgcttctgcctgcttcctgcacctccctagcgctgagcccctcacctccctgctgtgctgaggtgattgcagtgccacctgctgatgcctccttccactggcaaagcggccgctggcgggactgttctgactggtaggcaggtgggaaagtgatgctttttaggaactcaatcctcagtggctctaatacgatagggactgagcaatccaccctgctgcctccatgaaatctctagaaccggaactgtgcccccatcccctgctctcctcagtagggcaccctgatgcccgagaaccagtgcagaccacactgccagccttggggggctggaaaggaagagttagatcttggcctttcagggctttggccaaagaaattgaagaactgtaagattgggaaaagtccagttctacagatgaggaaactgaggcccagtgaggggctggggctcactccaggtcacaaagaattggtgtcagcgcagagactgggactgcccttttggtcactgggcactttaagagggagagaaagggaagcccagggcaatgtgaaattggccctcagccaggcagaaagctctggcaccaaccctaccaagttctccccatgtgggcatctagtgatgagaggcagtgtgggatgaggagggagccctgaaacaggaggctggcatctggtccagtctcaagtgagttcttggcctgggcctgttgcttttgagcccagcggttcacctggacaggggaaggtcagactaccagtctgggcagtccttaccctgacatcccatcccactatcattttgcagggctttcccctctccttcctttacgtatacttgtggtt

SEQ ID NO: 9801 - DNA, 1040 bp, Homo sapiens
gggtgtgttaggtgggatgcttttgtttgtaagtatctaaaacccaaagcaacatgctaagtcgaaaagggaatatactaattcgtgtagccaggggccccattcccggggctcagccacattgtcactcttctactttccgtgtgtgtcagacttcttctttcctgtggaacaagggctgcctccacacgggcagggaaggtggctgcctgcaagcccagattcacttcttccctactcagtattccatgcagtgaggagttccctaatgggacacactgggtggagaaaggaagcacaacagcagctggtacagctacagtgcggaatgattgaaggagttaggggcgattcaggagaggcatagagacagcctgtaaaactctggtatgtctccatgtgttttctgtggccctaaggaggaattaagacacgtggatggcagctacaagtagataggttgcagcttagtagaagaaagacttttctaaaagggccacctcaggtggtggtggacttcccgtcactagggtacaactgaggctcaatgaaactgagtgggatgaatggttggattaggaaaaccccaaggcttattggtccttagattctatgacatgctggacaaaatgtccctgagtcaggggtctctctggacatggttgaataggcctgtagaccattctgggcatggaaatggagataagcacagcccctctgggaccagctgcttatgagaggtcccccctggttccttggaggggggtgaggtaaggatataagcctctctggagaggagtctccctgcttggcatctgatctgctgacctctcccctccatgtgccacgttgacttggtgtcccccatgtccctgttcgagaggccaaggacttaaggatccagagcccatcttcccctgccccccaatcagctgatgctcagcttccagaatcaggggtgcttgtgggcccacgttgagaagctttaccttcctgaagtgagcgttcctgctggggtgccaagtaatcatacaacggga

SEQ ID NO: 9802 - DNA, 1110 bp, Homo sapiens
tttgatacaggcatgcaatgcataataatcacagggtaactggggtgtccatcacctcgggcatttatcatttctttgtgttataaacatttcagttatacccttttagttattttttattttttaaattaaaataaagatgtaatcttgctatgttgaccaggctggattcgaactcctggccttaagccatcttggcctcccaaagtgccgagattataggcatgacccactgcacctgaccccttttagttatttttaaatgtacaataaattattgttgactataatcatcctgttatgctatcaaatactagctcttattgattctatctaactatatttttgtacccattaagcatccctactcccccctgcccactacccttcccagcctctggtaaccattattctactctatctccatgagttcaattgttttaatttatagctctcacaaatgagtgagaacatgcaaagtttgtctttttgtgcctggcatatttcacttaacataatgtcctccagttccatctatgttgttgcaaatgacaggatttcattcttttttaaggctgaacactactccactgagtataaataccacattttgtttatccgttcatctgttgatggacacttaggttgcttccaaatcttggctattgtgaataatgctacaataaacagatctatagaattttgacttgagcaactggacggttactgagatagggaagggtaaggaaggaacaagttgggggaaatcaggatttccattttggacatgtaagtagggagttggagttctggacatgggtggagttggagttagcattcagatttggcttggttaataggtagatatggtgctgtgcagcagatacaagcataggtaagagacatgagcttggcgaggaaagtggtactttgggaatatccaggtagagatgatcaggaggctatagggaatgtgggtacagtctgtagaggaattctagagtcattgccttagagatggtaactaataccctggcagtagttgagattacccagggtggaatgcttacagccatgttccttaatcctgtctgcatgatttgatcattt

SEQ ID NO: 9803 - DNA, 1022 bp, Homo sapiens
ggaccacgggaaagctcaaggtaagacgcctgccattctctggaagggttaaagggaagtgttggtctgtggtgtccatggtgtgagcagctggtccttcatctgtgaggggcttgcaaagtgagagtctctatcaacaccttgatctggagccatagtggtgctggtggttggaaagtcagtctcatcttccttctacctttccttcctaaggaggcacagaactgagctgatgctgtggctttactcatcaacaggtttgagttgttcctgtgtttccctcgagtgacgctactgtcactccagaattgctatggattggtgatactgggatagtgctctgtgtcatgttgcgtggaatactgttgccttatatctttaaaacatgacatgggaagtactttgatacatgtgacctcatttaatgctcatggtgagggaaggatatgagagcttaagaaacttgcccaaagtcacaaagctggaagatgacagaggcagaacttggccctgaattctgttctctttcagttttcttatagggctcccactttgtattattttctcttcttccttgcttttcttccatgtcttatcttggtcacttgctgcacagacatcgcaggaggtagaaggtggtttgaattgacattaattgtatcattttagaaacttattcctgactctgaaaacattttgttcagtgcctttcagattcatcctttacagcctgaaaaatcttccttaggaaaccctcttttctagagttgagcactgcccagttgggcaaacaattgggatagtgatgttgcatatgatgttttgggaacaacatttggcatgtctttaaagtaacatatcataactatatatataatttttatcttaacacttcattggaggtgtgaaagtagattctaggcaaacatctttaatctgtcttagatttcttttcttttctcaacatttttcttggaaagactttactaagagagttccctaaatcttttgtctgagagaca

SEQ ID NO: 9804 - DNA, 1028 bp, Homo sapiens
acataaagttagggactatgtgttgttaagagggagtctcaaaatgtggagaaagagcttacttttaagataaggctagactgctactggtgctttcaaagcagttcagggggcctgagaagtgaattccatcattggagaatctgaggaggcttcttagaaggagagaagagataggcttttaagaatgggtagagctggctgggcactgtggctcacacctgtaatcccaacactttgggaggccgaggcaggtggatcacctgaggtcaggcattcgagaccagcctagctaacatggtgaaaccctgactccactaaaaatacaaaaattagccaggcatggtggcgcatgcctgtaatcccagctactcaggaggctaaggcaggagaatcgcttgaatctgggaggcagaggttgcagtgagccgagatcatgctcttgactccagcttgggcaacaagagcgaaactccgtctcaaaaaaaaaataaataaataaaaagaatgggtagagctttgcctgtgtgtgggttgtgggaggatggacattacaaggggaggaaacaacttggctgaagttctggaagcagtgggacagatgagcccagggaaactgcccagaaggttgttctgatgcatttttccattcaaagacagccgagaagaagcggtcctcgggagcatccccttgcccagctacgtgatctctcctgtggcccctgaggatcgcataagccgcaaatattcctttaaggtactgcccctgcacctctaatgcagccattctgtctaagaaactgtgttctcaaaatgtcttcataaaagcagttgcttttgtcgggagggggaagaagctagagagtttcagattccggttaacaaagttgtaagttatttaaacaagaataatatcacatgaccggtactgtcatttgactctaagctttggagtcgcccagccatgttcaagtattcagacccctccttcctgtcactgccagtcttgtggttacctgtcgaagccc

SEQ ID NO: 9805 - DNA, 1032 bp, Homo sapiens
ggcatcagtcaatgggttctgtagccttgttcccccaggggacacttcccaagccagtaggtttgtgaaaatgcctcatgggagagctaatacaagctcaggctgtattaataaaagtacaatgcatagagaaagggggagaatagttctgttacatcgtggtttttgtgaaacacttcattcattcattcaatacaaattgatggagtacaaagggcatgccaagctccaaacaccatgttctagatactaaattttaagagaggtgttgagcaattgatattcccctgaggagggggaccattatggtgagggttctagaagccctatcctgtgacctattgtgattaatctgcaggagagaagatggaggatgtggtaaaagtcttcaagaagggctagcaagtggaagtggggtacatttatcatgtggtgggcaaaggcaggtgtcagattaatgggtgaaagctataggcatacaaatttcaacccagtccataattttctaagaaagacactgtattagtctgttctcatgttgctaataaagacatacctgagactgggtaatttataaaggaaagaggtttaattaacacagttccacatggctggggaggtcccacaatcatggcggaaggcaaataaggagcaaagtcacatcttacatggctgcaggcaagagagtgtgtgcaggggaactcccctttataaagccatcagatcttgtgagacttactcactatcacaagaacagcatgggaaaaacccattgccatgattcaattaccttccactgggtccctcccatgacatgtgggagttatggcagctacaaattcaagatgaaatttgggtgggaacacagccaaactgtatcagacagtttatagcatcccttgtttcaagatctagaatttcctctttaacattaaatgaagtattttacctcctagaataagagttgggagcttttaaaataaataatattaatagtattgctagtattattattatttttatagctaacac

SEQ ID NO: 9806 - DNA, 1035 bp, Homo sapiens
ttggaattgaatgggcaaatagaatttctttgaaagatgtctctatttctgcctggaggactctgtaatttggacgttgtgagaagagcctatctttattttgaatttggaaccattgactcccctttctttatgctgtgagttatttatatgccaagaagcacagtggaggccttttcaccttctcatgactttaagaaatacaggaaaacagcattctctacaatccataatccctgagtgttggcaacaaaaaaatgaaagatattctaatgtaggcgtctgtgcaatggtgatgggttatggatggtcaatgagaaccttggctgccagtcctgggaactgatctcagccttccctgggaccctctggatgaggggatcctcattcacctaactgagcaaacatcccaaacatgctctgtttgcccatttattcattccattcattaatgtactcattgattccatttggttcacttcagctactgatcacctaatgttatatgccaggccgtgtgcatggctgtaattatagagctgtgactaagaccttccttccttcctgttcagtcagggttcagtagcagtagtgagaagttattctcgcttttctaaacagaaatggatttaatacagtgaactaggtgtttacatcatgattggaagggtgcaggagtaggctctaggctgacctttggcaatgataactaaaacaagactgtgaaaatggcccataagtaattgttttcattttccttttaattcaactcttttgagctccccttgccctttgctcccaacttctctgtcccagatcttaggctctctccttatgggaagagctgtttcaaagcatttatggattgtaaagtgtgaataagggtgttgttaataataactgtcacttgctgactgtttattgtgtgcccagctgtctgctaagtcctttacctgtgttatttcaatcctcacatctgttgggtagttaatattatctctacattgcagagaaggaacctgaagctaataaaag

SEQ ID NO: 9807 - DNA, 1050 bp, Homo sapiens
ccgccagtgccctcgggtgtattttcaggcctgggggctgtgggcagaggaagaggtgtctgtcaggtgtcacctgacttgtctctcccaggcccctcagtaggaggggagcagaaaggtccaggtgggaaatagagaaggtggagtgaggctcctccctcaggcagtttcagtttccctcctgtccttatcagagagagggtgggtctaagactgatagttgtacaaggtgtcctgtttgtgtgctggggtatttctgggtggggccctaatgagtgggagtggaagggcccagccttaaatggagggctgtggaccaggctgggctctggggaggtgggagggacgggggttggttagagacagacctgaggagattttttaccccagccagggccttagaatagttgtgaaactcagccttcctggtagcattgtgccttagagacctgggaagctatgtgctggcttaggatagagttttcagtcctgttaacggaagggtggaaggactggactgtagagtaagtgcgatgaggaagatgagcatgtcttggaagttgacattctggggagtgcaagaggcggctgagtttatgtaaggcggggaggggcaaaggcaagaagtgtggggaatagggtgggcttactgcaggcaaggagcgcaggaaggcagattttagcactgggtgtgggctgtgtatcagagaggtgcttccagacaggctgctgtgctccctccccctcctcccaattttctatcccctttctcagtgacttggtttgctgagttcgcctgcctctctgctctgctctccatgggctgggctgctccagtccctacctcactccagccttccagggagaaaatgagtgaaggaaggcttgactttaaagaggctgttgactctgaaaccctggtttgttggggaatcagtgccacctgccctgccacctgggtttgcggtgtgtacactccatggcagccctcccctaacacacagggctcttgcttgtagagtgccaccttctccaaccctgccctgagct

SEQ ID NO: 9808 - DNA, 1050 bp, Homo sapiens
ctcttttgcagaggtaggacagccatggatcagggagagatgagaaaacagacataagggcctctttggacagatagccaggctctcttctagggcctgggagccaccctatgccccacctggataaaagcccagatgtgcctagcatggcatttccacttctgcctaatcatctccacctgtgaatggaagcaagcttacactttaatacccagtggttttgcctgaactttcccactcactgggtaacgtctcagctttgtcaagtatcacttcgtcagggatcctttcttgactgccaagacttaaggctccctggtgcattcttataacacctctgtaatcccctcgcaacaatggtaattaccttgttctgtatttaatataggtctccctgactagagtagaagcactgtgagtgtaggaagattatctgttgctcctggcatatactaacccttaaatgtttgcatgtgtgaatatttggacgggtgctaatgaatgaattagaagtgtgtgtgggctgctgagaggtgctgtagttctgattgcctgcaggaccaggagagtgatcccttattgccaagggcattgagaaaagagagaaagaaaagagacatagttgaggttgcgagggcagagacaagccagagggtatggtctccttcgctgggtgcctgatagcggcctcctgggcgatgaggtcgcagtcacatccaaccaagtcttcattcctggcttgtcagaatccgttcccgcaatttaccagggattgttagaagactccttgaatcattgtggggaagagcattcaaggtcaggactcttggaggggagacgacagcaacccgggtctcctgcagcctggtcttcccagccgatgggcacttgcggcaacggatgacaggtctgctggtgtctggctagacgccagaacagcgcagttctgaggccgcaggtcctgcccctccgcccttttccctccccctcctcagcctctctacccctcccacttgcagcatcctctacgaggaaaggaatgtgctgggc

SEQ ID NO: 9809 - DNA, 1030 bp, Homo sapiens
ggctttgtgacttttcctcttggacgtttaatcaacatgtcaaactaacatgtccaaaatagagttcttgatcaattttaacacctctcctcccctttgacttgtacttctcccaggcttattcatttcaggaaacagtgctggcatccactcagttgctcaaaccaaaacgctggaagtcttgtttttctctttccttctctccagtcataaatcccatcagtgagtcctgttggcactaccactaacacacttggcaaagctgaatccctcccaggagtttcactgttgccattttggccagccactgtcctctcctgcctgtactgctgcagcagtctctttagctcatctccctgcttttccccacttcttttcagaggcattggcatggaactgtagtcagactggctttgcatactggatcctccacttactgtgataggcaagttacctgacctctttatgcctgggttttgtcatctgtaaaactgggactataatagtactcatttcaaaaagttttcatgaggattaaaggagatcatacatacagagttcttaggacaattcagagcacatagctaagcaccgagtaactattaggtttttatcgtccttaatccccgggccatcctctacatagaagatacagaaatctttttgaaaagcaaatcagattatgcctcctttcttttaaacccttccatggcttcctattgtctttggaagagaacccaaattcctactaggtattataaggctaacccgactcccctacctcatcttttcctacccttcccactggtcactgagttccagcctcacttgtccttcttccttcccaggaacaaacttagtttattcccatctattcttgtgccaggacagctcttcccctgggtcttagcttaaataccacaccttagcgaggtcttacctgatacataccctgacctgcacatatcacagtttggtttcttcatagcacatgttaatatctgaaatattttgtttgcttatttattat

SEQ ID NO: 9810 - DNA, 1037 bp, Homo sapiens
aaaaacatcgtctgagtgctgtggctcacacctgtaatcccaacactttgggaggccgaggcgggtggatcacctgaggtcgggagttcaagaccagcctgaccaacatggagaaacaccatctctactaaaaatacaaaattagccaggcatggtggtgcatgcctgtaatcccagctactcaggaggctgaggcaggagactcgcttgaacctgggaggtggaggctgcagtgagctgagatggcgccattgcaccccagcttgggcaacaaaagtgaaactccatctaaaaaaaaaaagaaaagaaaaacatcctagttaagggatagctaagtgcttcctagtttgtttctttaagttaaatttcttataaacaaggtcctcttcaactttcttctttgtcttattcactcctcattatatggctcctcagactgggccaatttctcaatttaggtggctatgatacagatggtcgtatacctctcttctgtagtgtttatcatagatgtacattctcatgtgcttagatgattattttgaaagcttgtgttctctactagactatatacctcatgagacttgggccatattgtcctcagtgcccagcacaatcttggcacatggtataccctcaataaatatttgttagaacaaatgaataaggccaaagcattcagggattttatgtgactgattcttgtagtgtcttcccaggaaatcaaggccctttcaagcgtgcaaactgtctcttgtccagagagcttggtggccatctccaagctcattttactccacggttattaacaatttggagattgttaataacaacgactccaggttattaacctgctataaatccaatcctgtaattggtacttgatacatgttgctggtagtcctcaaagatgagggagactgaggctcagggggagggaaacagcttgcccaaggtcacattgctggaaggcatgctctttcctttctgcctgctgtttctgagccagagctacaagtgtctgtgtgagttatggg

SEQ ID NO: 9811 - DNA, 1039 bp, Homo sapiens
ttatttgattaacgcaaacacctaactgaacctctactgggtgccaggcactatactaaatgctggggaataaaaaatgagtaggtcatggtcctttaagcccagttcagtgggacaaacaggtaagtaaacaaccataaggcaacaagtatcttcatgagtatttgtatagaacactttagggacacaggggcagtttattccatgggatacagaaaagggaatgctcaataggaagcaatatttgaactgggccttgaaggataagtaggaagttgccatgttgatgggtagcagaggaatactccaggaaaaaccattcattcattcagcaagtctctcctgttagcctgctgcagcctaagcatcagggttcattgggggtttcagttttcttctttgtattctctagggcgcctagcatagtgctttgcgttcaacagttgtttgggaattatttgagtaaataaaaaatccatctgataagggaattaaaaattactctgacatttgcaaaaactgtttcaaatgaaacagtatatgtgaaaataaagcatgaggccaggcatggtggctcatgcctgtaatcccagcactttgggaggctgaggcgggcggatcacgaggtcaggagtttgagaccagcctggccaacatagtgaaaccccgtctctaataaaaatacaaaaaattagccgggtgtggtggcgggtgcctgcaatcccagctactccggaggctgaagcaggagaattgcttgaacctgggaggcggaggttgcagtgagccgagattgcgccattgcactccagcctgggtgacagagcgagactctgtctcaaaaaaaaaaaaagaaaacatgagacaactgtaaagtatgtcgttaatatttaactttcttgttgttttattttgctatcttccaaagaaatttatttgaataatttctgtgacctttcaaataactaacagcatccagcatcctatcttattagtttttgtttttttttttttaaagacagagtcttgctctgttgcc

SEQ ID NO: 9812 - DNA, 1273 bp, Homo sapiens
gaagctgaggcttctagaagttgccatttgttcaagataagaaacaactttggagtgagaaagggaattgctttaatccagtgagtctgagggagtggagtaggaggtaggttcagattcatctgttttgttgtattattcaaagttctgagaaaaccccctttctgtaacctctaccaatgtcctggtctgtcctctgtccccacatagaaaaagttttcaccttttaagtgtttgaagaggctcccatgtggccctatgtgttttcctttccaggttaaatcatccttgttccctcatgaaacttggcttttagtttactcgttgtctttgacatcactctgggcatattcccctttagctgtaatcctcttaatagtgtatgtactagtaagctcttcaggttgaaagtgacagaaacccaactcaaactagcttcaagagaaaaggaaggatattggcaccagtatctgggaactcccagtgtaatcctgacctggccttggcactgttggactctggtgctcaaagggcattttgggggccctgccttctccatctttcaagtctgctaactcttttgtcaaggaagagaaatgctcactctcccaggagctatacatctcttcttaggggagattatgatcccctgcttggaacatgggcctgtcctaggggtagagcgtggtggctgaacagttgcagcatgacgatatgggaggtgtgacttctgccagtgaagggatgcatatgagcaatgcatgtccatcatattgcaatatgtagaattggtgactggccagctcagaatagcatgggatcatcatctgtcttttcctcaatatcatacttgaatcaattcaacctaaaatcaaaataggttccctattaagatgtaatcatattacatcaagcactgctgctcagcttctctctctcctcttaaactgctggtctcaaatttaggtctttaagcttatctctgttagattccatatggctgtattaggtccagagaatcagcttgttaagatcttttagctctaattctgtcatctggcttcctgcttctccctcacagctcaagcactctgcagtcaggtgatatgatgcaactgacatttgggagtggcggggatgggagatgggaaagtgagacagcaccaggcagtcagttgcatcaaaagagccagaatcttctctcacctcctcccacacaccctaaaaccccttcagtttcctttgcatggcccataagctcggccttctgggt

SEQ ID NO: 9813 - DNA, 1928 bp, Homo sapiens
gaggaaacaaggggaatagggtagactattagaaattgaataagaaaaccattttaaatagggcaaaccacagaggagcactctcccttcttctgtgggctagggagcccccatcagaatttcaaagagacattgcatggcctctgatctttgccaatttcccaaagttcatagcttactcccaggccttatttcttaaggcctaggtggtggggaccaagatgtcactcactctagaatgccaaataccctgagaaattccaggggctttctttttgagccttggggctctggccaaatagctcctggtatggttgcagcctcagatccattgatgagtacctatgcctggcaagggctgagccaaaaggggccagagggatgcagaccattcatgagtacagccccttcctgaggtgggggccggctagcccacaagcagctatgctgagcctctgaatgatgtgagtcctagaatggggacccacacacaatactttgctagctgagagaataacgtgattgtggctggaagagttacagatggcaaaattggagctttacttcaagcatttaaaaaagtcataaagttacttatattcactgttgtaaatttagacaatgcagacaagcaacaagaaaataaaaatcccttgtaatcctatcacccagagataatccctgttaacatcttgttgtctatctctgtgtatctatgtatttatatgtgtgttttaacaaaaatgggataatatatagttttgtattttctcacttaactatatagttttctctctcggcatccattggggattggttccaggagcccccacagatagcaaaatcagtggatgctcaagtttcttacagttggcctccatatccatgggttctctgacatggaacccatggatatggagagctgactgtgtatttgaaaaaatatacatgtccttaatttatgtttatctcatcagttttaatggctgcatacgatttcattatacagttgaattacgatttacttagccagtaatcgataaaattttttggagttgtcttccaaaagggagtatctttattgtggtagctgatcacaaaataaatacatgcttatgttgaatttttaaaaaagctagtctcaaaaggttgtatagtatattatttcattgataaaaaattcttgaaatgacaaaattatagtaatggagaacagatcagcggaagacttagaagagggtacatttctttgaagtggtggaactgtcctgtgtcctgattgtggtggggcacacatgaatgtatgcatgtgatgaaatctcatagaactgtacatatatacatagtatatataaaaacctggcttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaaaacctgtgaaatctctgtgaggtctgtagtttagttaatagtattaccatgtcagtttttctgtttttgacaattgcactattgtaatataacatgttatcactgagggaagctggctgatcggtacacaagaattctctgaacaaga

SEQ ID NO: 9814 - DNA, 1092 bp, Homo sapiens
aacatttaaagtaaaatttgaatgacaagaaggagacatcatgtgatgatgagttggcaaagcatttcgggaagagcgaacagccagggcaagggcttaaggcagaaaagagcttggagtttaaggagcaggaaggctggaatgtggtgcacaagggagaaagtggcatgaggagaggtcacaggtaggagaaaggtaaatgccgcaaagctttgtgagccggggtgaggaattttcatactttattctaagcccagtgaaacgtcattggagggttttaagcagggaaatggcatgatttggtgtgtgtttttagaacgatcactgtgaggagattggattgtaggtggccactgcagggggaggcaggagagcagctgaggctgttgccctcttccaggcaggagttagaagtggcttgcctgagggtggtagcacagtagacagggagtagtggtcacattcaggctgtgtttaggaaataggctcttcacaccttcatgatggactgaatagtctgtgggagaaagagaagaggcaaagatgactcctcagggcttgggcacctgagtggatagcattcatatcgttgagatgggaagagccggtttggggtggaggagaatcatgagatcttgttttgccatcttacatttgagatatgagtatgtcagatagtgtgatctgaagcttggtggggagagaggacagaagagacccattgggtataatagatgttattcaaggccatgggattagatgaaatcccctaggaagagagtacagacagaagagagatgttctgaggctttggatggtcaaagcagtgtttagaggggtgagaggtgaagccagcaaggagactgagaaggactgagaaggtaggagaaaccccaggagaatgcatggtcacagaagccttaaaggacaaaatctgactggagtaggtggaagataaaacacggggtgaagacagggagtcagttaggcaaatcttccaggtagttttgttgcaaagtggagttgagacattagccggtaattggagaggatgtgggtttgagggagggttcttttttttggtgggagatt

SEQ ID NO: 9815 - DNA, 2159 bp, Homo sapiens
ttcaagcaagcaattctcctgcctctgcctctggagtagctgagactacaggccgcaccaccacgcccggctaatttttgtatttttagtagagacgaggtttcaccatgttggccaggctggtctcagactcctgacctcagatgatccactgcctcggcctcccaaagtgctgggattacaggcgtgagccacaccacctgatcccacctcttaaaagggggaggggggtgcaaaatatctgtactcctggagcttgtagtctaattggaggtatgacacatcaaaagaaaatatgtcatagattgtaagtagtcagagctcattagaggtttaaaagaaataacgtgtaaagtttttagaagaatatctgaccagagttctcagtaaatgttagctgtggaatctcattaatccctttggtcatctgtattccagcaagctcactgtgatgatggttttccaacattcgcagtttccaccagaaaggttttccttagtgttgggtaaaccttccttggatgtctgagtgagctttatgtgcattctcacgttggtttctgtgatgtataaaagtatacccccatcttacagataggaaactatgccctgatttctgagccttgacatcatcacattctccagtttgtgtttcgtgttgaaagttaaaacgtgattcccttttcaggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttattaatgtttgataatgttaggtcattttgggtggttttcttgaattgcaccaaattttatttttaggataaggatgctaaattccgtctgattctaatagagagccggattcaccgtttggctcgatattataagaccaagcgagtcctccctcccaattggaaatagtaagtatcaactcttttgtcgttgttatcaagaataggagtcagccagtagtaaaagtcctagtagtaaatatgttcagccttgggggctagtagtaaatatgttcagccttgggggctattttgttaactgctctttgagctctggcctggtagtgggaaagcagccacaggcaatacataatcgaatgggtgtggctgcttgtctttaataaagacaagcagagggccatagttgcagaccccagatttagaccatgaataagccctttgactctcttttagatagtaggtagattttcctttcatacctctactcccaggagtttgaattaattttcacatgaattgctcactatgatgattggttgccagacattcgcagtttccaccagaaatgtttttccttatgttggccagttcttccttggatgtctgagtgagcatcttcattcattgtgcttgaacacaatgagttggttcaggtattcagaagtttggtgcactttatatagtttggatttattaactgtttgagaatagcaccattagtggggagattctgttaatgaatgtggagggactagtattaatcctgattttctttctttccccttttttctttttcagtgaatcatctacagcctctgccctggtcgcataaatttgtctgtgtactcaagcaataaaatgattgtttaactaaaagcatgtttcatatttattttcctagaagaaaaattatatatatcagtggttcatatgtgttgatcttgtttgatggggaagtgttttgggtgattgatgttaggattccagggagcagtaagatactgtccatcacatcccttgattggccccttaaaccagttgagcagcttataacctcataggtggttgctttaaacatggagaactggaagacactaggaaataatgccttt

SEQ ID NO: 9816 - DNA, 1046 bp, Homo sapiens
cccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaagaactctgctatcatttctttccttgttgacatactaacatttttggttccagactttgcaatgagctcactcttgatgttctttgcatctcacccaggagtctattaggtttaataatcctgaatttcagaactaacctgttagttgcccctaaaaatgttcaaatagagattctgacttctgagtgttaactcttttttttttttgagacagagtcttactttgtctcccaggcctggagtgcagtggcgacatctcggctcactgcaacctccatct

SEQ ID NO: 9817 - DNA, 1030 bp, Homo sapiens
cattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaat

SEQ ID NO: 9818 - DNA, 1027 bp, Homo sapiens
aatcagttgaacctaggaggcggagattgcagtgagccgagatgacccctctgcactccagcctgggtgatagagcaagactcagtctcaaaaaataaataaataaataaataaataattgaatataattcacataccataaaactgaaccttttaaagtgtacagttcagggaactgagatatgaagaggttaagtacctttccctagaatgctgcagaaaaataaaaaggcagttcattttataggtgtgtgcaaccatgcccagctaatttttgtgtttttagtagaggcggggtttccaccatgttggccaggctgatctcgaactcctgacctcaggtgttctgcccactttggcctcccaaagtgctgggattacagctttcatagtatgtaatctgttaagtcttttggagatgtacaagtttcattttgtttccttgatttcaaggttggtgaagatcttcggcaagatatgttagctttacagatgataaagattatggataagatctggcttaaagaaggactagatctgaggatggtaattttcaaatgtctctcaactggcagagatcgaggtaagtttattagctgtgtcttgatgtcttatttttttccttgaacttagcttaaagtgtacctgccgtaaacatcctgatgcagataccctggtatcacagttgtttcttattttaatccagtgttactttattgattcagttgctcataattaagtctctttgaaaaataacttagtggccgggcatagtggctcatgcctgtaatcccagcactttgggaggccaaggtgggtggatcacatgaggtcaggagtttgagtccaacctgggcaacatggtgaaaccctgtttctactaaaaatgcaaaaattagccaggtgtggtggcgtgcccctgtaatcccagctgcttaggaggctgagatgggagaatagcttgaacttgggaggcggaggctgcagtgagccgagattgcatcactgtattctaggctcggtgaca

SEQ ID NO: 9819 - DNA, 1028 bp, Homo sapiens
cacagcctcagcctcctgggctcaagtgatcttctcgcttcagcctcccaagtagctgggaccacaggtgtttgccaccatgcctgtcttttttttttttttttttttttcttgtagggacagggttttgccatgtttcccaggctggtcttgaactcctgggctcaagcagtcctcccattttggcctcccaaagtcctaggattatagatatgagccatccacccagcctatactttttttaattaccatagttttatagtaagttttgaaattggacaatgtaagtcctcctactttgttctttttcattattatttttggctattcaggggacacttgcaatttcatatgaattttaggaaccgtgtatccattgctgcaaaaaggcagttggaattttgataagaattatagattaatttggggaaatattacatacaatcttaattataaactattacctctatatacattgtttacctgttttctctttactaaacaatactgcaatgaactttggttggtgtgtacatttttatttctttgctagtatttctttcagaaaattcctacaggtgaaatagctgagtcaagagcgacatgtatttttagttataatagttgttacattgctctacaaaagaagctacacctgtgtacacctctctccctaccaataagttatgaaatcgtttcctaacacaggatgttgttttaaattttcatctgataggtgaaaaactgcattcatttttgtttggcttctatttctttgactattagtgagctttaacattttcgtatacattggttggccaaatgtacctttgcccactatatttatagcctttggccattctagttttatagtaaaaattaactctctttagtaacaacctttttttcaccgtttgacaactgggcattttataaattgtatccacagcataacttgtctgaaaaatagatcttcattttcattatgtacttacagtatcacatctctttctataggttgttctcca

SEQ ID NO: 9820 - DNA, 1008 bp, Homo sapiens
cagtctgggtgacagcaagaccctgtctcaaaacaaaacaaaacaaaaaaacgtgttttgttttctttggcttgtatttttgatctaatgattaaagtcaggaagcagttctgtaatccaaaccaccaccttgagatatatttctttgtagaaaatcttcaaagactattcttaaacttcctatttctagaagttgttttctgagtccttaccttttttgtgttctgtcctcaacaccattttccccaagataatgtcctttaattctccctctctttgttcccaccctacatttcaatacatttaccctacacctgaaaagtttcagtacaatgtggagagtgaatccttctgatatgttcttaaagatatcctttttatttagttgatctcatactaacttttcaaattcattacatgtgttgtaaattttgaattgatttttaaaatgaaaatcacattattatttttacatccgtgaaggtttttaacatgtggaactaaacttctatatctttggacttcatcacatacaaattctgttcctggaacagttaccaaaaaaggatatgtcatggaaagaatagtgctacaggtaatggtacttcttgacatgtagagaggtgtacatttaaatttcttcataaaatgtgtgtgtgtataccatgatttgggttgttaaagaaacctaactgatcttgttttagtctcaggatctatcttctattttaatatcaatatttctgagaagcagtaaaacatgcactgtacttatcccaagaaatatgtatgtgctgttgagaattaccaacaatggtaatcaattgcaacaagaagcattaatttaatattcaatgtaaatatgccccgattgctaagaaaaatctgttttcttaaagacaaagaggttaatgtggcaaatacgtagactgtaatttgatcaatttctgttaaattttaaaggttgattttccttctcctgcatttgatattatttatacaactcct

SEQ ID NO: 9821 - DNA, 1050 bp, Homo sapiens
tccctagattctacccattagatgccagttgtccccctcagtttacaaccaaaattatttccaaattaccaaatgtctgctggaaggaaaatcactcccagttgagaaccattgatgtaagcagtgatcatcagtgccgccttttttgttttttgttttaaaaccttaaaatctgtgaaaatgccttcctaaaaccattaaatagtttttctgcaacttcataattgatggcttaaactgatggcactagaactaaactgatcaatagtaacatcacagagagataacccaaagagtgtgtaccttttaatttgatagaattagaagtagtatacaataccaactgcaaaatagtaagtattcttgccaaagaactaaatctgaatcaaatcaggcctctaggtctaacttcttctctatggaaaatacaggaggacatgtgaaatgacaccagaggagtataaccagcaaaattcaggatatggaaaattctacagaacaaaaggcctggtatcatcaacaaataaatagaaaaaaagagaaggagaccaaacaagagttaacaaactttttctgtaaagggtgccagataaaagtagtttaggctttgcagaccatatagactctgtcacaaatgcaaaagcagtcgtagacagtacattaacaaatgagcatggctatgtctggtaaaagtttatttacaaagccaggtgtgaaggccagtttgtttacatgtggctataaataaactctgtaaaggcaggttggagtttgctgaccctgaattaaaagatgcttaaaaagacatccaaatgtattgtgccactgcacttcagcctgggcgacagaacaagactccgtctcaaaaaaaaaaaaaaaagacatccaaatgcaagtgttaggccttgcttggatcttgttttaagcaaaccaactgtttttaaaaaacatcatttatgggacaatcagagaaatttgaatagtgactagatattttatggtcttaagtaattattgttaattattttaggagggataatggtattgtac

SEQ ID NO: 9822 - DNA, 1032 bp, Homo sapiens
cctatttaactgggtcttatggcaatatatttactataataacaaacacttatgtagcacttactatgtgctaggtattcatctgagtgctacataggtatccttatatttctcacaactgctctatgaaataagtggtgattttatccctttttacggagtggggggaatcaaagtacagagattaagtgactttccccagggcacttagctagtatgtggtagaattgggatttgaaccaggcagtttggctacagggtctacattctgaactattaccctatattaacatactgaaacttagttgataccatgacacttttttgttgttctagaatatatcttttgaaaccttgtgtcccttgggacagtttgggaaatgctttaataatagatctatttaacttaaaacaaataccgagaatgaaaatttctgctaatctaatactttttcttcttaaatggcaaatacaccatttgatttgccagtaatcatctgttgacaataataggatgttcaaaacactgacttgacaaatttgttcttgaaatattcttttcccatgtgcttaaaaataacatttattggctgggcacagtggctcacacctgtaatcccatcattttgggaggctgaggtgggtggatcacttgaggtcaggagttcgagaccagtctggccaacatggtgaaaccccatctctactaaaaatacaaaaattagccaggtgtggtggcgcacatctgtaatcccagctacttgggatgctgaggcaagagaattgcttgaggctgggaggcagaggttgctgtgagtcaagactgcgccactggactccagcctgggtgacagagcgagactctgtctccaaaagaaaaaaaaaacacatatttattttaaaaatatttttctttattttagtcgcttcccccctatttgaggaggcagtataagattttttgttctctacattttggtggattcagattttaatacctgacataattttgaactaccaaaggctaaagaa

SEQ ID NO: 9823 - DNA, 1034 bp, Homo sapiens
cctaggaacttacattcccctttttatcccctttaccaaacctcttttctattttcatagaatttgcagtggttaaatttcagatggacttctaaaaactcaaatgaaaggtgaccagattatttcagatattagtctctttggaggaagaactgctaatgtatttgtattagttaactaatttgtattatcatgatagaaatcaagttaaactttcttttctcagttatgaaaaatactacttgatatgttcactgtctcacaatggaaaggatctttttaaacctattcaatcaaagaaggttggcacttacaagaatttcttctatcttattaaatgggatgaactgtaagtgaaatttctggctttttattctttcagtgtgtcctgttgtttactttttccaatgtatgcatcctagctttaatttttattgcaattttcattgaaattcattaacttctgacttatgtcttaagatctctcttctagatatgattttatagaacagactgaaattctcattaaaaaatattaaataccgaccgggcgcagtggctcacacctgtaatcccagcactttgggaggccaaggcgggcggatcatgaggtcaggagatcgagaccatcctggttaacacggtgaaaccccgtctctactaaaaatacaaaaaattagccgggcgtggtggcgggcgcctgtggtcccagctactcgggaggctgaggcaggagaatgtcatgaatccgggaggcagagctttcagtgagctgagattgagccaccgcactccagcctaggcaacagagcaagactccatctcaaaaaaaaaaaaaaaaaaaatgaaatacccttttaagcctttatattatgaaattacaaaaacataccattctttttagactttgtcaagttaaagatataaatttatagttatagaaaggaatgaaagttatagaaagacggtattttatagcattgcttgcttcagtatttattctgtaacactatataacaattctggctcttaga

SEQ ID NO: 9824 - DNA, 1074 bp, Homo sapiens
gttgttttagagcaactaatggaaaaatactgtacttgtcacttctagatttcaaattagtattaaccaagcagattttgttgtgtttctgtgatatttcacagtagtttttagttattctgattttcttaatactaaaaataatcttggtttgtggttttccctttctttttgcattatttatttatcgttttattaattctgtagatacttgggaggtttcccctggaaagagtttcttggacatagtatttgacattttatattatgtcataggcagttttctgactattgtgtgtgtgtgtgcatgtgtaggtgacttctttgtttggaggagaagacactagcaggagttcaactaggggtatgtgtttaaatctttaaattttagcaataatcatcgccttttcagagaatctattaactttttttttctttaatctaggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaagtaagtaactgtttaagcagccaggcatggtggcttgcacctgtaatcccaaggctttgtgaggccacagtgggaggattgcttgaccccaggagttggagaccagccttggcaatgagacctcatctctactaaaaagaattttaaaaaaattagccagtcaggcacggtggctcatgcctgtaatcccagcactttgggaggctgaagcgggtggatcacctgaggtcaggagttcgagaccagcctgacaaacatggagagaacctgtctctactaaaaatacaaaattagctgggtgtggtggcacatgcctgtaatcccagctatttgggaggctgaggcaggagaatcacttggacccaggaggtggaggttgcggtgagccaagattgcaccattgcactccagccttgtc

SEQ ID NO: 9825 - DNA, 1034 bp, Homo sapiens
cctacttttgttttagagagacttaattttgctgtaaactttctagcattcaaaatactgttcaacatatttaagagatgatattataataggcaagtttagaagagcaaatatattttctgaagtttagaaaaacacatttatagaatgttctctcaatcttaaatgtgtctaacattcattataggtgaggaaactgagactcagagaagtaacctaacaaactttacttggctagtcagtaatatcagtagtagaaccaactctcttttgcttctggttaagcatgttttcttcccattatatcactatattagttgtgacttctgttacgagtgctagaaacccatcttgaacttaaaaagggtcatgtattggttcacaacccaaatagcagatagaggaaggatgggatagagttcattaacagcaagattcaggaattcattactataaatcatccccccttccttcaattctccttgtccactccatttcctttccttcaccttcctcacttttcttcctctgcctttcctccatgcaatttaatggtctcagtagcagagaagaaaaaggagtccccttagctagccagataggaaacacccataggaggaaagagtggaacaacagtccttgtggccaagaggatgagagatctgttatctaaaaaagggaagtagatcaccactgggagatttttttctgaatccagcattgtcttcagtgtggtctgctttaagcatagcaggatttggggttcccagaacatttttgagtatgtacattattttaatgttaaagaacttaatatttaatgagattttctggaccattggtgatattttattaaaactctgtcttcctttatgttaccttttaaccagcatttcttttcttcagaataccttaggaaaaaaatattatcagtagagtcactttttcttggcaaaggttactctccccagacaggccttgtattttcctgttaggccatgttaagtaactactacatttaagctttgcaagtt

SEQ ID NO: 9826 - DNA, 1056 bp, Homo sapiens
ggggaaatgtgactgctaatgagtgcagggtttctttatggggcgatgaaagtattctgaaacttggtagtagtgatggtcacacgcctgtgaatatactaaaaatatactaaaaacaactgaatatactaaaaacaaccacaatctctgcctcccaagttcaagcaattctccagcctcagtctcctgagtatctgggattacaggcctgtgctaccatgcccagctaatttttgtatttttagtagagatggggtttcaccatcttggccacgctggtcttgaactcctgacctcaggtgatccacccgcctcggcctgccatagtgctgggattacaggcgtgagctgccgtacctggcatgtataccagacagcttctataaaacaaaggagaacctgaagtttacttattttttacttaatatttacctccaaaattccatttattctgtctggccactaaattgagtaagtctaatttataagtaagatgagtctgtgctttgttgcagctgtagtttgattcagtttaccactgggtccaaatactttggggcagaattatgactttctcctcagcaggatttgggatctaagcactgacatgatttcagagatctgttttgccagctgagctgccagctttttaggtcgctgggaggttctctttgttctttaattgtgcttcttgcctttctgtgtctcaggagatctctgcagcaaaggagatctctgccttgctgctcttacccttgcctcaggagggcagctgttttacattctgtgaaggcctggaatgccgtggagagctttttctcagctcttgcctccacagcctttggtagccaaaagcttggattacctcagatggatttctgtctgccacttgccaatcctcctttggaagataactgccttgtacttcagggaggcctacatacttcagatgggatctctttcagttcttctgatctgtcttcagctttcagtgtgctacctgtgtatttagtgaagacctgtaggagagttggtagatgggtacagatgggttcc

SEQ ID NO: 9827 - DNA, 1049 bp, Homo sapiens
gtatgtgacagtatgcatggactgttgccatccggggaagctcacttgtgcttcagcatccagattttcaaattaggacttcattaaataggcatgtttgattgatggattgcccacatagttgagctcagtctctagattggattcagactgatactgggtgacccaaagtccccatcctaaatcacatggttggcctttctggttggccaaccctggccagaaggacactcctgtcaagtatgacatagattacctctcaggagcagagggcacctgtctttgggcaaggctaaattctttaataggtaggatgtaaaattaaaacttacctccatggtttctttaggaacagactctgtagacaatagatggatttgatcctaactccatgtattaataagaaccgacataatttctttcaagtagtcatttaaactacattataacctcattgggtgaatcctctagtatatttttatcctgcttgggcttcactgaacttcttggttttgtttggttgatgtctttctttgtggaaagttctggccatttccttttaaaatatttcttctgtttcattctctctactctccttcttggactccaattacacattatattagaccatttgaaattgtcccacagaacttagacatgctgttgtatacccttccccctctttttctctgtttcattttggatattttctattgatctgtcctcgggtttatcaatccttctgcttagtccatctaattaattattgattttgaatatatttttcctttccagtatttcttttctgtagttcctgttactatgctgaaatgtcccatcacttcatacatattgtctatcttttctactagatcatttaatatttttatcataattttttttttttttttgagacagagtcttgctctgtcgcccaggctggatggagtgcagtggcgcaatctcggctcactgcaacctctgcctcctgggttcaagtgattctcctgtctcagcctcctgagtagctaggattacaggtgcgcacc

SEQ ID NO: 9828 - DNA, 1044 bp, Homo sapiens
ttagcataacacttttgagattcaataacatgtctcttttttattaataaacttttttagaaagtttatagaaaaatcatgaagttaccaatttacagaaaatttgtaattgtagtacagagaaatcccttaaaccctgcacctagtttcccctatgtttaaatttatgtaaactactaatttttgctaatggtcaaacctgcaaggttctagaattaagtttgttgaaaatgggaaacaatatgaagatttcgatcaagacgatgactttctaatgccttttttttttttgaaatgcagtctcgctctgtcgcccaggctggagtgcagtggcgcgatctcagctcactgcaacttcctcctcctgggttcaagcgattctcgtgcctcatcctcctgagtagctgggattacaggcacgcaccactatgcccagctaatttttgtatttttgtattttttgtattttttaccatcccaaacaaactctgtagctgttaagcagtgactgttcattctcttctcaacccagcccctggtaaccactaatctactttttttttttttttttttgagatggaggctggaatgtagtggcacgatctcagctcactgcaacctctgcctcccaggttcaagcaattctgcctcagcctcccgagtagctgggactacaggcatgtaccaccacgcccagctaatttttgtatttttaatagagacagggtttcaccatgttggccaggatggtcttgatccacctgccttggcctcccaaagtgttgggattacaggcgtgagcccctgtgcccagcctctactttttgtctctgtgaatttacctattctagatctttcgtgtgattggaatcgtgtaatatttagccttttgtgtctgacttatgtcacttagcgtaatgttttcaaggttcatacatgttgtagaatgtatcatttttatggctgaatcatatttaatgtaccacattttgtatattaattcattgatggatactgcatttgttttcaccttttggctattat

SEQ ID NO: 9829 - DNA, 1031 bp, Homo sapiens
gaaagggtggtgtcttagaccattcaggcttctataacaaaataccatagactgggtggcttataaacaatagacatttattactcacagtctggaggctaggaagtccaagatcaaggtgccagtggattcagtgtctgctgaagggcctgtctttcccctgtaatcttacatggtggaaggtgtgagggagctctctggggccttgttacataagggtactaatcccattcatgaggattccaccctcatcacctcccaaaggccccgcttccaaataccatcaccttgggcatcaggatttaacatgtgcattttagggggacacagacatttagcctatagcaggaagtaatttgctaagatctcacagctagtaggaggcaggtccaagatttcagccaaagtctgtctaatgccacagccctgctcttccctccccctctttcccctagcacacagtcccagtgacctaagctccagcttttagtagggctgcaccttgttctaagtgtcacattcaccacagggagaaagttgtctccaaaccaagggaaagagggaaggtggaactcagcaagcccctgggcctccctgagatcccagattggaaactggcagcaggcttggctgttttgtgacagcctagattatgtccagaacacctatggagtcagaacaacctcactggcactttttctggcccacgtgcatgatgagccctccatcttcttccttcttacaggaagactgggctctttgctttacaggctcttcttccagccagtcaggtgtcaatgcagcctgattgggcacatctgccacccatctgtccccaactcatatcaatggtgtgagacatgtcctgggcctcagtcctgagcttcagagggaaggcaagccaggccaccctcttcctgtgtgctagtctagaaaaactagcccactcgcacactagaacctgcccaggcctaacgcctgtggatttggcatctccagccaatgtcaccatgagacccacccgagcccca

SEQ ID NO: 9830 - DNA, 1042 bp, Homo sapiens
agtcttgtggctcattcacgccctcacctcctttagcaattggctgcaatatctcctctcccaggcattacctgattccccttcttaaagttgcaactcactgcctctactcagtcctccctccctgacccctcccttgcttatatttgtcgaggggacaatcactgtcttgtcagagacacatcggtaattacgatgtgaatcataagctttatggccttcttttgcacaggccccttccagaatttgttgtaagttctttgtgcattttaaataaatatttcctttcacactttaatgtgaatttgtacattttgtattcttcttcttgttgaagccccccacattgcataagtcaggccccacaaaactcaatgcttccatcctggtatatatttttatacttgttattctgtctctcccactaaatatcagctccacaaggctctacagtgcctagaacagtgtctggcacatagttggcgctccacaaatatttgccaggtacgtgcactcactctgtaaccccaggaatccctttagaaatggaatggaatcttttcttctggtctctgagcctcaccacagaggtttcctactgcaccagctagatggcttctggccatagctaagtccactttgtcttccctctctgctccaggaggcaggagaactaagggctgtcctgacatggccctctgggccctggactaagactggctgagtgaccagcaagagcaaagcagtggcagtccgaggcattggtgggtgccaggtgagcgggccctgctgaagctttcccatgcaagcccaggggatacagctcactacccagcatgcactgcaggcccaatagcctgtgccagacgtggggagcaggggccctccccctcccttgcccccagagatcaggccatctagcagaagggacattgctggacatagcaatgcggctgcctgcctccagtgcagtgggcttccgagaggagtacctgggcgacagtggacactaacccgtggaggagaggcgggactaacgggg

SEQ ID NO: 9831 - DNA, 1059 bp, Homo sapiens
ctgaggcttcagacgagaccaagaggtggaggtgaggggcaggtgctgctggcaccactgggggctggcctgggggggcgggagggatgccctcagaacccagcgtgccacacacagcccctaactctggttttaaaagtggaattggagaagctcaggttttggcgaggccactagactgccttgggggtacagtgagactggaaaggccttggggggctgcatctcatctctcacaattcctgtggggccaccacatttaccttccttgcccctggcctccccctcactctcccacaaactcaccccaaccctatgcccatctaggtgcatggctgcaagcaggaaaaaaggtgaatgggaagaactctggggtgcagaggtggggacaacgcccctaaagaccgcaactcctcttggtggcggatagccggggtctcacacgccagcttttggagggagaagtgttctggtgagggatgaggctggagcctcgggggtcaggatatcaggacagcaccaacaccaccgggaagtgagtgcttgggaagggcttgggagcacagttggtgacgggggaggcaggagggatccaggcatccaagctccagagggcaagcttgtgagggccccaaatacttcctcagccacagagactgtccaagccagaactgtctgggcccctgaaacctgggaccagggcaaagtggctctcaaaagcagggctggggagagactgtggagctcaggggcaatcccacaggagtgcatgggttttacaggttttgtgtcctgggattagctggtgtgcatgtctgaacaaacacatctgcactccctggggggcagggggactccgcacaggataatactgtcattgtccaagagtacagaggaatctgggcctgcctggagagcactggggattcttgactggctggcccagggcacctgtgcttggggcaacactcctgaaagatccagtgtcggggaggatgcaggggaagggccaggtagtgccacagtgatgccactcaggctgagctcttcttgccaggc

SEQ ID NO: 9832 - DNA, 1145 bp, Homo sapiens
ataggtggtctcatgattatttgattgttagaagaatccagtaaagtagggaaaacaaatactatgcttccattttacaaaggagaaatctgagcccaagagagattaagtaatagtggagctactgacttcaaacaaatacttggcgtaaagaaggaaggcacctaacaaatatttgtgaataaatgaatgattgaatgaatgctgacttctcttctagggaagcctctagaaatcattttgtccagtggttcccaaactatggtctgggaagctgtaggattccatggagccagttgggagtagtgggaggctgagtggatagggctctgagcctttcatccctgctccagtcagaataacttcagtgctgcctgtttcatgcactgggagattgaaaacaatttagcgagtctaactcctacagcagtggttctcaaactctgttgtgcgtcacagctctgagggagattctgacagttggtataggatgggcatcaggactctgattgtttaccagcacagatggtcatcgggccactgtttgaaaaatagtgtcctacttctgagagttggagattgcaagacccagggagaagcaggaattagccttggtcatacaatcctgtaggaacataggccccactaggtgtctgatccttgggtacctcttccactgcccttcccccggtaccacaactgcaaccgtgccagaaaacaaatgacacagcagagaagaacaaaatggtttccatagcaatgcttagtggcttgtgcctgtcagaatgcctcagacaaacagtaatctgaaccctcggctagaacttgtgtcaaatgttacctacttgttccatgcaaggggtccatggagatgggaagaaggagaagggatgacacaattttgccatgtgcccctgtattggacggttttcccagattcactaatagctggcctcaagatacaccagatcgaggaaggctgagaagtagatcctgggcaggagatgtgggcaatcccaacagcagaggggaagatggggaagggaacaagtgtccagtgagcgtgtgtcacgtgatggagtctgtgctgggcactttacatattcgtttagaaaaaggcaaggaaaagacgattgttcttattt

SEQ ID NO: 9833 - DNA, 1050 bp, Homo sapiens
gagtgggactcacagcagagcactaaagcacaaagtctcaggcagtatataccctgggcctaaatcctagctgtactccttaacagctaagtgatccaattactcagtctctcagttcctcaattttcttatctgtgtgatggatataataatgtatctatctcatgggatttttgtggaatataaataaggtacatatgtatggagcccggcacactgtaggtacttagtagatattttctgtaaaatttcctacttcatttttttcttataatcaccctaaaaaggaaaatatatttgcttgttttcttgttttacagacaagcaaattgaaactcttagagattaagaaacttgcctaaatccccccaggtagtgtggctcagaggtctgagttcctctgagcctttgccctttccactgggagatgctgtttcccgtgtctcactcaatcctgattacaagtaagttcacttatgcctggggcagagcggacacccagaaaaccgtaactgtatagtgtccatgaactctaacaaagaagtgtacacgtggtcatagcaggctggctctcccaatcctcaagtctgtccgtcttagggaaagatgggatatgcatagagtggtttggaaacctcgctcatccaaagtcacctgctggaagagccttcctgatggctgagggcatccatttctggttctgtggcctttcaacccagaggacaaatgaagtcaactggcctccctgagtttaggttggagtggttataacatcatccttaccaaggagagcttgagaaagggtgcagcctttgggttgaatacttaaattgccccttattagctatgtgatcttagcagagtgctcaaacctcagtttcctcaaccaaaccagcattaataacactaaccttgcagagttgttatttggattaaatgatacagagccaggctgtctgggtttgaatcccagctctaccacttactagctttgttatattgatcaaataatttaatctttgtgtgtcttggcattcttgtctgtaaaat

SEQ ID NO: 9834 - DNA, 1052 bp, Homo sapiens
tggagcttactttgtgttctctgttggctgatggctccctccccagccataggagctgattatgatccagcggccctgatgcagtcccctggcagcatcaacctggttttgcctctggttctgatctcaaggaccctccagtttcctcttatcataatggttgcccctagagggcaggattcaataggctgagaggtttacctacatgccctggcagtacagggagccttcaagaagatggatatctgacctttctaccccctacatcccaattcagaataataaaatctcaggcttgagataaattttcggcattttaaaatccaggcatctatttaatatttgaacgagaggcggcgtggtatagaagaaagaacactggctgaattcaaatcccatcttcaccactttctagctgtgtgatccttataagcaaggaatgccttgcagggccctgctggagaataaagataatctaggtaaagtcctgacatatatgatatgcttcataagtagtaagtaccattgtcctgtaaaccagagctttcaaactttttccttcagaacacttaaattctttcacatattctctatcatatatgatgtttagattcctcacagccctggttactttatttgttattattattactattgttacttttattgtaaaatatatatgacataaatttattattttaaccattttaagcatgcagtctagtggcattaaatacattcacattgttgtgaaaccattattaccatccatctccagaacatttttattctcccatactgaaatgttgtacctattaaacagtaactcccactccccatccgtgcagcctgggcactctattttgaatagcatgctccaaattcctcagtgtctttcttcccattgcaaatggaggttaaaaagagcctcttggaagggtttgagttcttcaaactcccactggggagcccgagaattaaaagtctataccagttgcggcaaacttttgggattgcagatggttacaaaattagtgtcaatatagctgctt

SEQ ID NO: 9835 - DNA, 1072 bp, Homo sapiens
aaaataaaataatgaccaaagtattgaggaagcaaaaaacttcaggcttgtttaggaaagtaggaatacttcagtttggctaaggggaacaggcttagaaaaggttaggatcagatcatcacagagggcctcctcctcagatgttccagggtaaagcatttatatatttaattctatgggcaaaaagatgcctgcttaaaaacttaataagtttaataagtttttaagcaggtgtgagttggaaaaatcctagagttggaaaggattttggatataacctagttcagcctccatctgtattagtacgttttcatgctgctgataaagatatacccgagactgagcaatttacacaagaaggaggtttagttggacttaacagtttcatgtgactgaggaagcctcacaatcatgatggaaggcaaggaggagcacctcacatcttacgtgggtggtagacaggcaaaaaaatgagagagcttgtgcaggggaacacctctttttaaaaccatcagatcttatgggacttattcactatcatgagaacagcatgggaaagacttgcccccctgattcaattacctcccaccaggtccttgtcacaacacgtgggaattcaagatgagatttggatggggacacggagctaaaccatatcatttcaccctggcccctcccaaatctcatgtgtcctcacatttcaaaaccaatcatgccttcccaacagtcccccaaagtcttaactcattttagcattaactcagaagtccacagtccagagtctcatccgagaccaggcaagtcccttctgcctatgagtctgtaaaatctaaagcaaattagttacttcctggataccatggggttacaggcattgggtaaatacagtcattccaaatgggagaaattggccaaaacaaagggctacaggccccatgcaagtccagaatccagcggggcagtcaaatcttaaagctccaaaatgatctcctttgacactgtgtctcacatccaggtcacttgatgcaagaggtaggttcccatagtcctgagcagctccacccctgtggat

SEQ ID NO: 9836 - DNA, 1029 bp, Homo sapiens
aatgtttcctgcatcctcagtcattatagatttcttcagaacagtaagtggaaagaccacagactttggaatctaagaaaactggatttgaatctcaactctttctcttactgtgtagtgatttctcctaagtcatttaatctctttaaactacagtttccttgattgtaaaataaggagaatggcacctgttgcttgagattgttgttaggattgacttactacatgaaaatatggatgcagagtgcttgacatatagtaggaactcaagtatctcagcttcttttcttcctttacatgcccagtgatgagtgacagtaaaaggagggaggaagactcagaagaatagatcaaccccaagccaggccgcagaggatgacaatatagttcattgtcatctcctggcttcctgtgacactgaggttctcactgaggcccaggcatcttggtggatccccacttgctcaaccctgggcatatcagaattcagacttagaatctcctgactttaagtgtggcctgttctctctgtttctgtgagctacaggagatagacaagtaacaaaagaaattcaaggaactattataggttggggatccttatgcaggcttgatgtctgggcttgctgtgagaaactcaagttcatttcatatggttggttctcagggctaaaaatctgtgcgttggtttcgttagcatatcagctcctctcttcacacactctgtgttggaactgccacagcatgctgcttttcataaaagtctctctttcaaaccaagtccagctgtttcagtcctagaaggcagccagattagttctcttctgggcaaaatggtaagtgcttatcactccccacaatgcctccagcaccacagaaataacagccaccctttactgagtgcctactgtgcttcagtcctttgacatcactatgagtggttattattagctcattttatagggcagtaggttatgattaagactgtagactttcaagtttgaccaaggttcaaatcctggccccacc

SEQ ID NO: 9837 - DNA, 1977 bp, Homo sapiens
acaaaatagtgtatgtacatagtttaaaaattttctaaatactaaaaggcttagtaatggcaatttctgcctcaccttttcccactcttttgtccaatttccggagccaaccattttgaattattttggggtgtctatctctatatttctaaactaaatgtctatttaagatatcaattttaaaataaattttatctgttgctttcttataaataaaaatttaattatcttataccaccaccttcatttcccttccctccatcctcacgtgtagttaagtcattagtctattattatgagtagtgtaaatactgttctcactgctaagccaagtaatatatcatgatatggttcctatgctatacttttcttttcctggagttaaacttgcctgtttattttccccttcctttaactgactttctatataccaattactaattgttcccaaatgcctccaaaacatctataaaacacctcttacacgctttgcaacatggtcaaagacgtcaactctttcagcagtctccccacccccactttcaccacatgccactctggggttcagcctttctgttccactctgaaatggttactctaggcctgcaccgtggttacgtgatgacttctctataccatttccctgtgttaaatccctgttccctatcttccttcttctttagattagtctcattttggtggggcacaggactcagtacctttcccggaaaagaggagttgaagataaattttttggttctttgaaattctgaaaatatacttactctattttcacatttgattgacactttcactgtttgtagaaatctaggttggcaatttttttcattctgacttttgcatgcatttcccattgtcctctagcatctaatgttactattgagaagtctgctgctttttctaattcctgtttctttgtacgttgccatttttttttccttgaaattcttaggaacttctctttacttcagtgttttgaaattttatgatgacatgccttgatatgtatcttctttattcattgttctggtatttattgagccttctcagtccagaggcttaggcctgccagttctgggaaatctttcttgaaattgttttacaattttttccttatttttctttgttctgtctttcagggacttctattgaatgtatattgaatttcctgactcctaattttcttatcttttctttcctcttgggcatgtttttacttttcttaccactttgtgagaaaattttttgacttgatcttccaacttttctaatggaacttttattcagctattatttttaatttctaaggttctttcttatttttaatcctttaaaatagttttctgttcttgtttatattgccatatcatctatcatttttctatggatattaattatagagtttaaacaaatgttttcttctctgccttgactctgtttttttccaatttttaattttctatttctttgttttgggttctgtctttcacactggagactgtgctttatgttttttgtttgccctgtagatgcattatccaccttttttcacactccatatatccctagggaggatggcctctctatggcctgcatcaactggccctctggcttctggttgggttcagctaatgagaggaacggcagatctcaggactgaaaaacaacgaggtcagggtatttattctcctagcttctccctgcttacctgccatggctgcatccctctatcagggattccagtctggtgtccctctccttaacttcaccctctccaattcaccctctccaagggtaaccactcctttcccttacttcttcaggcttagaggtggtagagctctagttttatctagtagtcctggaatataaacattgtccatacctctgtaaatggttcctttattaaactctcacctgctgtccagtttgatgtggtcttctgctgagattcta

SEQ ID NO: 9838 - DNA, 1053 bp, Homo sapiens
acagcatgttactgtactgaatactgtaggcaattgtaacacaatggctgatcagttatctgaaaactatttatggagttctttggctgccttcctgggtcctgttgctaccagagcagccgtaaggcattacccaaaattgcacagctggtcagtagcagagctgggactagcactcaagtctagcttgtgctattcagaaggagatggtgcctgattctcaaggggctttctcaagtggttgcttgagctgtttgccagacagggagacagcagctaaaggcagagcaacagttttttagttctattggttaccagtgctctgtcccaggtcttgcctttctcaggcaaaatatggtacaaaagattaaagatgatacatctgtatacggcatttactatgaatggagctttcaggactggaagttgttctgggtgagtcagtgagtgagtgatgagtgaatatgaaggcccaggacattattatatactactgtagcctttataaacactatacacttaggctgtaaatactgtgcacttaggctacactgaattacacacaaaaaatctctttcttcaaacgtaaattaaccatagcttactataacatgttgctttatgaactttaaaaaacttttttactcttgtaataacacagcttaaaacacattgtacacagtacaaaaatattttttaatatattttataagctattttctatttcttaaattattattattattattttgctttttaaacttttttgtttaaaacacaaacacacacattagctcaggcctgtacggggtcagaattatcaatatcactgtctttcacctccacatcttgtctcactggaaggtcttcagaggcatgtatggagccatcatctccaatggtaacaatgccttcttctgtaatatctcctgaaggacctgccttttaggaggtatttttacagttaacttaaaaaaaagataagtagaaggaatacactccaaaataacaataaaaagtatagtatagtaaatacacaaaccagtaacatag

SEQ ID NO: 9839 - DNA, 1059 bp, Homo sapiens
tgtctgccttgaaaataatgagttcacgccagcgtctttagttataatgcagcactacagagttccttctatatctcactctttcagttgtaattcatttccctgactatgagaaacctggctcccattatcttcaatacatttacttacttgctcagttctcctgtatgaaaccgacccattgcatcacagtcctgctgactaccttccttgcacaggttgattccccaccaggccacagctgtccagccaggctctgaaccttcactgggaccctgctgccccttcttagccacttttctcatgtaggttctgatgcttggccactttcctcacttaggcttaagaaggaagctatcctgtcttttttttttttttttttttttggttgaagtgtaacttacctacagtaaaatgcacagatcttaaatattcaactcagtgacctcttatatttgtatgcacccatgtaatcacccaaattaggcacttcagtaagcttcctggatatacctatcccaaaataaccattattctaaactttcaccacagattaattttgcttaactttttattttgaaatgatttcaaactcacggaagagttgcaagaataatataaagaattccacaaatcccttcacccagacacagaatgtattaacattttgccacatttgtgtcctctctctttttaaaacaatttaacgttgatagaatactcttatctaatctacagagcttctgtatatttttccagttgtctcaatgatgtcttttatgacaatttttcactttgatctagcatccagttcagaatcatatattgcatttagttgtcatgtccccttgcctcctttattctggaatagcttttctttatctcttatgacattgacattttttaagagtacaggacagttgttttgtatataatgtccctcaattggttttatctgatttttcctcatgattggatttcacttacacacttttggcaggaatactaaataagtgatgttgtgtctgtctttagtgcatcatatgaggaggcacctga

SEQ ID NO: 9840 - DNA, 1035 bp, Homo sapiens
ttaacttttgctgccacctgaacaattgcaaataagcttctcttcccaaagctctgctctggaaatgtctgtcctggttgcagcctctacaatgtcagcttccattgcttgctgcccaggcctctcctcatttacttgtttgcatctcaggcttttatactaaatgttcattaaacattctacaatctatctagggtaaccttgtcagaacagggagggaaaaaggaaatatctatcttctttcttgtcatttctctcagatgaatgaattaaatatttttattgccttgaagattaattatcttctgtccccaggccagctttagtattctagctgtatcttcttgtgactggacctgccagttggagtttctgcccccactctcaactctgtgtttttgccaggtttttcttcatcatcatatcatgtaggcttccgcagtgagtcacagtccaggggttcagagagactagagtgtgacctgcagggtttagaataaattttgaattatctatcttagagctgagagacctcctgaaatcttctggtcctttctggcacatgagatactgttattgtacttaacaagtgaaatacctgagacctagagagtttaaatgaccaagctaaagctgcccagctaataaattatgagtcctaatggcagattttatccttccgaggaaagccaactcttaatttggaaaaggcatcaactctctggattctctttgcagataaaacagtttaggacctccttttgtaataacatgccttgttagtgtaaggaaggaaagacagcttagaagtcatttccttggggcaggtgatgtctggtagataggcagatatcccttgtcccttgtcttctagaaagctcatgagctcagcatgttggcaactctagtcctgcatgcttcttgttcagctaatccttgcaggcgctcatgtacaaaatgattttttgtttgtttgtctctgaagtggcttctcagtccttgagggccaccaggcactaattcctcgtttctgcc

SEQ ID NO: 9841 - DNA, 1032 bp, Homo sapiens
gtggtagaagaagtagtgaatgctttggctccctcataatctagctgggtgattctgcgcaagtcctttattatgcctctcacttttgtcagctataaaatgggaatatagcatctatttaataggattattcgaagattaaaatgatcattcattatgaaagtgtttagtacaatgcctggcatacattagatgatgttcagttcgttccttggtttttaaactttttaattttgaaatatagattcagagggaaattgatacagatgatcctatatacgcttcacccagcttccctcaatgatagaatcttatgtaactgtcgtatcatatcaaaatcaggaaatgggcattggtacaatacctcttgttaactaggccacaaatggtattcagattccctgtgtttttttaaagaaaaattatatcatttctgagtttgtttctggttctgaaatgtttttatacagtgtcatcattatccttgacttttctctggcatctaactttttagaagctttgttctctgttggttttcataacactgtgtatttctccttgtcatccccctgtctccttcaccatcttctcttcttctcttctatactgtatgtctcccagattcagttcttagcccctgctcttctctctgtttgttttgttttgtttctccctcttggatagggtcttacttttatctttattctggaatcagtattcccacctccacttaccaagcccctctctagttccctgtttttgactatttgctgaatataagctcaaactcatcatatccaaagctaaatttgtcatttttttaaactccaaactactacccagctacctccacttgacttccctgcttccattaatgagttgtcattcaaaaactgctcagggctgtacgaggggactttttggtgatagatatgctcatcatcttgattgtggtaaagattttactagtgtaggatgggcatggtagataatgcctataatctcagcactttgggaggctgagatgagcag

SEQ ID NO: 9842 - DNA, 1068 bp, Homo sapiens
tgatatactcatgcagtaagtctggagtggagcttgagaatttgcatttctttcttattcatttatttatttatatttccatagatttttggggaacaggtgatatttggttacatgagtaagttctttagcggtgattgtgtgatttttgagacccattacccaagcagtatacattaaacccaatttgcagtcttgtatccatcacccacttcccacccttcccccctgagtcattgaagtctattgtgtcattcttatgcctttgcatcctcatagtttagctcccacttatgagtgagaacatacaatgtttggttttccattcctgagttacttcacttagaataatagtctccaatcccattcaggttgctgcaaatgtcattaattcattcctttttatggctgagtagtatttcatcatatatatgtaccacagtttctttatccactagttgattgatgggcatttgggttggttccatagttttgcaattgcaaattgtactgctataaacatgcatgtgcaagtatcttttttgtataatgacttctttttctctgggtagatacccagtagtgggaatgctggatcaaatggtagttctacttttagttctttaaggaatctccacactgtttcctgtagtggctgtactagtttacattcccaccaacagtgtacaagtgttccctgttcactgcatccgtattcaaataatattcccagataatgctgatgctactgatttagggaccacactttgagaaccgttgtgctagggggataacagggatgaagttaataagaaaaaacagataaatgatagtgattgttccactccaggatatttgtattctctgccttttagcttgtacatgtccatagagtaactattatcagaccaggcttggaatgtcttattaattattacacagcaacaaaaaccaacacttattgagtacttattatgtgccaggtattgtgctaacacctttatatagtttcacttaattctgataataatcctgtgaaatggatactatagttttctagcttggtgt

SEQ ID NO: 9843 - DNA, 1950 bp, Homo sapiens
atgcctgctggcagcatgccagtacagaaggagctttggattcactaatgcttggttcatggttagacttccgtgcataattagtatttttaaagtcattttatctaaagacttcaaatttagagactctaagtacttgagagacattttatggattgcagctgagtttaaaaggatcttgcagcattttctcctcagcccttactactagccagctgcttctaatcacattcagtaaagtcctgtgacagactctttcttcttccagcttcttgcagaagatgtcatgccccaggtcggcctggatcttcctgagaagctgcacaacagtgtttctcaaatttcaatgtgtgtgcaatcacttggggatcttgttaaaatgtagaagattctagctctgtaggtctgagtcagtagggctactttccacttctaacaggttcccagatgatttcaattctgtgttctgagtagcaaggaaattgctaaatgtcaggcatagacggggctttataaatggatcatcacatctgagactgtgactttacaaaggaggacacagaaatccaaagaaggagagtgacttgcctgaggtcacacagcaaattagtggaagagaccaggaccaacactcaggtcatcattttccttctgtgttgtatgtgtgcttttcctctgctgatctagcaatgtaaagaagcagaaataaggtttcctacttgcattttcatgtttacagcagcctcacagaaccaaaatcgggtatgttggtagtctagacttgcctgaagcccttctttcttaggttttagtgaggcatttaccacgggatcttaagcagagcctctctatgacaccaggctttgtgttcagtagtgcttgttgaacaggacttgagtcccttccacactggacaaggggaagtgggtggtgccaaaaattgccagatggccccaaatgagtctctagtgtgggttaaccctcataatccaggagcaaaaggtgtgtctgggacactgaagcagccttcagacttcagaatttgcttagcactctttcttttaggatgtgctaagtggcaaagagggcataccgggaatagagtaggtatgtttgacccagagaccctgtcaggggcctggagttggaacaacaaagcagccaaagaacatggtgacaggcgatggttggtttatccgtcaaagaggtcctgtgagttggggaggggcataggagcagacagtctgcagtgatctagaccagtgggtaaccttttcattctataaatatttgttgtgtgcccattacatgccagatactgaactgcacagtgggagatgtggagatgaattcctagagctctggtctcaggaggccctccaggtggattctgcatcaagatagtcttttggagtaatagcaaggtaggactctggtcttggtgaaacggtttattaggtggggattcagatagaggaaacaatcaattcagggtcacacttgctgaacctctggcataaaggagggcatggtttctagaataaggcagatacccagtgatggaaaccaaggaacaagatcagggcaggaatgggcagcacactgaggctgcttctgagctgctaacctctgaaacttgaaatctttcctgatagaagacaggggtacgctggagtaaaggtcacctggtgtggacgtggagccaggcactctgatactggaaagacttagccatgcaggttttccatctgtttacctgtctctccctgcctctggccctgcttgtgagaactgtcttcttctgtggttgtggagggtaagattctggaagcttcttaggatcaggccctctagggtagcagaggtggcagaggctcctctccccatcatcatttgtactaacatgtctcagggcctcttagggctgagatgtcgttagatatctcctga

SEQ ID NO: 9844 - DNA, 1050 bp, Homo sapiens
tctacaaggtctcagcaacaacaaaaaccaaacagcccaattttaaaaaagggcaaaggacttgaatggacatttctctaaagataatatacaaatgaccaagattatgtgaaaagttgctcaacatccctaatcattagagaagtacaaatcaaaaccacaatgagataccacccaacacctattagaagggctactataccaaacagaaaataagaagtgatggccagaatgtagagaaattggaacccttgtgcactattggtgggaacgtaaaatagtgcagctgctgtggaaaacagcatgacagttcctcagagcattaaaaatagaattaccatatgatccagtaattccacttctggatatatatccaaaagagttgaaagcagaatcgtgaagatatatatgcatacccatgtacatagcaccactattcacaatacccagaaagtggaagcaacccaagtgtccatcaaaggatagacgataaacaaaatgtgatatatacatgcaatggaatatcattccgtcttaaaaaggaagggaatcctgacatatactacaacatagatgaaccttgaggaccttaagataagcaaaataagctagtcacaaaaagacagatactgtatgatcctgggatgggtacagagttttagttttgcaagatgaaaagagttctggagatggatggtggtgatggttgtagaacaatgcgaatatacttcacaccactgaactgtacacttaaaaatggttaagatggtaaattttatgttatgtatatttgccacaattttaaaaattggaggaaagactcatcagcatatgtgaaggacacttgtatctacaacttattttaaaatacatttaaaaagattggtgaatagagagagggatggctagatttgtgattaaagcaaatacagaaaaatgttaactatagaatctaggtagtaggaatatgagtgttcattgtacaattatttaagcttttctgtatgtttaagcttttctgtatgtttaagcttttctgtgtgtttaaaa

SEQ ID NO: 9845 - DNA, 1969 bp, Homo sapiens
tctgcctcccaggttcaagtgattctcccacctcagcctccccagtagctgggactacggtcgtgggccaccacactcagctaatttttgtatttttagtagagacggggtttcaccatgttggtcaggctggtctcaaactcttgacctcaggtgatcctcccaccttggcctcccaaagtgctgggattacaggcgtgagccactgtgcctggccgccttttgattttcgtatctttgctcatcccctcacgctgctcctgcaatatcctcccttggtctcccattttcttttcttatccagaagttcaccttaaatgcctcttgttccctcaagcctgccaggacaattctagttccagaccccttaggtgttctttctccatacttctcatttggcctctgtcgttttctgtggtacgttgatatcttttgcagtctatacttcttggctctgtagttatttctctgtgctaattcttacatggacatgccttataaattgtgttgcacttgctgacttcgttttgagctattttgtcatctctgtcatttatcatttacctggagacacatacctatactttttggatgacattagtgtatctattttttttaatcatagtaatatataatcctttaaggagaagatacgtttgttaaatttgtgatttgaatctccctggatttgacagcacgcatcagcttgatgcagacattcatctacagtgtattaatgagcattttttatatgtggattcattgttttttttttactccagatgacataaaatcatcatccatgtgtttatgcctttatttcagcacttacagtcctgagttctacatgggctcctgggaagaagattattctagtgaggaaagctggatggtacacagagcatatccatttaatctgggttttcgtcttcctcaaacattgtaaaaatggctatttcatcagccaagttttgtcagtttgggacagcagctgtgcaatcattggagataccactggccctggagtcagaagacacaggtttaaatcttgattcgactatttggttgttgattgaactcaaccaaatcatttaactctcatcatttaacctcatctgtaaaataagcttaatactctatatgccatagcattattgtgaggattgagccagcgtcaatgaatgtactgggtacctgggaagaggtcagtaaatgtctgtttaaaagaaaaggaaaaataaaagggtctcttctgtcctgggtgagccttctgatgcagagtttattttgaggagaaatagacaagttcagagtgtgttaaatttaggcttgagactaaagactgaacgttaagtcagcctggtttctggacttgtcttaaccagaatgtctatggcctccgcagagagtatgaggattaattagttaatctttgtaaagtgctttgaaggtgaaaagtgctctgtaagtggaatggctgaattgctattggggatataataatggtggcaccatattctgccagtcttgcctgtctttgacttcaataatcaataacaggaaagctctaagatgttttacttcatgtgaaagaaaggattcaatgcgtgatttctggtaaaattatttctgtagtcttagagataacaacttcctagtttttcccagcagaggaacggtcatttaagcagcaacagtctcatcccctggtttcttgggaatctcctgctgagcaatctggttagaaatcctagccagctcaggtagagggacaatttgccagttttggatgccctatgggtcctgggcacatgggtttttaagaggctaatcttgcagaagtgaaggaagagtgttgagtgattatgcagtgactagtgcttaataaccaatgcagagtaataccatgggctagtagaaagggatgtggcttagctgtgtgaccctgggctagtcacttctctgaacc

SEQ ID NO: 9846 - DNA, 1030 bp, Homo sapiens
aatttgatggggacacaaccattcagtctgtagcagccctttaggctttagggagggggcaacagatattttgtctctccttcctggagaaagcttctgggggagttatggtggtgaactgccagagggaggaggcctttgaagcaggaaagggcaggtatttattggagcaggttagggagtggtggctggtggtataaagcccactgagaaatggttaaatacctttcccctctgtgcctgtgttctagcagttctttcttccaggaatgctcgtctctgtgattcctgcatagctactgcctcacttccattggttcttgtccaaatgtcacctcttacactctattcccttcactgtgttatttttcattatagcagttttcattgcctgaaaccatagtgtcattatatgtttacttatttgttgtcattctctcctaaccgaatgtgagccccacaaggttagggacttggtctgctttattcatccctggatttctccaactatagacgagagactcgagtgctggtggcatgggatgggtagaacttttggatgtggaagtgatgctatttccaatggctgtgttcaggagatacagcctgtagctggccctgccctcttcctaccttcttggagaagcccaggccacagagcctcagctccctgaggctgacagtgatgcctgatgccccagcgttttaagaccagctttgctcctgcctatctgcaaggccttgccttgagaccttggcttccccatctgtccatagtgagtggggtgaccagccatgctgcaagctcaccagatggttctgggaagggtgtagaggtccctggcagagagctcagtttccattcaaagaatcttcctctttcctgatggagattgatttgttccaggagctctctaaaagtaagcatttagttactggcctgtaattttgccatcatttttaggtttttggcagatggcactctgcttgccctttctcaggggaccttgcctatcccatgggtgctctc

SEQ ID NO: 9847 - DNA, 1042 bp, Homo sapiens
ccagtgggtatccagttcctcccttccttttacagaagaaggactagagaccttagggtgagaagtgatgtgttcgtgccccacagtcaatgagggatggagaaggcattcttttctgagaataaaagtagactacgaggtgtttctgttttgttctaattaatttgaaatgactgatggtatgtaaacctagagcttgtctaattgtttgccaacttcaacttcttaaaaattcttgttggtagtaaatttgttatttcatatgtagggcacttttattatggtgttatttatatataaatgttgaatattttaattaagatgtattttaaatataagaaattaaatttcttttaaagtatacaaagaacttaagtttcatttaaagtatacaatttagtaatttttaatatattcacaaagtgaaatggtttttgatattttgaaaatgagctaaagattatggagattaatagccctgctggacactgtggctcacacctgtaatcccagcactttggaggctgaggcagatggaatacttgaggtcaggagttcaagaccagcctggccactggtctactaaaaaatggagtttttttgtagaaaccccatttctaccaaaaaattcaaaattagctgggtgtggtggcacgtgcctgtaatcccagctacttgggaggctgaggcaggagaattgcatgaacccgggtgacggaggttgcagtgagccgagatcacaccactgtactccagcctgggtgacagagcaagactccgtctcaaaaaaaaaaaagattaatagccctctctttcttcatctagttcaagctgttacacattggattttgttcaatgctctttagacactttctctggagtggttgtagattatataactatttggcattgcagcagaatttaattttacctgctgaggcaacagcataatgatcctcatctggaagacagtttgactttcaaaaagatggtttagagctactaagataagtgaagttgtttacacaggcttcatcgtcag

SEQ ID NO: 9848 - DNA, 1029 bp, Homo sapiens
ataaatgtgaagatggctaagtcatgatggccatattttgtcaaaatgctatttatatgtgaaaatgttggttttacttgacgcttattattgggtattataatttttatgtcaaagttcaggtaataaattgtgtcttactttgatttgcatttttaaattaatgagattgaaatatttggatgtcgtatgttaatttgtttcctaccttttaataatttatccattttgattatttgtatgaatttcttgggtaataatgtatcttttccatatttatcgcatgtatttttttcccattctttgctgttgtttctgttttttggagcaagggacatcgatatttcttaacttttaagtggtgggaacatcaaagaaaggtgggctgagaatacacgagtgctatgtcatgcaaattcttatgtcatatttaggggatttagacttcatcttgaaaaagctgaggaactactaaagattttttacttttaagcaccaagtgatacgatcagtttagaaagattactccaaaagcaatagagaggaaggagtagagagagttgaggctggagggcaggagatcaactaacaggctcttgtggttggtaatcttcaagaataatctgaaaaatgatggcagcctaaacaatggaagtttgaatggagaggagggatgggggtaagagagatttggtagaatagaattgagcacttgccgggaggagtcagcaggaggggagaaggaaaagtcttggctgtgttccaagtttgtagtctgtgtagcagggtggatggtggtgcccttcactaaagtaaagacgacagtggagaacatgtttgggttacataagcctccttgatgttggtgggttcaggtgggacatttgaaatgcctatgaagtcaggagggaattgaatatcctgatttgtttttattcactagttaaagcttgaaaaattttccttttttgacattaaatcttgttgttgttttaggagacggtggctcagggagtaaaggaaggccag

SEQ ID NO: 9849 - DNA, 1088 bp, Homo sapiens
ttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcatttt

SEQ ID NO: 9850 - DNA, 1033 bp, Homo sapiens
gcagttcttctgcctcagcctcccaagtagctgggattatggatgtgtgctaccatgcctgactaacatgttctaaaccttgcttcatctttttcgttctaacctctaagattagataatcacaaacagatccttgagaaatctcttctgcagttacgtaccagattatttaatacaacttttaagtgactaaaactttgatatccttacaagcaaattaagttttggcttatttgaaaattttattttgctattcaagttattttcatttacaaggtaaagaggaagagattgcatgtgtatgttatgattaaataaactttatttctttctcacattccttttaggcagctgctgcttttgtgatgtttcctgttcagacaatcacaactgttgactcctgtgttgtacagttagattatttggatggaaggctacttatatcttcacttactcgatccttcttgtgtgacactgagaggtatattgaccaaccattagtcatcagaaatgcagaattttagaactgggaggaacttagaagttatctaccccaagccccatcaatcagttatacagattttttttctttttcttttttttctttttttgagatggggtctcactctgtcactcaggctggagtgcagtggtgtgatcatggctcactgcagccttgacctccctggctcaagcgatcctcctacctcagcctctcaagtagctaggtctataggcacatgccaccatgccctgctaattttttgtattttgtttagagactgggttttgtcatgttacccaggctggtcttgaactcctgggctcaagcaatcttcctgcctcagcctcccaaagggcttggattataggcatgaaccactgcccctggctatacagatgttaaggaatcagttgtatgcaagctgatgttagagagcagagaggaggtagaggagtctaagacagtccagtgggtgactaagacaagtattccgtgagcccgttgctggtgagacatattctaagtgcc

SEQ ID NO: 9851 - DNA, 1047 bp, Homo sapiens
atctgcctatttgctaactcctatccaaaaaacataattctatcaaaggcataccctgtactaagtactgtgaagagctagaacaatgagggaaagacgattcctgctctcaagttgtttataatcaggcttctcttctagcaaattcttccccatcttagaatgaccttcccttttccccctaattttctttttttttttttttgagacagtgtctcgctctgtcactagagtgcagtgaggtgatcccagctcgttgcaacctctgcctcccgggttcaagtgattctcctgcctcagcctcctgagtagctgggattacaggtgcatgccagcatgcctggctaatttttgtatttttagttgagacgggatttcaccatgttggcctgtctgttctcgaactcctgacctcaagtgatttgcctgccttggcctcccaatgtgctgggattacaggcgtgagccaccatgcctggcttaactactaattttctatactgttctagactctaggctgaaatgtagattcagcttctccagaggcctttctctaacttagatgttctttgtgtcaatttgtagtttcctgcctgtacttactattgtatacatattttgtttattatctcacttttacatatgttaattgtaagaccttcatacacacctgttgaagtttgtaggcagtagagctatatcttttttttttttttttttgagactgagtctagctcttgttgcccaggctggagtgcaatggcaccatctcggcccactgcaacctccgcctcctgggtttaagcgattctcctgcctcagcctcgcaagtagctgggattatagtcgcctgccaccatgcccggctaattttgtatttttattagagatggggtttcaccatgttggtcaggctagtcttgaactcctgacctcaggtgatccacccaccttagcctcccaaagtgctgggattacaggcgtgagccaccgcgcctggcgagctgtatcttttttgcaggtgaacaacttaaggctctgagagag

SEQ ID NO: 9852 - DNA, 1029 bp, Homo sapiens
taatcttggttctgaaagtgtttctacccattttgtattttaatttttattaacagaatgctatctaaaaggctaaaatagagataagttttaaagtctttatttcgaatagttctacttcatgcaaatacaaagaaactgattcaatatgtttaagtattcattgaatcataattaataacaactactaagtggatactaatgttctcttaacttggtaatgtatttggtttgaagtattttgtatatttaaagctgaaaaccaagtctcccacttgcttagtcatatagaaaaacccatatgtctcccactcattatgtaaagatgactcaattgatacttgttcacatgacttcctcatttgattcctagatgtcttcaaactgtaacctgaacgttgtgttttcacttgagcatactgcaatcttgagatctcgaagtaataacatattcttgttttgtcccttttagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaa

SEQ ID NO: 9853 - DNA, 1042 bp, Homo sapiens
accatttcttttttcttttgagacagggtcttactctgtcacccagaatggagtgcagtggcatgattttagctcactgcagcctcgacctccaaggcttaagtgatcctcccacctcagtctcccaagtaacttagactacaggtgtgctgccatgcccggctaattttttattttttgtggagacggggtttcaccatgttgctcagcctggtctcgaactcctgagctcaagcagtctgcctgccttggcttcccaaagtgctgagatcacaggcatttgccgtcatgcccagcccactttaaccatttcgttttagtatggcctgagcaaaacaaagacaatgagagagtcatgtgttaattcattcaacaaatttttactgagaatttatacttctaggggtggaaagaagataagtatgcaagtaaacacaaacatatcaggtagtgaatgataggaatgaagatgacatgataggaggaaggggtggaagggctactgtaggctagaagagttcaagttcaaatatgtcagattcattcggcaatttaatagttctaattattttataaaaaagggaattggcataggttaaaagattctataatgaatatagtttgttggaaatttaaaaattattattctattattgtgggttttactgaagacttgaaagagttaaaccagcagtcagaataatttgtaccatgagagaatataactaaagctaatagagcgcaggtcttcataaagcacctaaatttgccccttaaaaattctctcttcctgcagttttcaaggcacctactagtagagattttgagtgggaccaagtacttaagaaacaaaattaaaagcttgtagtatacttttagctttgtggattctgaatttcctggttcccaaggaaaagacctattaacaactagattaaacttgttttgacaatggagagaagaaaggtctgaaggaagaaaaaaggaggtccctagtttataagagcggtttttagcttttgccagtcccgctcatggtaag

SEQ ID NO: 9854 - DNA, 1064 bp, Homo sapiens
aagtggtgagtcagacatcagtgaacggtcttcccctagctctgggaaatgcacaacttctccagagcatccttgaggctgttctcactaggcttaagcggaagacagaatccacctctcccctttccaatgtgggaaaaagtgggaacaacttaacaactttgtccaaataaatgttttatttaatcctcagctcccctcatacctttccaaccacttaatagaataaagtgagaagtcaggagttcttaccacaggataataataaatacaataataataatgatgggataggagaaaactttggaaggtgattgatacagctatggccttgaagatgctactcttttcatgagtgtatactcatccccaaaatatggacagttttacatttcaatcacactttagtttaagaaaagagagttctttgtgagccctgcttacatggcccagcatttccagtttggaatgggggagtatcatctgatcttggaagctaagcagggtcaggcctggttagtacttggatgggagacctcctgggaataccgggtgctgtaggctgtctacgaccataacaccctgaatgtgcctgatcttgtctggaatgggggagtagagtgtccacctgctattctgttctacgcatgtgggcttccacccatgggacagaaagagtactattttaacatcctgctgcataaagaatatttaacttcagaaatgtctatcaaaagcctcatcttctgctgtatcttgcagaaaagcaattaatttgatctatataaatcccggtcaaatgtactccattgagataaattggaggcattatatcactcttttccatggagtctcctcacttcaggaaaatcatgagactttgaaagtgacttaaagctggctttgtctttcctaggttttccttttgcttttttaaaagtgcattatgtcatgtcctaactgctagattgggaatctgatttcgtcagaggattctgggtaaagatcaacagacaacaatagctctgggaaattttaactctgggttccgaaaagattatttg

SEQ ID NO: 9855 - DNA, 2003 bp, Homo sapiens
attatttaaactttctgatgccttatggcccttaaaatgcaaaatgagaggattataagatttcataacttcatggttaatctgaagatattttacacattagagatgtagttggttggtttccttcttcatatgtctagaaaaactcatttcatgctcttttctgagagatagtcaatggtcttcagaaaccctaaggacaaagatagccccaacatgacccagagagaggaatctgagaaaaaatttaattaatcacaaacaagtttaaatttagtttactcacccagtgttcttaaatgttcttttggtaacatctttgaggaagtcaactctagtcgatattgtcttttcagtgacaaagtgtcaagtaccttataaggtgggcattgtgtcttggatcatttttgtaacaaagttcctctttcctttgagctacatttggtgatccagagttttctactctttctccctgcttctattctttttgctagtacaaaacaatctgtagacaagacagctaacagttcctccaagtaatttcttaacaataaaaaatgaacacctcccagcgttcctgaaatcattccttatatgtctctgattcaagcacttttaccaggtatcctgtaggtactattctgtccccacccacatcaggagacactgaatatgatagcattgagtcacctaatttcagaatcagcctagtctgctcagtgtgttgatattatttctcactgtggcctttttactatttacttgaacttctggtttgagatgtttccactctgtttgcaaccagatttctagactatttagactttttaatcctttattcattggctattggacccatctctccattgtccttctttggatcttacatctagctgagaataaggtgacattaacctacttggtctatgtcctggccagtcttcaataaggagttgaggagtaagaggctgaatatagtctcagtttttttcacatccctggttggtgccgattgactagcagctagactccagtgccagttgtgaccatgttttcagtgacacttaaaagaccatcttagatgtggtatgggtatcataatccttccctccctgccaaacatgttcatgtcctaatccctggaagctgtgaatatgttgttacatggcaaagtcgattctttagatgtgctcaagttagtgaccttaaaatagattatccaggtagatccaagctaatcatgtgattgttaaaagcagaaaacctttccaacctatgagagaaagagatgtgaagaaagaagacgggtcatagagatgctacattgctgattttgaagatggaggaaggaaatcatggagcttaggaatgcaggtggcctctagaagatggaaaaggaaaggaaatggatgctcccctagactcttcaggaaggaaaacagccttggtgacactctgattttagcctattgaaaccatgttgaatgactgcagaaatgtgagataataaacatgcttattcagctaccaagtttgtggcaatttaatgcagcaatagataactactaatgcaaaagataaagaggttaatattacttttgttaagctacacttctttaatgaagttgactattatctttaatttttgttttagagacaggcagtggaattatattattaaggatataaatacgcttatggaacaaatttaggcacaggagaaaatgttgatggaaatattgtcattaactatacaaagaaactcagtgtcagtattaggtaatttaaagatcttaatctttatcactcaacattatattttaaaatatattagaattattcactgcaccaaggtgactatctcatacaacatctcagggttttttttttaatcgatttattttttttaggtttcactgactttctctcccccaaatgattatcatcacttccagcactacaaaattatgccatgcatgttatttaagaacttctcaattaac

SEQ ID NO: 9856 - DNA, 1034 bp, Homo sapiens
tacatggaaaacatttaataaataataataagcattatggaatgtgtattgtatgccagatacagtaactctgcttgcattacattacttttcacaataattttataaattaggtaaaatttgttgccccttttagggatgaagaaactagagtttagtaacatgcccagaatctcatgtcttacaaggcagaaaaatccagataaattggatctaaaaatggcaggagattcatgtaaacaatgaattctgtaggtatcattcaggagaataattaaactcttaactgctgaagaaactttgaaatatcctcaaattcttgcttgaaaataacacgagacgctttccatctaggggtattgtgaataaaggtatgataaacataacacataccttgacccccccaaaaattacatatatattgtatcagatcttcatgattccagatgtttttcaagtaaccaaatgactaccttttaagataaaacataatgcagaatttgagaatagcaggcaagcctataaacagaactcatttagttctatggaagaaactgaatttattactgtatatcctttattacacatcctttcaaaaagcctgcacatcctttcaataagcccacagaaataactgaaattattctctcactttctcttttgtacaacactcataaaatttattgtttttctattgtaaaatgtacacagcataaaatttaccattgcagccacatttaagtgtattgctcagtggcattaaatacatttacattgttgggcagctatcacataagctttattttaggtgtagctgcatcacattttcagattttgtgtgtgtttaaatacatatggaaaagtccttatggaataagcatatagcttgataattcttcttcgactgcacacagccatgtaagcaggactcacatcaaataaccatgcattaccagcaccccagatttccaccccaacatacacacactaaataaatatttgttgaacgtatcaataaataagtgggcaaaata

SEQ ID NO: 9857 - DNA, 1083 bp, Homo sapiens
agaggcgacctggctggtggatagccactttcattgagacacccaagtatatgaccctcccaggtctctggcatcctatatgtatcttcttttttctttctttttttttttttttttggcagaatagtgaatatttatttataaagagaaagtaaattataaaaactaaagaaatggaaaagctggcaattattgccaacatcacaaaatccgttcgctcttattgtgcaagctggagtgagatggtgctatctcggcttactgcaacctccacctccagattcaagtgattctcctacctcggcctctctagtagctgggattgcaggcatgcaccaccacaccaggctaattttctgtatttttagtagagatggggtttctccatgttggccaggctggtctcaaactactgacctcaggtgatctgcccaccttggcctcccaaagtgctgggattacaggcataagccactgtgcctgaccgaaaaaagaatgcttttacactgttggtgagaatgtatattacctcaaccatcgtgaaagacagcgtggcgattccttaaagatttagaacccaaaataccatttgacccagcaatctcatcactgggtatatacccaaaggagtataaatcattctgttataaagatacatacatgtgtatgttcattgcagcactattcacaatagcaaagacgtggaatcaacccgaatgctcatcaaagatagactggataaagaaaacgtggtacatatacatcatggaatactatgaagccataaaaagaaaaaagataatgtcctttgcagggacatggatgaagctggaagccattattctcagcaaactaatgcaggaacagaaaaccaaacactgcatgttctcacttataagtgggagctgaacaatgagaacacatggacacagagaggggaacaacacttactggggcctgtcatgggagtgtggggggtggagagcattagggaaaagagctaatgcatgctgggcttaatacctaggtatcttcttttttcaatggaatcatagcctagccctgtccagaattacttcagaa

SEQ ID NO: 9858 - DNA, 1093 bp, Homo sapiens
tccaatactgaattttgctgaaattgctcttgtgtgacaatcacaggcatgtcagaccaacttagcccatgttaaattcattagtcttattatttgctttatatttcgtgaaaaatataatgcctatcttggatgtctagtagaggtttcctttcttttctaccctatttcctttttcactctactttaccatgtcaatattcaccatgaagaaaacttagggtgtaataaaatctgaaaaataagacctactcttttctgattttatatgccatttgtggaaagtagacaataatcagtgtagtcatgaagtcataaatataatgccacctctataataaaacttgcctaaaactatgatctatctcacttttgaatgattttaagaatggtctctcattatcattcttaatcacaacctctgtgaaaagtgatttgatgtatctattaggcaccatacaattttgcatttttgtgagccagttttttggtctgctggaaatttataccctatgtgagagcaaatgatacctgctcaaacatatttactgtagtatttaaactagcaaaacttgtaaacaataaaattgcctacagtggagtggtttcggtggctcatgctttttcaatttgatgacattaaagagccattaaaaatggtagtcatgcaaattataatacaatgcctgtatctatgataaaatgcttaatgtttgatatagaatcaaaacagaatttattcctgttcacaactatgaaactattcatatagggaagagaatatgaaaattgaagactgctacagatggatgataggtagcttttctctcttttgtccctcttctccctttttccctcttgctccccctcccttccttccttctcttgtttttatctctagaattattaaatattatttgtgaaatacataaaattagaggaaaatggatatatcatatttctctctttaagatatgttatccaaaaaaatttctgttttgtctacatatgaatagataatagatttgctttataatatcagatagtggcaatcttttacctgaaatattgaatattaagataaacatgcaaa

SEQ ID NO: 9859 - DNA, 1043 bp, Homo sapiens
ctaaaccagtctttctttttcctagttttattttaggttcagggaatacgtgtgcaggtttgttacatgggtaaattgtgtgttactgaggctttgtgtacaaatgatactgtcaccaaggtagtggcatagaatcctataggtagccttccaacccatgacctgtcccatcttctccctcaagaaagatccagtgtccattttcgcatatatgtgtccatgtgtactcagtgtttagctaccacttataagtgagaacatgctgtatttggtttatgttctttgttagtttgtctaagataatggcctccagctgcattgatgttgctgcaaaaaacatgactgtatagttttttgcacgtcgtgtatgtgttgcatgttctttattcagtccaccattgatgggcatcttggctgattccacatctttgctattgtgactagcactttgaagaacatgtgagaacatgtgtatttttaggagaatactattttcctttctgtatatacctaatagagagactgtcaggttgaatggtagttccattttcaattttttcgagaattctctaaactgctttccacagtggctgaactaatttacattccaaccagctgtgtaaaagtgttcccttttctctgcaaccttggcagcatctggttctttttgactttttttataatagccattctgactggtgtgagacggtatttcattgaggttttgatttgcatttctctaatgattagtgatactgagcattttttcatgtatttgttggccacatgtatatcttcttttgagaagtgtctgtttatgtcctttgcttatttttaatggagctgttttttgcttgctgatttaagttccttatagattctggacattaggcctttatttcatgcaaagtttgcaaatattttctctcattctgtaggttgcctgcttactctgttgatagtttctctttccatgcagaagctctgtagtataataggtccttcttgtcaatttttgtttttgttgcaattgcttttgggga

SEQ ID NO: 9860 - DNA, 1045 bp, Homo sapiens
tgagatatttgcattctcatgttcatagcagcattattcagaacagcccaaacatggaatcaactaattgtccattgataaatgagtggattaaaaatgtggtatatatcaaacccatatctatctattatctatctatctatctatctatcatctatctatctgcctatcatctatctatatcatctgtctacacacacacacacacacacacacacctcaatattattcaaccttaaaaaagaaggtaaattctgtcatttttgataacacagatcaacctgaagggcattatgctaagtgaaataagtcaggcacagaaagacaaatgcaatatgatatcacttatacatggaatctaaaaatgccaaactcatagaagtcatgagtagaacagtgggtgccagggcctgggaggtgggagaaatggggatatgttggtcaaagcatactacttattcaggataaataaattctggagatccgatgtacaatatagtgactatagttaataatactgtcttgtgtattcgaaatttgctgaaagagtagatctcaagtgttctcacccccccaacatacaatgataactatgtaaagttatggatatattaattagtttgattgtggtaattatttcacaatgtatagataagcatcacactgaccattatgtttacaacttttatttgtcaatttacctcaataaaacaggaaaaataacaacataaagtgaaaaaagattattagttttaattgtatggacggtaagattacaatagtagtaatagtagtagaagtagcagtagtagtaaaagtaataatagtttacatttattgaatgctttctttatgccacttactgtttgaagttctttatgtataataactcattgaatcctcatttcaagccaaagaaaaaatctactgtaattaccccaaaaaacagaagtagaaagaggctaggaaatactagcatacggatgatttatcttaggttcttgtaggaataagaccatttaaaaattattcttatttattttta

SEQ ID NO: 9861 - DNA, 1050 bp, Homo sapiens
atttcaaattttactataatgctatagttaccaaaacagcatggtactatataaaagtaaacacatagaacaatggaacagaatagagaacacagaaataaagctaaatatctgcaaccaatggatctttgacaaaacatacaaaactataaattggggaaaagataccttatttaataaatggtgctggaaaaactgaatagcgacatatagaagaatgtaactgggtccctatctcataccttataaaaaatcaactcaagatggattaaagacttaaattgaagatctgaaataataaaaattctagaggataacctaggaaaaactcttctggacattggcctatgcaaagaatttatgactaacaccccaaaagcaaatgtagcaaacaaaaatacataaataaatggggacttattaaactaaaaagctctgtatagcaaaaaagaaaaaaaaattaccagagtaaacaacccacagaaagggagaaaatatttgcaaactatccatcccaacaaaggactaatatccagaatctacaaggaactcaaacaaatcagcaagaaaaaaacaaccccatcaaaacgtgggcagatgacatgaatggacatttctcaaaagaagatgtacaaatggccaacaaacatgaaaaaatgctcagcatcactagtcatcagggaaatggaaattaaaaccaccatgagatgccattttgccctcaccagaatggctattattaaaaagtcaaaaaacaacagatatttgcatggatgtggtgaaaagggaagcgttcactgtgggtaggaatgtaaattaggacaatctttatggaaaagagtatggagatttcttaaagaattaaaagtagaactactattcaatccaggaatcccactactgggtatctaccccaaaggaaaaaagtcatgtaaaaaagacacctgaaaatgtatgcttattacagcacaattcacaattgcaaagttatgggaccaatctaagtgcccatcgactaatgaatggataaagaaaatatggtatatacac

SEQ ID NO: 9862 - DNA, 1030 bp, Homo sapiens
gtgagtctcaacagctattgaacaaatattcagtaagccatgctgtaaatagacgtatggtcatccaggttttgtttttccattgatagagcacaggcagaacagattcagtataattcttaatggtcctagaattttcagaatagtaaatgatcattggtttcaacttaaagtcaatagctgtattggtccctaacaaaagggtcagtctgttttttggagtgttgaagctaggcattgacctctcttttttagctatgaaaatcctggatggcatcttttccaatattaggcattttatctacatggacaatctgctacttagtgtatccaccttcatcaatgatcttagctagatcttccagatcacttgctgcagcttctccatcacaattgctacttcaccttgcactttcatgttataaagaaaacttctttccttaaacctcatgaaccaacctctgctactgccagacttttcttctatagcttctttacctctctcaggcttcacagaattaaacagagttagggccttgctctgaattaggctttggcttaaggaaatgtggctggtttgatcttctattcagacccctcaaactttctccacatcagcagtaaggctgttttgctttcttatcatttgtgtgtttactggagtagcactttcaatttccttctgtaacttttcctttgcattcttcacaactgggctgacagtctggtgcaagaggcctagcttttggcctccctcagctttcatgcctttctcactaaacgtaataatttctagctcttgatttaaagtgagagacatgcaactcttcctttcactgaaagacttagaggtcattgtggggttattaatttgcctaacttaaatattgttgtctctcagggaacagggaggcccagagagagagagagagagagagagagagagagagagagagatgggggaatgtggctggacagtaaagtggtcagaacacatacatttattaaattatctgtcatatatgagtgc

SEQ ID NO: 9863 - DNA, 1095 bp, Homo sapiens
acatcagaattagaaactcaaaaatggactgatgtattaagaaaagaaaaaaatttaaaaactccttaaacaaagaataaattagaaggaatgcaagatcaaataaacgtaactaggagataagagggagaagaatttaaaagaaatcaatagaaacgatttgagagaaagtaacaagaggaccggcaaagaagacttaagatatacttaacaggagtcctcaaaagaagaagcccaaagcaaaggaacagaatagatactaaaaaatatgattccagaaacattttctgaaaaaaatttaaagctgttccctaaaacaaatcatatcctcccagaaaaatctgtcccagaacaatcaatatcaagacatagtctatgaaattactagactttaaacaacaacaacacaaattcaaaatccaggtaaaaacatcaaattacttttttttgttgagatggagtctcacactgttgcccgggctggagtgcagtggcatgatcactgcaacctccgcctcgtgggttcaagagattctcctgcctcggcctcccaagtagctggaattataggcacccaccatcaggctcagctatttttttgtatttttagtagagacaggttttcactatgttggccaggctagtctcaaactcctgacctcgtgatccacctgcctcagcctcccaaagtgctgggattacaggcgtgagccaccatgcctggccatcaaattatttttaaggaaaagaaaatcatattgccagtaaaactataagtgacatattaaagatgctgtgacccaataatttatatttagtcaagccaattttcaagtataaaggccttaaaactgctgtcaacatgcaagaattcagagaatactgttcctatgaggccttccttaggaatttacgagagaatggacttcagaaaaccaaaatgaatagatacattgagctaagtttggtgctgagcagtaaatttatgtttacgtgagttaaattgtaggggaggaaaaaaagatattgaaaaactgaaaagtagaagaatcaaactgcagtagtaaggatgcttgttgatgataatactctaaa

SEQ ID NO: 9864 - DNA, 1046 bp, Homo sapiens
ttctattgagttactttttaaaaatttttgtcccttcaaaataaattatataaaccacataaaacacaacacatgctggttccatttactgtgattctacagagagaggttttctgacaggatgatatagataagaagtacaggataaaattatgaaaagagagcttgttcttcttcttctcctctcttccttccacattctgtcatctttttccttttcttcctcatccttctcttccttcttcccatattagtaagaactgattatcatacagtagcctaaacacatttctctgcctattactcccaaaatagaaaatacaagagaggttaagtaatgcatttatttttaaaaaatgaaattatgaaaactgttcaaaacttttccaataaaattttgattctgattcagtccaaattcttttttaagtggttggctcaaacttagctcttcagggagtaaaatgaaatattaaaaagcaaaattcttctggtaattttaacaatactagagcctgctgtttttgtctttccattagatctaaagccaatgttcttttagtaaatgtgctcttagagacagttttattattattttttaatcaagaaattctatttttatagaagttttagttttagcaaaattgagcagaaagcgcagagagttcctgtaaatcccatgtccccacacacatgcaatctactccgctatccacatcccgcaccacaatggtacattaaatgaacctgtgttgccatatcatcacctaaagtttacattagggttctcccttggtattgtacattctataggttttgacaaatgtctactggcatgtatctactactacagtatcatatagttccctaaaaatcctctgtgttccaccaatttttcccttcttccctactaaaccctggctactactgatcttttttttttcttttctatttctatagttatcccttttccagaatgtcgtatagttggaattatacagtaggtagctcttgaaggttggcttatttcacttagtaatatgtat

SEQ ID NO: 9865 - DNA, 1059 bp, Homo sapiens
acactgcatgttctcactcataggtgggaattgaacaatgagaacacatggacacaggaaggggaacatcacacactggggcctgttgtggggtggggggaagggggaggggggagggataacattaggagatatacctaatgctaaatgacgagttaatgggtgcagcacaccaacatggcacatgtatacatatgtaacaaacctgcacattgtgcacatgtaccctaaaacttaaagtataataatgataaaattaaaaaaaagaagcaattattaccctgttcaaagcctggtactttaaaatttttgctgaatgcatgcatacttaattgggaatgcattctctctctatatattgataatttttaaggtcccaattgtgtgaagaaattgtctaagccacagaaaaacaatctttaagaaaatcttttagtaggagaacttcctcccaaaatttggttggtttaagtgggtctaagaatgattgtgcttggatgaccttcgtgaaaggaatgatagaagagttccctatttgtttatttttaaggcagggtctcactctgttgcccaggctgcagtgcaacagcgcaatcacagcttatgctgcaaccttgacctcctgggatcaagtgatcctcccacctcagtctcttgagtaaccaggactacaggcacacgccaccatatctggctaatttttaacttttttgtagagacggagtctcactatgttgctcaggttggtctcaaactcctgtgctcaagcagtcctcccacctcggcctcccaaagtgctgggattacaggcctgcgccatcgcacccagctgagctcccttttattaagcacatggtatctgtcaggtgtacgtgatgtctcatttaatcctcaagtgtgggcgttattttcattttacaggtgagtgaacttaacctttaagaggttgagcaatttactcaaatttatctagctctaaatgcaatcacgaaacttaaaaatatctgaaaaaatgaaatgtgaatatagccttggaggcacagtttgggaataacttat

SEQ ID NO: 9866 - DNA, 1189 bp, Homo sapiens
gggagggggtacataaaattgactccttagaacctgtgctactgaccccagcccaccactgagcaccttcctcacatcgattgctggctctggctactgcactaaactttgagaactgggctgctgaagccatagcagggagtagagtggaaccagactcagttgtaacactctcctctacagtcacaggacatgtggagaggtgggcctttctccttacaagtaggcagctacctcctattctttctggagtgagtgtgggtgggacctttttaaatcagcccccactgcctctatttgtgcctgcagttctaccattagtaaatacttctttccttttctttctgaagttctttaagaaattgagagctcatgggttgggtgcagtaagttcccagcattttgatgtgagcctgtttggcacactggagagagatcttaagctgaacaggcataggtaggagctaaggaactcagatagtctggggtcagtgtgctcattcctcacaatctgctcatttagtgaggcctccaaaagaataggggaggaggccaattagattcttcttcccctgaagtccttgggtaaagcctgtggttaaaagactttgtcctagtgaatgagcctagaaaattgacttagacaaagggaggtgcaggacagttctgaaagattctattctaccttacttacatcatagcccaaatcaattccagatggcattaatgtgaaaggcaaaaccttaaacattttagaagaaaatatagaagaataaccatatgacccagaggtaggaaatgatttattaaatgagactcataaagtacttgatgtaaaatagataaattcaaccacatcaaaattagaattaatttctgttctcaaaaggcacaattaaaaaaagatgaacctcaaattcctcaaattgggagaagatatttgtgatataattaattaattgtgattaatatacaaaatatttttaaaaatccagaaatctatacaaacaatgcaaacaaacatagttaaaagagaaatgggaaaattacatgaacaggcaaatcacagaagaggaaacataaatagccaacagtcatataaaagatgctcatctcattagtagtagatactatattccacccattttattccaactagattggccaatatatatatttttaaaagcta

SEQ ID NO: 9867 - DNA, 1137 bp, Homo sapiens
tacagaatgaattccaagtggtatttgttgcactaatcttgctgtgcagatgacaagcagtttttcttaaatatctgtttccagttcttccagagatatagaccatacttgttttgtttcacgtgtgtgcgttccacatccccatccccagccccagtagctaaaatcaagtatactcatgattactttggtaaaaataatgtttactaattgttcttacaatatcttacatgttgaccagaagttttattgactcttatttaaaaataaataataatataaataggaatgacattatctttctgttcaagaatttctgatagggccaacattgtgtctggtcagtggcctataatctgctagcataaatctctcattttgtagaaatggaagggtcattttttgcactgttgttttatgacatttatttacgcagatacatagcataagtttattatgaaaattaaaaaaatatccaggtgattttcttttctgggctcctgctttagacatttgaacctctcaaccatcactcctttaaacagttcaggccaggcatggtggctcacacctgtaaccaaccccagcactttgggaggctgaggcagacagatcacctgaggtcaggagttcgagaccagcctggccaaaatggcgaaacctcgtctttacaaaaacaaaaattagctaggtgcggtggtgtgtgcctgtaatcccagctactggggaggctgaggtaggagaattgcttgagcccaggaggtggaggttgcagggagctgagatggtgccacagcactccagcctgagagacagagcaagaccctgtctcaaaacaaaacaaaacaaaatatccaaaagttcaataaattttcctgaagagatctacccctcccccacattttaatccctcatattgtgaagaagttattttctgtgtacagctggaaactccccaactttcttcaaatcctgctggctttgggtaggcccctgatgtcctatttgaggctaacctagtaaggggaaagaccgttagattataagaggtcattggcttaggctctgatagtgggatgctaggtctcagctgagatgaagggaattgatggtcctgtcctggatgggattactgat

SEQ ID NO: 9868 - DNA, 1032 bp, Homo sapiens
cattgaaaggctattctctaaagaaattggatggccctagacaaatgacttccccgttgaggaacttaggggatccccctgactgatcatcctacagggaagcctgctaatcagtccaaggctcactggggtacacagagctcccaagcagtcatttattctttgtaaataatgacaattaagcttcactagacagatgaacaacacttgcaataaaaatgaatgaataatgtttccacttagtagactgctgacctgtgaaagtcttgcttagggcctatcagagttagagggaccttgggagttagggaggtcatttggctttcagctgcacagaggcctaaagctttctaagttgggcttttaacattgtctagaaatgcacacataggtttgaaagaggaagatgttcataattaaacctatatgccattactgaacaaaatgcctacagtatactgtgaattaacgtattacataaatcctaaattaatttttgaacagcgtaagtacatagcatgtatttttgaacattagaagtatacctttgttaaacacaaaaatttaacacatatcataatttcaaaaactattttggcatatatatattttgtaatttgctacaaacctcaaggaatagaagtagtctgcctgcatacctgaatcatctggaccgaagttcaaatgtaccccgaagtgtcattatacacttgcaacagcttcttagatagaatgcaggattccattaagcacaaagatctttagagttagactgaaaagacgttcacatatttttagattctattgcattcaaaagtctataacatgagatagaagagacatacaaagatcttaggaaccaaagaaaatacataatctaatcaagagattgagctgggctgcagtttcagatatatgtgaatagatggacgaatcagggtttgtgtataacttgagtcccatgatttgatcatgcctcctttgaagttataaaaccattgatataaccactaaaaatagagttcaattgtc

SEQ ID NO: 9869 - DNA, 1111 bp, Homo sapiens
ctatcaattttgtttatcttttcaaaaaccagctcctggattcattgatttcttgaagggttttttgtgtctctatctctttcagttctgctctcgtcttagttatttcttgccttctgctggtttttgaatttgtttgctcttgcttctctagttcttttaattgtgatgttagggtgtcaattttagatctttcctgctttctcttgtgggcatttagtgctataaatttccctgtacacactgctttaaatgtgtcccagagattctggtacattgtgtctttgttctcattggtttcaaagaacatctttatttctgccttcatttcattatttacccagtagtcattcaagagcaggttgttcagtttccatgtagttgtgtggttttgagtcagtttcttaatcctgagttctaatttgattgcactgtggtctgagagacagtttgttgtgatttctattttacatttgctgaggagtgctttacttccaattaagtggtcaattttagaataagtgcaatgtggtgctgagaagaatgtatattctgttgatttggggtagagagttctggtgcattaggtcctcttggtgcagagctgagttcaagtcctggatatccttgttaaccttctgtttcactgatctgtctaatattgacagtggggtattaaagtgttccattattattgtgggggagtctaagtctctttgtagatctctaaggacttactttatgaatctgggtgctcctgtattgggtgcatatatatttcggatagttagctcttcttgttgaattgatccctttatgattatgtaatggccttctttatctcttttgatctttgttggtttaaagtctgttttagcagagagtaggattgcaaattctgctcttttttgctttccatttgcttggtagatcttcttccatccctttattttgagcctatttgtgtctctgcatgtgagatgagtctgctgaatacagcacactgatgggtcttgactctttatccaacttgccagtctgtgtcttttaattggggcatttagcccatttccatttaaagttaatactgttgtgtgtgaatatgatcttg

SEQ ID NO: 9870 - DNA, 1048 bp, Homo sapiens
atgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgt

SEQ ID NO: 9871 - DNA, 1033 bp, Homo sapiens
gcttaggaaaagaagggtatctgcagccctcctggaatgctcttgtttgcatattgattgtttgtcttctctcggggccttatcactaacctttgagaaggcaaacaatacgaagtctgtttttattttcagctttttcagaaactgagcttttcctcactgagttagcagtaccaaaggttatatcatatcatttatatgtttgaattggtatcagaatgataaagtgggaaaattcacacctgttttgaaacagatgccagctagaattactgctgtacagaacatattccaagaaatagattgttgtgaaggagaggcattcaacataaacatgaaaaaatattgctggccaagattgaagatctttgttatcttatcagcgatattgtgttactacctctaattctaaagtatagtctaagtaagtggcattctgagtgtttatttgaaagattaacatgttactcttataattgcagagatctgagtagaaacctgatacatgaaattcacagtagagcttttgccacacttgggccaataactaacctgtaagtggatgattatgcagtaatgtcatgaaagtagtaactagtgctatagaaacatctgttttaacattgtcgaatcaaaatatttttctgtttagttattcccttgtataaatgctaagctgtatttatagtaaaagtcttcttaaacggcaagatacatgctagaactataattttagcacccccacttgaacttcatcttagggatctaatatttatgatgttaatacgtgtacagatgtttttatgtgatttatatattgggcattaacttgaagtctcattcatattttagagatgtaagtttcaatgaattaacttcctttcctacggaaggcctgaatgggctaaatcaactgaaacttgtgggcaacttcaagctgaaagaagccttagcagcaaaagactttgttaacctcaggtgtgtttttgcttatttttcttttttgttgaagttatggtaggctccaaaatta

SEQ ID NO: 9872 - DNA, 1050 bp, Homo sapiens
cgatttattactgatgccactggtaagattgtacaactcatgtgaatttgaaggtactaatctgtaggagcatcttctggctgaaaattctttaaacaacttccttatatttatgtatcataataatttatatggcttttgagcctcatatatttgtaattattgtcataggtcatcctttctaacctcttatttataaagtctgtgtacttcagattctctttatggtgttggtaatgtcagatctagaatctactcttaagactatctatagattgtttatcaccatcagccctcattattttaaatggatacccacgcaactatactctgtaactacaggtttccagagcttctccggagataacatcttgtagctcaccactgcccccacacccaactttttacttcataaatgttgtaactgaatcccagaaagtatgagagaaaacatctgtaaagagggaacttctccgggtgtgtgaaattaagaaaaatttagaaataagtattactcctgaatctgaagctttgaaataaaaactcaccgtgtgttttacatatgttagtttgtaaatatggagtctcactaattgcatttacagctcacagcaaaactacctgttacgtcttgttactataaggaaaaaaatcagagctgtgcgtgtgtgtgtgcatgttttaaaaaactggaatgcagagaatagtgtggtgtaaattgtctctaattatgtgtctttttctggtgaggcaattaattggttctctccagacctttttctgatgaggaaattaatcagtttttctgttacagtgataactcacctgaattcaggtgtgccaagcttagaggaaactgtacagaatgcctcattttgtaaagcaatcaattcttgttgtccttcctctttttattagaatgactgaaaagcaccaaaactgtctgatattttacagaatcattgtttactcattttggatcattattttgctttcgatatgattaaatgttttgttgtattcttgagaatgattttattggttaaggcc

SEQ ID NO: 9873 - DNA, 1050 bp, Homo sapiens
ccagttaggtaggaagaaaacaaggaatattatagttttaacccttatctattccctgtgttgccagatggtagggttcttgatcaaattagagacaggaaagtaattttttttgtctttggcatttatttttctttgccatttaatagacattactccagaattagagcattttatatttttctctttagaacatatcccacacttgtgaaaactagcctgtttaaaaagaccaaaagaaaaacaaacaaataaacaaaaccaaaagaagctgaacttgttttaaagctagaaaatattgaattagtctaactagttttatttattttctttctttctttgtaggtgggcaccatctaatagttttattttttagttacccttttaagaatttgtaatttaagccacacataccttttgttgtgttgtgatatttacacaccagtgttttatcctcactcttttctaccttctagtgttagcttccccttgaagaacacacccttaaatgtctcctaggctgtattgcttcatcaagagtgtaaacaattacagcataaaatggtacctttggaaatgaagtcatgcgtctttcttaattgctgaactcttgtaattctgaagggggtctattttagcctgtacttactcccatacttgctaacacaagcaaatgggcctacacatacagctaggaaaagcatgaatctaagggtttcttagggttccataattatgcatggaatgtgcaggagcaggaatgtcaaagtaggagtaatcatgatagatttagaaagggccttagaggttagttggtacaaaatattttacagtgaaggaagctggaattaagcaggtctgggtttcttcttcctagcttcccctcccttcgtcccattgtaatatatggctgtcaggatgacgtttctacagcaaatttgatgtgcataaactttgctggcagctttccacacttttagaataaagttctgatttctaaaggtcacatatgaaggccttttgggatgtagtttttgcttgtcttggtag

SEQ ID NO: 9874 - DNA, 1679 bp, Homo sapiens
ccagattttcaagtagcagaggattcagttttcagggataatttaatgaaaataactgtcttctctctacggccctctcttcttcatttgtctagaatagaaccaacacagctcttgtgtataatgtgaagaacatggaatattgactctttctttgtgaatgattgtcataattcattttagagtcttctcaggtctggtgctgttttgctctgtaatcttttgaaaatcacctgtgtttttttgttgtcgttgttgttgacaacatagtggtaataacatttaactcactacccctcagatgtgtttgaagatgattataagtggtttataagccctctgtaggtatcactacattaaaatggaagaatgaggcccctaaaattgtaaaacaaaacaaaataaagttttgcggcaaggtaggtaacgtagttgtgtagctgcatgggactaagttattagttgaacaaggtgtttaatattgaggttcatcttgtggcctatcaggctctttggatggcattttcacccctacaaaagagtgagtagttctatttgtagacctcccacaaaatgtggtattggagctgggttgctagtctcttcttctctggtttgatttcccactcctcttcttaatcccaagcccttgcttgccccattctgtctaaccctcttccatggttgatatgcttttctccatctcagcctcttcactagctcttctctgaagaactgcttcccctgcagacttttggttagaggctgctcatcttcctacactgttaagagaataggattgattctcaccgctcctcattgttgcccataggtcactgggctttcatcttaactcacaatctctgttccatctgtggtccctgacctttagttctgatccttcgcaaatactgtcatctactggcttgtctgttggtcccctttaaaggaggattgggtgccaagttcatgatcttatgatttctgccatcctctcccctgccgtaagttctgtcattcacccaacatggacaatccttttgacacttttgcctctcatttcatttatctccatcacattggtgagccctgtctcaactccacttcagccttttcctcccatgaccaaatcttggaccttgtgaccacagaactgctaaatccctctgactacagcccctctctctctctttttaagaaaatttttagctcagtgtatacaaatttttcagcctcattaagccctcatgtcccttgaactttttactttctctctatcattcatttctttctctggttagattaagatctgtccattcctttagcctcagtgtccttaaccctcttaccctgttgtcttattaaaggcgattttttatgtaatgatgaaatcaatcttatttagtcacccatgccactttttttgtgtgtgaaatacctagtaagtcccaaactaagtacttatcatacatgacttaactcatcatttgaggaggtagttaactagtagaggctgactgcttagatgtaatggtttaatggagaatgagaatggaactttgacaggagaaaaggctttccattatggcactgtgtgatcttgttcacatcatttagcctctgggttctagttgcctcacctatgcattgaggatacttggctacatgatccccaatat

SEQ ID NO: 9875 - DNA, 1028 bp, Homo sapiens
aaaaaaagaacaactgaaactctggatgatttattctaatttaaacatgattctaacttactgatgattttattaaactaggtcttactagattgccacatttaagccagtgatcctgtatttaatggtaaggtctttgaaaagagcattatggaaacaaaatgattttaccacacatttgttcatgatccaaattctttaatttcatacataagtagttttgactcttacagtgctacagagagcaataactgtaatcatagaaccacaggatatagacctggaatgcatacatggtgctatgttaacatggagcattagtgagaattataaggttcattgaagtatattaaatataacatgcataaaccctattactttctattcctttagtgaaatgcgatactttggttgtacatatatttttaaaaatttaaagacttaacacactgttgacaaaatgcacattagtcaaacatattgtgaaagcatagtgtcagccatgaatacaatagacatacatttctagatgctttgtcataggatgaaccccaaaattggggttcagcctcggagaccacaggaattcttggctttgcacaggaaggaattcaataagagtgacaaagttaagtgaaaacaagtttattaagaatgtaaaggaataaattggcagagcaaccccaagggttgctggttagctatttttatggttatttctttatcatatgctaaacaaagtgtggattatttatgcgttttccaggaaaggggcagggagttccccagaactgagggttcttccccctttcagaccatatagggtaacttctggacatcgccatgacatttgtaaactgtcatggcactggtgggaggttcctttagtaagctaatatattataattagcatataatgagcagtgaggatgtccagaggacgcttacaccaccttggttttggcaggttttggccagcttctttattgcatcctgttttatcagagtggtctttaccacctgtatct

SEQ ID NO: 9876 - DNA, 1049 bp, Homo sapiens
ctgggatttaaaaggattaggtaacttgttcaaatatcccacagttagtgggtggtagtttgtgaagctcaggtgttccatatttaagtttgctcatccctgtagtttgcttagatatttgacaatttatcagaagaggaacaggtgaaatgagaaacaaaatggtgagaagctacaggttattacaggaaaaaaaaatcagaacagaaaaaaatgtgtacccaaaaagcacacatacatctatatgtctgcatacactgggagactatgacttgatttagagtcaaaaatctacacaatagattcaaaatctgttgtgtaaaatgaagttgtctgttattcatagcagaacttttaaaaagtatctctaacttggtctttttgctttttatacatacttgtttaaaagctttcacatcatttcccatgttaatagtgtttttttgtgtgtgtctggaaagtatcagtcatatgctttttgactggctttttctttcttccgtggacttcacttacatggtatatgaggatcagatctgttagcagactcacttttctgtttctaaaggagcaaatttctgaatgtgctcctttaaaccaaaactttgcagtagattaaaaagcaaaatgtgcagtatgatggtttccatatagctgccccctttcactcactggaatttcctgcctctcctgttgaagatgtttttatagggaagtcagcataaaagtgaatcacccatgagcctttttctcccccaaggcatttcatttagtcaacttggtattaatttagttggtactctttagttgactcgaacactgtgtgttgatggtgtgagctgatgtttattaagctgttaatgttttacagacttgatgggttcccatttggatctgtgtgctctttcctttagcagcagggctattattcatgattgaatctgtggccacagttttaattttgaatgtactggtgatagccagcctcatgctaaacagtcatttgcttggtgattctaaaggttgtcttcttcccctggaagcatttt

SEQ ID NO: 9877 - DNA, 1049 bp, Homo sapiens
agctaaagaaaagcttattatcttaaaagtaaatttagaactaaaatcctttctttaaagtattacatattttaaaaagtttatatgacattcttaagcacggttaaatctttctcagaaactaaaaacttctctgagttttgattcagacctgatttaaacatgaattacaaagacagaatagtagctaacgtatgcagtagccctcacaacctatttagattggctgagtgtttcaaatacagttgtgcgttttctaccctgggtctccttctttaaaaaaaaaaaaaagtttgagatgtttttcccattaccatcttgacatctgcctggttacacatgaatagcttgacccagtccctcagcagggagactaccatggccttgctttcaatagccatgtcactgacaaagaaaacatatggaatatttcattcctacccttcacacacagagtctggggctgtgagggcatgcagcagaacgcttcattcttcatggtaggttggcaaatctgtgcacaaaccacaggctctgctgttagtaatcaaactgtgttttccagagcctcattacattctgtagaaagaaaatcccttgttttggataaatcaatttctaatatcagtttgaattaacttaggatggctggcttccatgatgggttttccacctaatcatgtatttcaccaaaggacatttgtgtatgcgtgagcacaggggatttgggtattgctctgccagatttgatatgtggtgtgtgttgggatcacagatgcttgaattcccagtaggataggccttgaaaactgcctgcctttatgtttatcttcttgtcagcccacagaaagagatcaattgatcattgtcctgctagccaaacactgctgcaatgacctttaaaggtttccgttgcatatagtattagccttcttcttgggagctcggtttcaggtcagctagcattgagggctttggtctgtggcatctgaagctatagtattgaggctcatcagcaggtgtgacaggagatggtcaagaacatgaaa

SEQ ID NO: 9878 - DNA, 1080 bp, Homo sapiens
ataagacacctttgctcttttaattttttaaacttgatctcaaggttttggagtgagaaatatgttacccagcttgctatttaaccgtcccgtgcggccttcaagttgttggcaatgttaaagcttgttttcctatacataaaagaatatggatgactttttttcttttttcccccaactttgttcggtgaagtgtggttttttaaaagcttgattgaagatgataaaatgctgtaattgtaaatcctgtcagtgaagaaaaaaatctaggacatttagcaaatcagtactcttacacaatggctaatttgtctgcctctcttgacatttcttttgtgcctttcagcacctgatggtcacactgtatgctaggtgtcaactctattgtctaaaattgtgtgagttaaaaattgagtttagaaatcagtcttagcatgagacagatcgtgattttttagctcatgtacagttgataacttctcaactttccgaagactaacaagttagtattcaaacacctcttttaaattgcaagatgtaattgtgtgctagtatactctgagttcactcacacatagacaaatattcgttattaaactttgtgtatggctgagctatttttagcaagatctttaaagcatactaaaatattctgtgtcgtgtccaggcaattaaaactctgaatgattgggttggttggttttaatctctaaaacatgtttttcataccattacgtattttaattgtcagaaaagctcactagcctggtcttcccccaaccacaagatttggcgttatgcatctgggttcagcaatgcctttctaatagtccaggtccctgaaatgaatatttaaaatatatatccttcttagctttctgtcatgaaagatcttatgggtaagacattgaaccaccctcctgtggcaacatgttggttcataagaatataagcatatccttgtaaggaaatgtaaaccatagatattttgggaggcagctgggccaagattgggtatacgtttagatcccaggctggcctgctgtttgtgctagtgagaaaatgtgcagaggaagcata

SEQ ID NO: 9879 - DNA, 1077 bp, Homo sapiens
ttcaaaacaagaacgatgtatgaatatctttaagtataggtcctttattttccaaactagtgaaccatgtgttctctttaaatataagcgaggaaaaaatattctgccaggcatagggagtgctgggttccagatctgtcaataattcacaggagtgaccttgaatgagtcatattcttaacccttcaggaccttattttcctcatctgtaaatctgtaaaacaagtcaacaactcttaactgccaaaagtgttttttattgttgttctctatttaatttgattttttttttttttttgagacggactcttgcgctgttgcccaggctggagtgcagtggcacgacctcggctcactgcaacctccacctcccaggttcaagcaattctctgtctcagcctcccgagtggctgggattacaggcacccgccaccatgcctggctaatttttttgtatctttagtagagtcggggttttaccatcttggccaggctggtcttgaattcctgacctcgtggtcctcctgcctcggcctcccaaagtgctgggattacaggtacaagccatcgtgccccgccttattttgatttttatacattccttgggtcctctctattgtgttaaatgaagtataggtgtctaaactgtagaatctctcaccaacccaggagactcttccagttgtccagttcacctggaatatttccattgcatggggaactcatgcctcacaggcaaaagtgtactggatatgatctgagcaattcttaagacttgaggccaggtgtggtggctcacacctgtaatcccaacactttgggaggccaaagtgtgtagatcccttgaagtcaggaattcaagaccagcctggctaacatggtgaaaccccgtctctacttaaaataaaaaaaaattagccgggcgtggtggtgcacgcctgtagtcccagctacttgggaggctgagggaggagaatctcttgaaccccagaggtagaggttgcagtgaaccgagattgtgccactgcactccagcctgggcaacagagcgagactcctctcaagaaaaaaaaataa

SEQ ID NO: 9880 - DNA, 1033 bp, Homo sapiens
ggtggaaaatattatcttccacaaaaccattccctggtgccaaaaaggtcagggaccagtttaaagtccattcctgttctaaaagtgcaataacattaacacgcaattggtttgatgtgaactattttgtatcatgtaatgacatataagctagtttatgcacaaagggggtattttctaaaatatcagaaatattgataatcatgcatggctgcctttcataaagcatctactaagcactgcatctaatccttataaccccccaataagatgggtgttattctgtttcacagaatcaggaacaccaaatagtttattcataattacacacttacactgactcatggaccagattctaatcccaagtttattttcaaaacccataattttcccccaataccacactgcacttttagcaagattttctctctcattcattttattttatttttttaggtttcttgttggatttgttgtggttttttttttttaatctagagccctgtaagaacaacaacaaaaaaagcagagtatgaatctaactcgtatattatgtcaatattcaattggatatttttaagttggcatctcttccccagtatataggtattatttcattaaatagcattagcacattgaaaataccacctattattttctacctattgttactttgtatcacaaaattataaatgatacgtatgttgtagcaattaaaaatttttaagagatgaattctacggaaaatggcagcaatttaagtgaattatttccatagggggaaaaaaaatttaaaaaaaataggttgggtgtagtggctcacgcctgtaatcccaacagtttcagaggccgaggtgggaggattgcttgaggccaggatttggagaccagcccgggcaacatagaccccatttctacataaatttttcattaaaaaataatgaaatagcattctattaactgttaatgatggtggaaggaactaactgaagaaatgacaatgggaaaaattggaagaagaaagtgatcagct

SEQ ID NO: 9881 - DNA, 1073 bp, Homo sapiens
tggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaa

SEQ ID NO: 9882 - DNA, 1035 bp, Homo sapiens
gcatgttgttatggacattctttcagtgaaatgtctaagacttgtgagtcacacttaaagctaaacttgatatctacttcattgattttctttttagttctatgtactatattgaatttcctgacagtggggctatgaaagccttcctagcattttatagatgtggttgaattaatggctgtaagccttaaagcagaattagacagcatcaatgaatttattaagtataaataaatatataatctgcttagcaatattacacagcctctttatcttatgtgtgataaagagtcatccgaaggttgaaaatgaagaattgtcctggaagctcttacttaatcttttattatttcctaatacagtatataaaattactcattgaaagcttagcagaataagaaacaagaagttaaaaggctgaaaactacaaattttgctattattattgttattacttcccaagtctcttattgatctgttagaaatagagctacacaggaaattgtaggacagttagtatgtggtagtgttatctgctttttaattattcaagtaaggttttattccattagaggaactcaagaagttggtcatggctgataattgctatctgtcaaattccttagagcagggatccgcaacacccaggccatggattgttaccagtccctggcctgttaggaaccaggctgcacagtaggaagtgagcggcgggtgagcaaacattgccatctgagctctgtctcctttcagatcagcagcagcattagattctcatagaagcatgagccctgttgtgaactgcacatgcaagggatctaggttgtgtgctccttatgagaatccaattccttatgataatttaactgatgatctaaggtggaaccatttcatcccaaaaccatccaccctgctactcccagaccgtggaaaaattgtcttccacaaaactggttcctgctgccaaaaaggttgggaccactgccttagagtttataatttggggttagcacagcctatatttacctgagaatt

SEQ ID NO: 9883 - DNA, 1051 bp, Homo sapiens
actcactttgctctaattagtttttgtgtgcggacaagatggaaggtaatggaaatttggcttgcaaagtagttctaacatgatctacatccacaatctggttataatgctataagaatattatgtgggaatagtagttcaaatcagtatttagtatgaacataaagggacaaacaatgcaaagctaacttaagttgtttacacttggaacttatttaaattaaaaaggccagtggatggtcatatgtttggctcattcttctcaaggccttcaggaaaacatgcctatgaaataaaagatcctcaatattaaacattttactgcatttgggggacacatgaaatctggtaataaaggaagtgttggtcttcatttttctaattcagcatggaaactatcttgaggaaaactgactatggtcttagtttgtgtctcagaaatatatttagtctgaatcatggcgtcgacatctgacttccaaaattggatatctagccgtatagtacctcacctcccacacacaccaccccccattcccaggtcatgactactgtccaagcagcaaaaaaagaagtaatttcccagagtacatacatggcagtgacaaccaaccaaacaaaaaacaattataggggctggaatttaaattaatggctgtactctcaccaattcattccccattccaccccatctctctgtcttcaacttttatgaaacattatatttgtcctattcttctgtatcagcatcagcctttcctatatccaactagacttataacttcttggtgcctctcactggctgactaaggtttcagaagtacctacttacagcaaacacttgcagcagtctctttttggttacaaagtccctggacaatttctcaaggcgatattatgaagaggaagtaaacattctcctctgctaccccatttctttttagagtgctaactttattctatatctggtttaatgtcttcttaggccaattggactgattttacagacaccatagaatatctcctgagtaatgggaacaatatttctgct

SEQ ID NO: 9884 - DNA, 1035 bp, Homo sapiens
tttgtagggccagcgttgggaaacaatattctctctcttcttttttctatctccttccttctatatctaaatcaacagtcgctagtttctactatgcttcttaatgacattttattctataaatacttcctgcttagtccaaaaatgattagacaaatcaaacatgacttacctttctggctaatctcattagaactcattccaaattgagcaattaaaaaatggcacccaaattttatctcagttgtcttcttccctataacctagtatagttctgggcagaaaggagattctcaatttattcttaatatattgtaagaaattagattaactgtctctaggataaggaatgagtttaatttaagtaaattgtaattaaagtacagaaaaagaacatattagttgaagaaggatgattgtaggttcaatttggaaccacaaaataatctgtcattttggggcaaattatataaattgattttctcatctgcaaaatgggggtgttaataagtaactcacagggttgtggcaggtcttgaaagaaaaaaaaatatgggtctgggtgcagtggcctgtaatcccagcactttgggaggccgaggcgggcagatcacgaggtcaggagtttgagtccagcctagccaacatggtgaaactcatctctactaaaaatacaaaaattagctgggagtggtggcacacgcctatagtcccagctactcaggaggttgaggcaagggaatcacttgaacctgggaggcagaggttgcagtgaaccaaaatcatgccactgcactccagcctgggtggcagagtgagacttcatctcaaaaaatacacatatatatatatatattttttaaatgcctggcacataaaagctgttcattaaatataagctatctttcctcctaagccctaaaactgttttgatattgagtaagaggtgttttttcccccataataaatgttatatctagacacatttactccaaatttcaatacagctgtattcagacccagacttgtttaaaa

SEQ ID NO: 9885 - DNA, 1050 bp, Homo sapiens
taatttaagattttaaactacatgaaaagtttatttataaatatttactgcatttacatttacctactttatttttaagtattataactagattacttatgaaacctaagatattagacaaagtcaacatttcaagttattttcctcttaaccatttttataccctgtgaatatcaggtgttcacctaagtaaaaaatatatggatattttctggtaactcagaagatatacctgttcttgttaaaaaccaacaatattacattagccttagtcatcaaataattatacaatcaaagatcatttagtgttagactaaatttatagttttataacctttgtatcaaaccttgacacctaaaaagagacaaatatataattgtctgatgagtaaacccaggcaaaaatgtatgctattttgaagacatttatttttattttaccaacaatataaaaaccagctttttaaagatttactcaagtcatgtgaacaaaaagccatttgggttgatgactgtatagtttatataagcactaatgcatgtaagccaatctgaatagaatttcttaagggatttctggttgactataacagttttcaccatgcagtcatgacatacagcttaatacatgtacatgtgcataaatatacctaaacacatgtacacacccaaaaatagtattgcttttatttagaatattagtcttgacacagtaaaacatactaactcacctgtttgtaaaagacatttagatacaaattatatttctgttaacattcaattttcaagctgctgataaagacatacacaagactgggaagaaaaagaggtttaatggactctcagttccacttggctgaaaaggaaggcaaggaggagcaagtcatgtcttacatggatggtggcaggcaaaaggagagcttgtgcaggaaaactccccctatataaccatcagatctcatgagacttattcactatcatgagaacagcatggaaaggacacacccccaagattcaattaccttacaccaggtccttcccacaacatgt

SEQ ID NO: 9886 - DNA, 1021 bp, Homo sapiens
ataaagaaggggaagctctctatatatgtatttcatttattttgcataaaatggcattagagtttgaaagcactggatattccaaaacctacccaacagatttgtttaaataattgagtatattagatttttaatcttaacaatttatttaatatttctctagcacactattttactaaattgattagcctatcaaatatttaaatataatgcatacataatgttagcttttacttctcaattatattaatcagagttttggattgtttgttttgtatttgtttggttgattggttttttgtttgtccacaatcttctgagcaccccaaagcagtttcatatttgccatacacttttattttgttttgaaagatgtctaattatttcaactagaaattatttcagataaaatagtagaagaggtattatgttgagtagaaacattctacctatataagggagcaaaaggttaattcttaactttatttatagttatgggaatatgttttgtgcacaactggaagtgtctttggatttttcagtatagcctttaacataatttgaacttgcgctcatcagttttaagtctttgtagtttatgacctacaacataaatgttaaacatttcatcagtggactatttaactaaatcgtaaacatgtttgggtatattttacttttatataaatacgcaatttattagggttggatttgatttctagaaatatgagttctaatcaaatggctttattcaaaagcctaattttcaagaaagaacatgctatgagtaaaaagtagggtcctggaactagccataatgcataatcgtactatgaaataataaagacaactttgggataaatttaagaaaaaacaatgttttatcaaaagtaactaataatattgatctttatatttgaaaaaataaaatcaccaaatgatcaaaaaagaatttctgccttggacagctgatatatacaaaagtgtgtttaatatgcaaaacagaatcatagtaatttat

SEQ ID NO: 9887 - DNA, 1049 bp, Homo sapiens
ataaataactcctaactttaatatataaataggatgagtgacattgttctctgtcatagtctcaataactggcattggaagtactttctaaaaaggagaaaaataactttgacattttagaaaattattggtcaactgcagattggaaaggagttttattaaatttgatttattaaaattattttattaaaattgatttaatcttaatattctttaaaagaatctgaagaatactttgcattgtttccactcgctaaagctaagatggattatgagaattgtccctaggaggaagtttccagtttccaggcatagctcccctgcatatggggttcctgtcttagccattcaaaatgtccaaagaatttaaatttttttcattgtattgtttgaaatttttccaataaaatttctgagaatgttactagattatcaccatttatactttggtgtaatcccttcgctgatatattctgtagataaggtttagtaggtttaaggaaagacaagtaactttaggtggtagattacaggacacctggccctagacagatgaggcttaggaaaatggagcctgcaaaaaaacattttcacacttttgcctaggatggagctaatatcaagagtgggtctcaagtcttgtctctttaaaagaagaaagattcaagaagataaaggagattatgagaggatgtatataaaggatatttttcttttaaaggagaacagacgtaatatttggcaaacatgttcacactattaggatcatttaattttctaactggaaaggactgaagagatcatctgatccagctcttaaattttagtccagtaaactgatctccataaaggctgtatattcaacttaaggtagcatttgtttcaaggccttataagcccatctctaaaatcacatgactcataggccagtgctctaaccatgtcatccaaccaaaggtgatatcaaccatatgatcttttgtttcatgcaaaaacagaaatttttattgcacacaactcaagactttgtacactggggctttaacact

SEQ ID NO: 9888 - DNA, 1055 bp, Homo sapiens
gttatagtctttgatttggtcgttgtatttcttaaagccataaactctcaacctgtaattttataaaaatgactcacagctcaatttcctattttcttgcaagcagtagtattctgagatttcaagggggaaatagctttaaatacaaaaatgtagcctaacttaatttactacaatagtacacataagaaaatatactagtttactaatatcatgtacatcaaatatcataaaaattagatttactgttaaatgaatcgtgtttcaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggtacaaatatctctgtatgttcagatttaatttgtaggaactgagctcctaaaatgtgttctttttcttattgagtaaatgtctttcataagacaactattattgcctcataactctgagatttaatttacttttaaatgttatttctaagtgattgcatccttttataaggtagcttttaggttaaaataaacaattctatttcaacctgcacttgaggattcattatgtaggtaatttgtttgaaatcttgatattttatgcaaaaatagtttaaatgaggtcaacattaaatgtgttatggttaaagaaagttgatttgaaagggggtgtgtgtgtgtaactgaagatattccaccttagaatggcaaaaggttttatttttgaagtgtagtgatgggtaatgacagtatcatattagaattatgttctgctacaaggttgcagtagtctaactttagtgccttaactagtgtgggctgtcttttgttctcttaacaataagtcttggaagtatgcagttcatttctaatgcagtacctttaaaatgtcattatcgtgcttgtcgtttcatgattgtaatattactgtttcatatctagtctcaagtttacacacctaa

SEQ ID NO: 9889 - DNA, 1027 bp, Homo sapiens
tgtactttcactttcatgaacttcaaattgttgccaatattctttgataaatgtaatgacttccaaataactatctcattggattaatttatcaatttgttgttgtgaacttctttcatatggttgctgaacagaattctggaatagtaccatattatataagaattatatattttatttcaaatttttaagatgtttttcttcttttctttattttttatgtttattttattttatttttggagataaggtctcactccacaactcacacaaacctcccaagtagctcagactcccaagtagctgagactacaggtgtccaccaccatgcctggtttatttcaattattagcacttatattacatagtaatcttcagtgggtaataattcttctcagttttgtgtagattatataagtgtcaattatttgaatgtgcagttatctaagatttactttttgacaaaaggcaagaaatgcagccataggaagctgatattgacttaacatctcaactttaacgaaactcttattgaacacttgtttacatgtaaaacccttgtgcttgacacaatggaggtaaagaaagagaagtgtttgtccttcaattatttacatactagttggagcaataaaaataataaaaatgataaggcactatatgcttgtcatataaatagtaataataaaaacagctgatattgaacgctatttgccagacatttttcaaagttttttgcatggattaattaatttagtatttataacaagcctatgagatagatctaatattatcaccatttgtgaggaacagaggcactgagaactcaagtaggttgtctggagttacttacctaattaatgtggctgaaccaatattaaaccccagctgtctggcttcagagcctgcactcttaatcactctgctatattctaagtaccgtgaatgctatagctattcagaaaagtaagcagtgacttcctatttttagtaagaaggcttcctggtggaaagatgagatttgtac

SEQ ID NO: 9890 - DNA, 1050 bp, Homo sapiens
ataagaaagatactatttaatatgattttgttttaaaggtctgatatatatcacatttcaagggtatatcagtaatgttaatatatagatcaaagacctcagaaaacctagtgtattaaactgatttttatttcttttttaatttccagttttataatgagaattggttaaatagaaagtaatgaataccagattgatagttaatattttatggtacattctcatcacttattttgaacttggtttttaaagtgatcactacacagcaaacatgttaattaaattggcatgaagacaaactaaccatatttttaaaaactaaattctgttgtttagtattttatatattataaaatagggttaagtattaaagagtgttgatttttttttaaggggggtttaagttataaaatgtcatgaaatcacctaataaggtaatgtttactagatgcttctgggcatatttaaatatagtttacatataccatatgccagaagtgcttacctagaacacagtgtatttcacaacatagatatttgtaaaaatgacatcctttcaaaaaaattataatatggcaatttaagttaaaccatactcgaaagctttagcttgttaaactgttcgaaaagctcatcattagtcattagaaaaatgcaaatcaaaaccacaatgagataccatctcatgccagttagaatggcgatcattaaaaagtcaggaaacaacagatgctggagaggatgtggagaaataggaacacttttacactgttggtgggagtgtaaattagttgaaccattgtggaagacagtgtggcgattcctcaaggatctagaaccagaaataccatttgacccagccatcccattactgggtatatacgcccaaagaattataaatcattactagaaagacacatgcacacctatgtttattgcagcactattcacagtagcaaagacttgaaaccaacccaaatgcccatcaatgatagactagataaagaaaatgtggcacatatacaccatgcaatactatgcagccatgaa

SEQ ID NO: 9891 - DNA, 1049 bp, Homo sapiens
tgagagtgatagattatgtcactcctgtgctcaaaacgacttccagttgttctttgtcttactcagagtacaagccaaagttcttttaatggcctccatttctcctctcatgtcttactacactcccctttgctcactccattctggccaacataaagtagcaccctgggtccttctctctatggggaaaagcttcctacaatacctgtatgactaactccctcacctccttcaagtccttacttaaatgttgttttgggtgaatttattatttttgtctcttttattttaacttacaaatgacaaaaaaaatgtgtaagtttataggatacaatgtaatgttttgatacatgtgtacacagtggaatgagcatatcaggctaattaattaacatatccatcacctcacataccatttttttgttgtgagaacatttaaaatgtactcttagcaattaaccatggtcaccttgctgtgcaatagatcaccaaaactattcctcttgtataactgaaactttgtaccctttgaccaacatttccccttttaccacccaccccaccctcctcagcctctggtaaccattactctacttctctgtgttcatatttttagattctgcataaaagtgagatcatgtgatatttgtctttttgtacctggcttattttacttagcataatgccccctagattcattcatgtcgtcataaatgacagaattttagtcttttttaaggctgaatagtatttcattgagtgcatataccacattttttcgatctatttatctgttgataggcacttagattgtttatatatcttagttattgtgaataatgttgtagcgaacatggcagggcaaatatctcttcaacatactgattttaattcctttggatatatactcagaagtgggattgcaggatcgtcctaagtctcaccttttggtccttactcagatcttgttgttttggggtgttttattttgttttgtggtttggtttttttttgtctttttgttgttgttgttgtttgtttttttgttt

SEQ ID NO: 9892 - DNA, 1019 bp, Homo sapiens
caaaatgacttcttattatggtggagtagtcaaaggagagccggattaagagcaaggaggctaggattctaatcctggctctgccacaaacagtctttgtgattgctgtggtctgaacgtttatgttgctccaagattcatgttgaaccctgatctttattgtggtggtattaagaagttgggccttaggaggtgattagatcatgaaaatggacctcttatgtatgagattagtgctcttataaaagagacttgagggagctttccgttgtttccactgtatgaggatgcagcaaaaagtcaccagcattgaagtagggagcaggccctccctccccagacaagaaatccgctggcaccttgatcttggacctcccagcctacagactgtgagcaataaatttctgttgtttattaattacccagtctaaggtattctgtcatagcagcccaaaaggactaggacagtgatcttgggtgggccacttaatatcactgggctttaatttttccatctcaaaaattcaagaagtaaactatagaaactctagtatctccacccattctgtgattctctctatgctttttttctcccaaattacatcagaaaatgtcttcaaaaaatgacaggaaatttaagtgacaaaacacttcagaaatccaacaaaattatttttaatatctccaaagataaggaaaggtaatatttatagaaacactgggaattatattttaagatttcattccactaatattataaaatacagaatatctaagtcatctgtttgtacataaaacaatccaagcctgtgactctggtggctagcatctttattaaaaaaataagatttaaataaattagttaaacaatatgagtgtgaaactgagtgcataactaagacagttaacacgtttaaaagaaatcaactcatgaaatagttttaatatataacctgttgaaagaaagcacagatttgggagaacatggatggataaaatagaagattgatgtagacagg

SEQ ID NO: 9893 - DNA, 1021 bp, Homo sapiens
actcatagtccctgtacccagcttctagagccatcaccgaactggagattggggacccccatcagaacagtgcaaggagaaacatgtgcctagtatcaaaagctgaagattagaggcttttttccacgttcacattgttctaacattgtatgttatcatatcagttagcttggctcctggggacttgcctgggaacctagcattgtttccataccatgacactttagctccaaccaggcaacctagaaatagtttagaatgtaattcacaagttggggacctgtactttagcttcaaagtaatgctgttgatttgtgagcagataacctagaaatatatacatcaaaatgtttattttactcttcaaataagcaattttcaaaaaagaattgtgtattttatagggtggaagtatagcatcactaagttgtattcattctagggcgtatgtttttaaaaaaaaactagtgtcattactttgcacaggcatgccttgtgtaaatataggaaatctaacttctggggaatttcatttcaagaaatcagacctggctcacataaagatacctttcaaaaatgaaatatagcaaatttagtcaagcttaggctgttttgttttgaaagctataaagaagtaaactataacctgctttatttttagcagacacctctagaaaaccttgcacaatgttctatttataaaacagagtctgttttcatgcaaagttgcttagtaataagagaaaagagcaagactgagtatcggaaaaatgaaatgtttctgttttcaagattccttgaattcatcagcatctctttaagacacaacaaagcaattgacctggttttagttttgactatgagaggttacctggagattgataaattggattttttttttttttttgagacagaatcctgctctatcccccatgctggagggcagtggcgcgatctcggctccttgaaacctctgcctcctgggttcaagcaattctcatgcttcagcctcccaagtagc

SEQ ID NO: 9894 - DNA, 1447 bp, Homo sapiens
catgtgtagcaggtgtgaatgttattctatgatatgcagatgcaagaaatttcacatcaatatatttgtttgtttgtttttagagtagaagtaaatctaaatctgagtcttgtctcttggagtgggaaagaattagatcgcacttgtaatgggggttcactcgaccttggctcccagcccagggcctgggggagatccaggccatttggtgggagccctctggactgtggtccacactggccactgctgatgggtcctctgttagtatccatcaggtactgggcccttaaaatcaggcaatgtctctgttttcactgacttgggcttggggatcccttcccaagctgggagtgatggcatgatttgggacatcacacagctgtgccagctgagagcttgtcactcccccactaagcctgcccccttgccaggaattccagctgagtcctcactactccagacaatccctcccttttcattctagaggaatccccctcctgcttaatcttgactgtgtctggaagcccttcaccctcacccctgtctccaaaggcactcacctggctctcctcccatatgtgttgatctagccttgtgccctcagtgacagcaaaagccagaaagtgtgggggtggggtgtttttgcaacttctgtttaaaccatcacatacaaacacccctgaggcaaaggggcacgaggtcttcttagaataagggagagaaaatcaaacacagattaatatctctatcaacaattctgtcatgtgaaggaaaaattcgaaatttttgtatatgcataaagggtatgttataatatgacacatacatacacacacgtattcaattcagaggctcagaagtgtgttcaaataggcatatgtattaagcatggtttcccgttgttaccagagttggcatggaattatagaatctaaatgttatgcttgtataggccttaacaattatctcttccaaatgcattttatccaaaaatgcagtaggtatttggggccacaaagcactgtttcagttgaatttgcaaaagcattcaaactgggagaaaataatagaatcagcccagtttctggtctaacctttggttcatttgcatcactgccccttcagtattgatgttttaaaactcaatggctaccctgatcctttgctctttgcattcagccccattcctcattgccctgctcccctctgcatcaaagggcagattgacctctgccatctagggtccagcgatccctgaagggccctttcctcaatggatccagctggacagcccaccattggaccggatgtcagggtgctcctggcctccagctgagcagcacctcttcctttcatcactccagccccatggcagggtgcagcatctttcggttgctaaatccacattcctcttctaacacttttgaaagtaatgctccaatttaat

SEQ ID NO: 9895 - DNA, 1028 bp, Homo sapiens
gcagaaagggcagcatgcccaatgagtagaagcaagttagaatgcaggacatgtgtggtaagatgagaaggtcataagggcctcatgtgccgggtgagagagtttggatggtatcctgtggttttggtgaaccatggaaaggttttaagcaggacaattatttggctatatttatcttttggaaagaactctagcagcaatgtggactaagatgaagggaatgggaaggaagtgagaccaggaatgttataattgtccaggaacaagatgttgaggatcttactttgaagcatcatcacgtgaggtgaacaggaaagaaagacccaagacaagcggagaagacagaattgaaaggtttagaactaatgggctgagggcaagggagaagttaagattaaatttctggcttgctggctaatattaaatgattctctagtaatctgataatgaaccattaattgagtctttttccaaggagccctattgtgagaaacgtttgatgattttctcaggatatagctgggcaccctttctaggtggcacatcctgcaagcttctttcttccattatctgtggaggtatatttatggagagaatcttagaggttaaaaattggtctatgcaggatggctagaggcagaggaggtgggaaagaagcaaggaaagaagcggccattgaaactagaacatggtactaagggttaggataaagaatgtagcaacatgagtctggaagtagaaataagccaccaggcccttagctgggaagagtgggagatttgggggatatagataaaaatagctcagggcacagatgatttagataagactgtaagtgatatgaaggcagttggcttttagaaaaagttttgtagagatataattcatgtatcgtacaaatcacccatttaaagtgtataatttagtggttcttggtatgttcagagttaggcagtcattaccacggtcaattttaggatgttttcatcacataaaaaagaaacttcataactatgagtagataattt

SEQ ID NO: 9896 - DNA, 1023 bp, Homo sapiens
gcctcactggaatgtttatagtcatgcaagtttatgattacctaacagtcatatctaataaagaggtaaaggtaggagccttttttttttttttgagatttattcttgctctgtagcccaggctggagtgcagtggcacgatttcgactcactgcaacctccaccaggtagaaggctttaggaagggcagataagattaactcttcctatgatttacaaaggagaatatgccagaggtttccctagagtcaagatctctgattcttactgttgagagtttaatactcaagtagtttcttaatctttagcttgttcacaaaaacagtatctaaaatgctatacttttaagtttttgattcataatttggttttcctagcaaccatcctagagttatgatttattgaaagcttctctttctagttcaagaaatccacttagggtccttttttctatttttttttctttcccctttctcatcatcattgttgtccttgtcgtggtgtgtaattctaggatttcagtaggtgtctatgagttgcctgtatgttctatcaggtagctgtaacacagcttgttttgtctgtaatagtacaggataagagtatttgcttaatacaagtaacagttgattcatgcttattatctgtgtgtctttctttacattgaataatttttttcctatatgaattacttcatggtctaattcatataaaagtgcatctttccaataaggacaaaattaaagtgtagttcaattttgataacagaattaagtaaagtacttgggggaaaataatgaacccaaacacagcatagttgaatatgctcaaataagtaagattggattttgttccattagaaaggatcattagtgacctgaggacaagatgactaggtcttttgtgatccatgtgaacccaatcctctgtgttatgggcagccattttcttaaattacataaattattatgcctttaatttatatgacatctttcctccaaaggactcaaagtaccttttgag

SEQ ID NO: 9897 - DNA, 1026 bp, Homo sapiens
ggttggtttctggtgaggcctccctttttggcttacagacagccaccttcttgctgtgttcacacatatcctttcctttgtgtgcatgtggagagagaaagaaccctggcgtctcttctttttcttgtatataaagaaaccagtcccactggaatagggctccacccttatggctttatttaaccttaattacctccttaaaggctctatcttcgaatatagtcacagtagcggttagggcttaaccatgaatttggagtggacacagtttagtccataacactatcctaaactcaagtgcttgaaccactacttgcctgtaaataaagaaatggcatggtgaaaacaatgttttgggaagattaatgtggcctagatgtgtaaaaggacacttagagaatgtctagaaacttcgaatctcttccttttccatgctgtgtatttttgtctttacgggcttgcatgcgattctttgtcatcagttaggaatgtatcctttcacgctgtcaggctgtataaaatacctctggaggatggactgtgtgtgagaaatgaacaggcagcaggaagggtagggtttggatttcactgggggtgtctggctaatgacagtgactccaaagaagctcagagtttcagtgtttgagacttttgctggaagaatgagaaacagatcacatttcaaagtgcttctctataccttctataatgaaacccccagatggtatttgaatcccatccaatgtggactttctctcaactgctttcactgctgtggctattctggatgatttagccatgttcttcccacccactctttgaacattgctagacttactctcatctccaactgttgtcggctcatcagtcatcaatgcaccaaggcggctctctctccagggttagtggctctttctgcaggaccagcatctttctctgatttatgattgcctgtgcccctccttctatggtcctgaagcgtttgtcttctcccattcctgcagcagctctctaattctacagaat

SEQ ID NO: 9898 - DNA, 1027 bp, Homo sapiens
gaatgtacctcagaaatgaacttacataaaatgtctttatttctattagaggatgaagctactataacatgaagctaccataacaatataagggatttacagttgccagaatttgagccatgctgctgttacttatggtcttggaatgtgtctactgtttgttttctactgtttgtcttgctttttagaagtcgattcttttaatgttctgatactgtggaacatatttggtattgttttctctcatattgaaaacacagtggtcttttgttgctgaatttgggctttgatgtttttagcagaaccaatatgaaataatctgcttctccattacccatcacattcttttcagttgaattgtcttgaatgtacctaagacaataagaactgacataagaaaacaaaaagtaacataatgcaataaagatgaataagattaaaggtaaaatgaaaatcctaattttttttggattaaacttctttttgctaatgttttggattagcttagtgattcaaaaatctcgttccaaaattatctgaatagtgtgtgcaataatatcactattttcaatttctttaaagtattaatttttataatatgcgataaaaattaatattagaaaaaatacattaatgggccaggcgcggtggctcatgcctgtaatcccagcactttgggaggccgaggtgggcagatcacaaggtcaggagatcgagaccatcctggctaacacggtgaaaccctgtctctactaaaaatacaaaaaattagccaggcgtggtggcatatgcctgtagtcccagctactcgggaggctgaggcaggagaatggcatgaacccaggaagcggagcttgcagtgagccgagattgcaccactgcattccagcatgggctacagagcgagactccatctcaaaaaaaaaaaaaatacattaatgagaagtaaagtctcttcctctcaaactttattcccatttcccagagttattcactaatagcatgctttttgtatattcccaaaaat

SEQ ID NO: 9899 - DNA, 1054 bp, Homo sapiens
aatttaggatatggcttaggtacagttagtaaaacatgccaactttgcgttcatttgaaaaggaattgtggtgagagtagcaaaattggaatattcaaggttattgtgattttgagaacattcactaaaggttgggcaaaatgtaatgaagatgatcaattttcatatgtaggttttacgatagtaggaaaatattggactgcccattttaaaggtaaagaaacagatcctacgaagcctttacacatctcatgtgatagctaattagcggcaggtgctgaaatctcttgactcttctttgcagcgctcttttccatcttgccaccaccttttcttcctcctgtcctcattgccccactcctcctcctctttgtggattttggggggaaaatgccagtatattcatactaccttattttctgacaggcatctgcagtcaggtgtaaatctccgtaggaagatacaatcttccttttcaagatgtgctgaagagaaaaactgcgtctgtatcaaaatcagggaagagcaattggtctgggcattagctcccatgcagtgcctgttataatgagacaggctttccctgtgcaggcctgacatcctagaaggtgcccggagaattgccaggtgggcagtcagcggggaaagtccacaggccagagctgtattactgtcccagcagttattcggactaaatgcaaccactgaaccttactgttgcaggcacacactctctctcagtgagattgtccttctccataacagttaatttgtttttacctctcaattagctttttcacggagtgtttgatatgttcaagttgctgagattcctttcctacatatgttcccgtcccctggattaccgactgacatctatgttagtctgactcaccatgaacgttatcgagcataaattcttcatttgaacataaatgaatgcagattttctcgtaagtgaaaatggggtgatgaatttacacctacttaagattctacctagttttgattgtgttttatgatgaaaaaaatggattacttcttaaaatataaa

SEQ ID NO: 9900 - DNA, 1034 bp, Homo sapiens
cattttactaagaagacatagaaatcaaccattagcacatgaaaagatgctcagtattattaatcatcgaggaaatgcaattaaatccatggagttaccactatacacacattaaaatgactaatatttaaaagactgacaataccaagtaggtgaaaatgtggagaaatagcaaatcttatatttagctgataagaatgcaaaatgacgcagccacttggcaaaacagtttgatactttcatataaagttaagcttacacttaaatacaatcctgcaatctcatttttagatatataccaagataaataacatatgtcaacacaaaaacttctaagtgaatgttcatagttgttttatttgcaattagccaaattacagacagtaaaaaagtccatatacctgtgaatggataaaacattattatatatttatgtcaaggactatttttcaacaataaaaaggaacgagcattgtggtaaatgaatgaaaccaggtacaaaatattacatgccatgaaattgtagaacagacgaactattctctagtgaaaaaaaccagattattggtgacttagggccaggagtattgagttgtaattggaaaagaacatgaggaattttggaaggtggtgggaatattctatatattcactgtggtagttacatacggatatacattgttctacctgcatcaactgcacctacttaaaataggtacagtttatttcatgtacattataaatcaacagagtagattttaaaaacaaaaataataatatgattagaattgtaatctggttcatttaattattcttaagaaaatttcctctggttatctacttctcattcacattctaaaaataaaataccaaaacaccacagaacacaaattcacgagaaatagctgccttttcaaatcatatttatgttcattactagtgcaagcaaataactagatttggtgtacattctttcacttacctttatgagaataagacaaataacaggccagcatatttagctctaggatttt

SEQ ID NO: 9901 - DNA, 1099 bp, Homo sapiens
accatatctcatggtaaatatgaaaagagaatacacaaaaatggttagtaccttgcccaaggtcagagttacaaggattatattaaaacattttcatattctgtggctgtctaaacatctgtatgttgacctgattattcagtaccatgggcacaaacagtccaggttcctgtagggattctggtttcaaaaaaccagtatctgacaaaaaaatataacacactgtatgattacccgttacacaaaatgttaactggcaaaactaccctatgatggtgggggaaatgaggagttagtggtaactggaagaagtcataagaggctttccaggtcaggcactgtggcttatgcctgtaatcccagcactctgggaggccgaggcgggtggatcacctgaggtcaggagttcgagaccagcctgaccaatatggtgaaaccccatctctactaaaaatacaaaaattagccaggtgtggtggtgtgcgcctgcagtcctagctaatagggaggctgagacaggagaattgcttgaacccaggaggcagaggttgcagtgagtcgagatcccgccattgcactccagcctgggtgacagagcgagactccgtctcgaaaacaaaaaacaaaaacaaaaccagaggctttctggttaaatgggtgtgtttactgtgaaaatccatcaagctacacacttagatttatgcacttctctgtatggattaaaatttttaaagttttaaaggtagtgtgttgagactcttaagtggctacatttttaaatagaaataagcaaataaaaggagaaagaagaaattcaagaaagtgtatattctttgaaaggatggtaatctaacaatttctgaaaaaggctaggggtgattaacttgggaaaattggatccctggagaactgtataatgagcagacgtggtacacacaagtaaaaggtgaatctaaatgtgggcagtggggggtgaccaagatcctttgttgagaggcaggtgtccaaggatggggcaacagcaaattccctctcctcaaaccccactacaattacaaagaaggagcacaaacaaatcaatgtgtttttttttcttttt

SEQ ID NO: 9902 - DNA, 1035 bp, Homo sapiens
aatgtgttatttgatattgtggactgtttcatcagatttcacttgaatcaagaaaggtaacacctgtgtattgcctccacaaaagcctcttttgttaaatggacacccgcaggccatgaggcaattacatttgttgtttgtgctaaaaaggaggcacttaactagacctcagtaaatatagctgagaactagaggcttgattcttttgtccagccctgagattaggttttatcatagctcaggaagtaaacctagctcaggaagtaaacctctgtcgtagaaaggaaaaacaagaatgatttaaaggtccctttaatgccttaaaatttagctgtaaagttagctatatctgaggcacatggagaattcaggtttgggcaaaattaaaacagtttatggcattcatgaaaacatatattcatatattcagtcttatgcattcattcaaaatggcatagcatatttacaagagtacaaaattaatccaacttaaaagttttgattatgagacgtaatgaacaaagagatagaattaggcatttccattttgggccatttgtaaaacatttactataaatgtgtttattagagtggttttcagccttagttgtaaagttatcatagcttttaaaaaaacacattttattatctgtctctgtgagcacaaaaaaaggaaagaaaaatacatgttaatctaccattttatcctcttcatattttattattataatattgctatagaattcttttttctattatctggtttgaattttcaacttactgacaactagtaggttaatctaacagacaataactgtgtttaaagttagaaagaaaatgttctgttccttgcctcattccatatcaggaaagtcaggtgttgtgtttcagacccaaaccaaaaaatgtgttttactgtatgtttgtttaaatgtgttcttggctagagtaatattttagtcatctgtaggtttgatgacagtactgtgaaataaatgacaagtcatttacttgtactgtacaaagaagcatatc

SEQ ID NO: 9903 - DNA, 1045 bp, Homo sapiens
attcttactttttaaagatcttcagctattctctttgtatcatgcatcatcactaaaaaatgccatccgtctcgtgccactgcactccagcctgggcaatagagtgagactctgtctcaaaaaaaaaaaaaaattcatctgtcatccacctgcctaatttgcaattttgtattcacaaacctagattttattctaaataatctgctgggtttgatacattagagttgtgtttcgatgagtaaaacacaagcaggagaagtctgtcaaatatattcaacaatgcctgtttttaaaaaaatgcatcagtaacatcaagtacaaaaatacctacatatttatttttaatcatttcttttttgaagtatggcaacctttctactggtaatctatttctaataccctttcagatataaatctgtttttctggccaatctctatgtgaagcagctatgtacagcaacaacaggagattgaaaagagcaacagagattcatctgtagcaataaatccatataggatgagtttggatttgggaaagaattaagtggagtgccacgaataaaacttttggtggaaacatgttagtacatactgtgtacagtatgcatctaatttactgttcagaactgtttttctgagagcatgagaaaactcattattgtaatacttaacaccattttctactacagtctgaaataccctttgttgaattaagttgggctcatcctttggaaggaaagcaagtatatagatcaagctgtattaaaatgaaagtgcagagatagtcttagaatgagaatataaagtgctttttttaaatccaaatctcaaaatagcaggtaacattgtatttacaaagagacagaggtaaaacacagggacaatagtattgggaggcatggatagaaaggcctataaactggcttcagtcccaaccctcttctccatctcctacattctgactagttggtaaatggttctgaagaagtggatgcttgataagggcctaagcattcaatatttaataaacattgcttgatgagca

SEQ ID NO: 9904 - DNA, 1559 bp, Homo sapiens
ccaaagatatctggctatttaatttaaaggtttttggttgtctttggtaccatagatgtcagcattatacacaaaaggtgaaacattgttcaccaaatagtaatccattaccacagcagagtgatgggaggtgaataagtaatgtagttatttcttatgtttttctttgtgaattgtagagtatgttaataacatcatcattattactggcagaaatgtaagaagtagagacaattttacatttcagaaaggactgattaagtgttatcaggatgtactggtggtatagtgtattaaaatggaaatgtaacaatatggcaataataaagctgttttaccgtgtattagaaaatatttaaataaaactgatggacaacctaagaaacaatcttactaattagcattacaaaatggtcactttatatagttaacactaatagtcctttaatgtgtactgtgtatttaggttatagtttgaaaccctgaatattctaaatgctgtctttctgtttgtttaaatgtcatttcccttagctaaaagtcaaccatctggtcttctattaccacttgtattataaacagaaaaaagtacttctctgtagagagaggaatcatcagattgaaagggcttgtgtattataagctgctgatatactaaatccttatgtcatttaaatagaagaactgcctaataatgtcacttattacaactagagtatctaaacaagcgacttgttttttgcagactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgacgtgactttttcattctatagctaacacaattctgaagataaatttcactcattgtttacaagtctgaagtgtttttgttcagatgtcaacactaaagaataatctttgaggctcctagacttaaagtgttttctgatgtgttctctgaatattttcagaataatttgagcttagtttaacagtaatatggagtttataataatcttattttgtagtagtatattttatatgtatatgtttgaaaagatgtatatatgaagatcagcatctctgttgaaagagtagcaggttgtcctgaaatttgtatgtgttgctcacctggaaatattttaaccactcaaaagttataaagttagtgctattggtatgaatctagagaggcaggatacagttgagtaaaatgaaaatattatatgtatttttatctgcaagttatctgggacttctgtactttaaagttgcttaaaagtcatttgcaaaaattaaagaacaaaattgtaacacaggtattcagtgaaagcatctgaaccagactccaaactctgttggtagtaaggagaatatattccaagtgtgatgtggcttcctaatctaaaacaatcttttttatttatttatttttgtctttcggagacagattctcagtctgtcaacccaggtt

SEQ ID NO: 9905 - DNA, 1022 bp, Homo sapiens
tatttgtaaaagagtaattggtttggaaggagacaaaatcctcaccactagtccatcagatttctttaaaagccatagttatgtaagtaacatttcaattatgttatttttggtgtcataattgattaacattaactgagtgctgacaaaagaaaataatgtttattcatattttgaatgtaagaaaaaagggcatccagtagaatttaaatgtttatatcaagaacaattcagccgttatatttcatgtattttagttacttttaaaaccctgcataaacatcttagtaataattgttacaggcaaaatttaccagtggatgctaaaattattggacaaagtttgaggagaaatagaattttacataatctgaacttatctctcccaaaatatttattacaaagggaaaaaaccttagaggtgaaacctgtcaggcaccactttaactgagttatcttcatcatcataacactacatatcaacataaggtagcctctggattgaagcaccaagaagggcacttgcaggaaaaaaaagttacaacctcaatctactcatgagaaaacataagacaatatcaaattgagggtcattctacaatataactgatcaatactcttcaaaaatgtcaaggtcataaaaaacatggaaagattgaggccctgtcattgattggaacagacaaaggagacatgataactaaatggatttgggatcctggcttagaaagattttccactattagggggaagtctgacaaaataataacatcctatttaaattttgataatcgaaattgtgtgtattgaaattgtatacaaccaccttgcctgtacagctagaaaaagtgcaagaacagtaaaatggaagaatgaagagtagatagaatgtgttagctcctttcaccagtcacatggcttctgtaacagagcttatggggaagagatggccttttgtttactcagcatatactcttcttacttgaataattatagcttaattttctactttactgtaaatc

SEQ ID NO: 9906 - DNA, 1031 bp, Homo sapiens
aatgggatacagtgatattgtgttacatgtatacagtatataatgatcaaatcagggtaattagcgtagtcatcacctcaaacacatcatttctttatgttgtgaacattaaagatcttcttgtacctttctgaaaatatacaataaattatagttaaccgtattcatccaacagtgctgcagaaggcagtaacttattcctcctatctagctgtaattttgtgtccattaaccaacttctcattctcccctcctacctccccttcccagcctctgatacctataattctacactatacttccataggctcaatatttttttaagctcccacagatgagtgaaaacataaggtatttttcttcctgtgccagatttatttctcttaacataatgtgccccagggtcattcatgttgccttgaataacaggatttcattctccttgtggctgaatagtattccattgtgtatgtatagcatgttttctttatccattcatctgttgatggatatttcggttgattctgtgtcttagctattgtgaatagtagctacgctgcaataaacatgaggatgcaggtatccctttgatatactgatttcctttctttcggattaatacccagtagcagaattgagagaattattttttgattctctagagtttttaaagaaacctccacactgttttccatgactgtactaatttacattcccactaacagggtatatgaattttcttttctccacatccttgccagcactttctttgtcttttttgataataatcaatctaactgtggtaagatgatacctgattatagttttgacttgcatttccctgaagattagtgatgttgagcattttttaatatatttgttggccatttctatgttttcttttgaaaaatgtctattcagatcatttgcccactttttaattgggttatttgtttttttgctgttgggttccttgtatattctagatattagtccatgtcagatgcatagtttgcaaatattttctccca

SEQ ID NO: 9907 - DNA, 1025 bp, Homo sapiens
taggggtcactcttatttgtttagagatggttattttctttagaacgtctcaaataaactcatctgaagtaaattcaacataaaacataagatcttctcaatggtatacattcttttcataaaaatacaggttatttgaattttaatatctgttgataacttataagaaatttggcttatcttaagctagatactaatttgcagcacaggcaactcatgatgtcagtaagacttaagggaattatttttggagataagagagtgggatatacgatgaaatgagaagaaattttttagaaagaatgataagtcaggtataacaaaagaataggatggggctgggcatggtggcacccgtccctggtcccagacacttgggaggctgtagtgggaggattctttgagcccaggagttggaggctgatctctctaaaagccgttcatgaactgtggcacagtgagggttagcctatgataatgctaaatgatatttctttttgaattaatattcttccactgttactcatacaactgctatattttgaaatagatcatttaatagttgtattattggtgaatgaatgtggatgttttggtattttactttttggaaggtgatgctttcttatattaaaatgatcaactgcttattctttataaacataaggtgagtttcaattttggttatatgtgaaaatgtaaaattcagaaaataccagtggactaatgaaatacattgaagtattagcattataatatttacttgatgaaaatttatagaattatcccaaagttaacgttcactttaaagataatgaatgggtaaattttgtcaagtctctgaaaatattgagtatgcgtcggtggtcttaaaggacaggacaaagtcctttactggacttccttcctgggagcttattaaaactatagaatctgcagccgggttcccagagattctctttcattagctctgtgatgtaggatgagaatcataggaatcgcagggagcctgggaatttggattt

SEQ ID NO: 9908 - DNA, 1035 bp, Homo sapiens
ataaatagatctagttatagtattgatgtagatacaggacctaatgcagtaactctgtttcactttgttagcacacttattctatttagtaacatatcatgccttctataactccttcactttactgatgaagaaactaaggactagagagattgagtcacttgaacaaggccatttagcaaattggagctagaagccagactaacctatctactttggcagttacaacttaaagtaaaatgaaatcaggacattttcttgagtgttccagtcatttaagtgaaaatatgcctaaatagcttgcagaaaaaatcagatattccttcggctattaactaacaactggcttagcatagaaagttgcatgtctatcgtaaggagaggtcattacaaaaaaaaaaagggaaaaaaaagtttcacatctaaagcccccatagttattgcactttatcacagttcatcttctaaagggcaaccactgtatattctgattttaaccgagaagttttactttgagtacttcatcagaaaaacgtgtgtctttgttctcttaaacagaatacattttaagtttttttataatggctctgagttgttactgtgaacatcagtcattttacagaattaaagtgatttcctcggaattctatgctgtgttggactgttttcttctaaattatcctagcctgataagcttttttgtcctcagagctactgtgatgtgttttctcatttgttttgttttcttttacatttgttaggtaattcttgctttttgttgtcagtgccttccgtttgactcatatttaaaatcaacgcatttgcctaacattatgtattacttaggtgagagcttaagtatggttctgtcacatctgctgactataagagtagagaatgtgtgctagcattttaaaattcattttggtatcagcaactagtctagccactttgtttttacaggatattgagataacctcagaccgatttctgtctgaccgactgatttctgtctaatatatatgcaacataggt

SEQ ID NO: 9909 - DNA, 1068 bp, Homo sapiens
aattcaactcaatatggttgaaaatagccttcaactaatgtaattttgatttcctgctttaggattcctgaaattgtggatcacccacctatgctttaagacatgctttattttttttttttctggaagccctgcaacttccctaaaaattgaatgaattgtagaacagacctatggtaagtgggctttttcctcctttttcttctgtcggtttcatgttcaacttaactcttatgactgttgtaatgctgctccctgctggacacaatgtaattttgtaaagttggcacttaatagatgggcaaataactggttagttggacccactaaggaggggaatctttggctacattcacaaaaaccaatagtatgcaacaaaagcaactattataaaggtgctatatcattgccatcatgttggtacctggagcctgatgaaagtactgatagtcttgtttcaaaatttcattgtctgcttcctgttgagcagcatctaaaagttggaataactgtacacactgaaggatgcttctaggtggtgaacctttgaggattttgtaaattgtgtagggtttttttgtaatgtaagttagtttactgttaaatgttctgtaataatttccattccctgtacttttgtttttccaaagaaaatatctaaaactgccccagtataatttacattagacattgtataactatgctataatccagctatcatgttttctagtactcacagtgtggatttcatctgtagtgtctgtgacttgcctatcatggaccttcatgttgtatgcatagacaagtgctcccaaaattattttaaaatgtgtgaaagtcagaagtgtgtttcttcctaccttagggctaagctattgtattttttgaaatgcagcatgcctcaaattattacctgaatatcatttggaattaatgagcatgcattttcttgaaaagaagactgacagacagaaacaacatggagctgctaagccaagatctagcaggataactgatcttatattatttaaaggctgaaatctacttttaattaggattgtggagaat

SEQ ID NO: 9910 - DNA, 1066 bp, Homo sapiens
ccaaggcccttaggaattatactaaagctactctgcctgttctttatagacagaacaacaaagcctgggtgacagcacatgtgtttatagcatggtttactgaatattttaaaatgtgtgggtctcccatgtatgtctagaggatctctgccatcataagagaattcttcaaagatctttcctggataatctcatctctgtttctagcttctgctgaaaaggttgatttggacccattagtcacatacctaatctcttcagaaaaggtttttcagccacatccttggcccttctccagagcatgttttagcatcttttacaatttagataggttaagaaatctccaaatcataggtttttctttgcttaacaatttcttcctcaatttatctcttctctcacattttactgtaagcagcccggagaaaacagtctacgcctttaacactttgcttggaaatctcctcagctacatattcaagttaattgcttaccaagttctacgttttgccacatagtagaacccatttcagccaagttttctgccactttacaacaaggactgctatttctttactttccaataccatgttcttcatttccttcttgagagttcatcagaaacctttttaatgttcctatttctgtcaacattctgttcatgataatgtatgtattctttaaggtgatagctttctttacctcttctcttccttctgagccattagcagagttctcttaagatttctttttctaccaaaaatttcttcaaggcaacctaggctttttctgtttttctatttttaggtatcacagcaacactccagtttttggtatgaaaatctatgttagttctctaaaattaccataacaaatgaacaaaaacttggtgacttaacacacagagatcaattttctaacaattttggaggtcaaaaatacgaagtcaagttgtcagctatgtttattatgaaaactctaggggggcatccttctttgcttctgcagcttatggtgtcatgttattccttgccctgagacagtgtaactccaggctgacttcatt

SEQ ID NO: 9911 - DNA, 1064 bp, Homo sapiens
actaaattttgactcagggcttaaaataataatatcaacatttgaaatcagcgtgtaagtcctttcgccatgagtgtaagtttcccgaggccttcccagccctgcagaactgtgagtcaactaaacctcttttctttataaattatccagtctcaggcagttctttgtgcatgcctgaggctagcatgagaatggactaatacagtaaattggtactgagggagaggggcactgctataaggatacctgaaaatgtggaattgactttggaacagggtaacaggcagaggttggaacagtttggagggctcagaagaagacaggaaaatgtaggaaagtttggaacttcctagagacttggaaggctcagaagacacgaagatgtgggaaagtttggaacttcttggagacttgttgaatggctttgaccaaaatgctgatagtgatatggacaatgaagtccaggctgaggtggtctcagatggagatgagcaacttactaggaactggagcaaaggtaactctgctatgctttagcaaagagactggtggcattttgccactgccctggagatccgtggaactttgaacttgaaagaaatgatttagggtatctggtggaagaaatttctaagcagtgaagtattcaagaggaaacagagcataaaagtttggaaaatttgggctggtcgcggtggctcacgcctgtaatcccagcactttgggaggccaaggtgggcggatcacgaggtcaggagattgagaccatcctggctaacacagtgaaacctgtttctactaaaaatacaaaaaattagctgggcgtggtggcgggcacctgtagtcccagctacttgggaggcttaggcaggagaatggcgtaagtaaatccgggaggtggagcttgcagtgagcctagatcacaccactgctctccagcctgggtgacagagtgagactacttttcaaaaaaaaaaaagtttggaaaatttgcagcctgactatgtgatataaaagaaaaacccattttctggggagaaattcaagacagctacagaaatttg

SEQ ID NO: 9912 - DNA, 1041 bp, Homo sapiens
agagggggccattgggaagtttttttggtgtagggagaggagtagaagataaagggtaagcagagtgttgggttctgggggtcttgtgaagttccttaaggaaggagggagtgtggccctgcagccctcccaaactgctccagcctatgctctccggcaccaggaagttccaaggttcccttcccctggtctccaaacttcaggtattcctctcccctcacaccccttcaacctcagctcttggcctctactccttactccactgttcctcctgtttcccccttccccttttcctggttctttatatttttgcaaagtgggatccgaacttgctagattttccaattctcccaagccagaccagagcagcctcttttaaaggatggagacttctgtggcagatgccgctgaaaatgtgggtgtaatgctgggacttagagtttgatgacagtttgactgagccctagatgcatgtgtttttcctgagagtgaggctcagagagcccatggacgtatgctgttgaaccacagcttgatatacctttttctccttctgttttgtcttagggggaagactttaactaggggcgcgcagatgtgtgaggccttttattgtgagagtggacagacatccgagatttcaggcaagttctgtggtggctgctttgggctcaaaacccacaaacagtcaaaacaaactatttcagtatgcttcttcactatagttcagatagaagaaaataaatcaaaattggggcatcgcttctactgattaaagggttaactgctaaagaatgtaggggaaacagattggggatattccagtactttgtttcaagccccaaagggtagattttgtatgcactgcagggcagagctgagtgaccctcagatcgccccaagaggttgagtggatcaattcctaaagaacggagattctcctgtcctagccccaggtccacctcggttgggagttcaggcctacctgatgcagctgcccgaggattaactcctattttcttgctaacagagccccatatt

SEQ ID NO: 9913 - DNA, 1122 bp, Homo sapiens
taacagcagatctctcagcagaaactctacaagccagaagagagtgggggcaaatattcaacattcttaaagaaaagaattttcaacccagaatttcatatccagccaaactgagcttcataagtgaaggagaaataaaatcctttacaaacaagcaaatgctgagagattttgtcaccaccaggcctgccttacaagagctcctgaaggaagcactaaacatagaaaggaacaaacggtactagtccctgcaaaaacatgccaaattgtaaagaccatcaatgctatgaagaaactacatcaattaatgggcaaaataaccagctagcattataatgacagaatcaaattcacacataactgcattaaccttaaatgtaaatgggctaaatgcccaaactaaaagacacagactggcaaactggataaagagtcaagacccatcagtgtgttgtattcaagagacccacctcacgtgcagagacacacataggctcaaaataaagggatggaggaggatataccaagcaaatggaaagcaaaaaaaaaaaaaaaaccaaaacaaacaaacaaacaaaaaaacaaaaaccaggggttgcaatcctggactttaaacaaacaaagatcagaagagacaaagaaggccattacataatggtaaagggatcaattcaacaagaagagctaactatcctaaatatatatgcacccaatacaggagcacccagattcataaaccaagttcttagagacctacaaagagacttagactcccacacaataatagtgggagactttaacaccccaatgtcaatattagatcaacgaggcaaaaaattaacaaggatatccaggacttgaacacagctctgcaccaagcagacctaatagatatctacagaactctccgccccaaatcaacagaatatacattcttcttggcaccacatcgcacttattctaaaattgaccacataattggaagtaaaacaccctcagcaaatgtaaaagaacagaaatcacaacaaactgtctctcagaccacagggcaatcaaattagaactcaggattaagaaactcactcaaaactgctcaactacatggaaactgaacaacctgct

SEQ ID NO: 9914 - DNA, 1049 bp, Homo sapiens
tttcattaaattttgaattaaaagctcaaaagaaaacctattctattaggaaaaaagcaaaagtcttattaagagtatgcctaatctcaattttataataagaataacttttaaaaatatatagatgaagtctcactgtgttgcccaggctgaagtgcagtggcttgatcatagtccactgcaaccttgaattcaagaataatgtttgactttttctcccatgtacattatatctaaaataaggttaaataaaataaataaataaataaataataagttcacataaaacctctcccatggtgtatgtagtacatcttctagataattatttgtagttgattaatccatcatactaatattgacacttaaaattcaatagctaattgacatgttactatattatatacaaagtaaaaagctagagtgaaaattcaatacatacagcaaattttagaaagatttcaactacagtttgtggtgctatcaattattacatgaaaattttaatatgcaactctgactataaatatttatccattaatatttattaaatgtatgttatgtgccaagcactgcgctgaggttacagatacaaagatgaatatgatacattctctgcccacaagcatggaaagaaataactataatgaaatgtggtaagtgctgtaactataacaaagttataagcacttgtttttactatagcatttaagtaggctgcagaaacctattcatttacttcgtgcatataagttattctttgatgtagatattatctcctgttattctcctagggagtcactgtgcttattcacaaccaattctaaccagctctaggtctaatagtgtaggatatgaaaactgattacagagaacctagtttgggagacatgtaaatatgcttactccctttactacatcaagtaaaaatgacatactttcattctgacaattatggttaggactggattaagacagtctgaggctttaatctatgttaagtgtaaaaataattccaaattgtaataaagattcacattctattcatt

SEQ ID NO: 9915 - DNA, 1033 bp, Homo sapiens
gagtcgcatgaagtatgaaaaggttcacagtatatataacagacttctggcaattgaggatattgaccctaccttggtgagtaactttacaaatctttttttccacctttacagtcttatctaacaaaaaataatttaaatttatatacaataaaattcactgtttttgttgtatagttctattaatcttgacaaataacattgagtatgggatccccaccacaattaagatagaaaacacctccaccatcctccaaaaattcccccatgtgacccctttgtagatataacccttccctctgcccttacctctgacaattactgatctgttttctgctagaattttttctttttaatgcagcagtataaaatagatacagaggcactttctctaacactttctttgtgatcatggtttgaagtcactttatgccacagaattgttgcttaatagatatttctttttaaatgaggcgggagaaaccgacatcctgggaagaaattagactgaaactcactttatgctaaatcctgctctatcatagtggttttcaaagccccaagtgcaaaagtgcagtgatgctctcccattgggagaggaaggggacaggcttgtgggtgtgtctctagaacctctgcctcaagtcaattatagctacactactttttcttgttaatgatttatattgggattccactgctataattcctacatttattcatcatcttataattcattccacaaacatatctggcaaatatattgctagagtctatgcattgtgctagactccagcaacattaatgacaaactagatgaaattccttttcttgaggaactcatagtccatccatccatccatcaaaactgggtaatatagctagacattatcaatactgggcaaaccaggaccctactaattagtcatttgttcactaaacaaaactgcatactcatgatgtactggacactctgtaggtgctaggtataaaatggctcatagtttatccatgaagttctattatatgttgt

SEQ ID NO: 9916 - DNA, 1025 bp, Homo sapiens
aatgacattttttaaaagacagtggtattacatgaaataaaatgtttttatgggtgttaagagtaaatgaggattataatggaactttgatcactgaattagagttctgatacaattttttaaattgatgaattttaaatgaatttatatctgtattcttagtaattatgtgaaaagcctaacatttgtatgtttaagaatcaggtttttttagtacattcaggtaggctgatttaataattagtagaaaattattaaatgctaggatacccacaagtataaaaatttgtgcataatgtctgcatgatagataatccacatattaatagtaaagtctattctctagtcacactggcctccttgatgttccttaaatttattccagacattcctcccttagggcttttgtctacattagctcttttatctgttctaaagatatttttccagatagctgctttgctagctgctttactttcttcagatctacaaaaatgttaacttctcattgagatctactgtgaccactctgtttaaaattgccacttctatcccctgcagaactccttatcctttaccaagttctccttttcccctataatactcatcacctaatgtactgaataatttacttatagtttgtctcttttgtatgttgctatattccaggaagctacaataatgcttggcatataatggcactatgaatacttgttgaattaaaaatccacagtgggaaataattgtattttacaagttgaatttctaaaaattcaaaggtctcaaaaaaagtaaaatgagttatttcagtttataacaagatgtattttcatgaatataaaattgtgattggctgatacctttactgtgacaggttaaaaaaatgtctttatttttagaacactaaaaagaaactgttcttttgaattgtctaatacccctaaatatttaagtatttcagagtaagctgctttcacattatttagaattatgttgatgtataacataagagaaagatttatact

SEQ ID NO: 9917 - DNA, 1053 bp, Homo sapiens
ttgtagacccccccaccatctgtatatttttataggtttttatgtggatataggtaaaaaaaaaaaaaagtaggccgggcttggtggctcatgcctgtaatcccagcactttgggaggctgaggcgggcagatcactcgaggtcaggagtttaagaccagcctgcccaacctggtgacaccctgtctctactaaaaatacaaaaattagccaggtgtggtggtgtgcacctgtaaccccaactgcttgggaagctgaggcaggagaattacttgagccctggaggcggaggttgcagtgagccaagatcatgccactgcactgcagcctgggcaacagagttagactttgaaaatgtcttttttcaggttcttccatccacgttattttttcagggaagatgaggacattatcttcctaaattgcttctaaaatttattaacttttccagtatctgttgtgtaaatgcatgccagacactgcatgggaagatgggggatggtgagtcaaggaaatctggaagaacaggacttgtgaactgaggtttgaagtacatgtatgagttaagcagagaatacctggcagagactgccagtgcagaggccttaaaggaaagagagaaaacatgctttatttgatgagttgaaacaattttagcttgatgatttataattttttacattttagaaatagatgaatggcgtgtttttttaatttttaagctgaattttgcttctagtcattcccagtatattaaagcagatgacttgtggcttacatgaacgttatagaaatatgagaataatatagaaatattatagaaatatgagcttaatggtcattagctcatctagaattgtaactaagcagtgagggagaataattggagaataagcatgaacatctgaaataattgctaggttaataagttggctgtaattttgctctaggaagagcttaagttgagatatcatttataattctgggcccttattttactcaaatgcctacataaatttataagttaaatgactgtggaagcttcctgttcaat

SEQ ID NO: 9918 - DNA, 1022 bp, Homo sapiens
tactgaatttttaaactttaaattttattattaaaccggtttgctcctagcaacttggtagcagaaaacaaatagttggtttgtataatggcataataggttgaagtctgcatctagatttttttcccccacataccagaatccacaacagtttgaaaaaaaaattgtgaatatttgctttgaatacaacttcttgagaaactcagctgcttttctaagactcaggaaagcataatgtgggtaagttttaccattttgtatgctagacctccaaagaaaaattttctatttgcaagtgttaattaagcaatagttctaaagacaaattgacatcagcgataggattcaaatgtagttttgaaatagtacattgcaccgtagtaagggtcaaagataacaagatcccaaagctgtttttagtctttctgaaatgaaatctaaatacttctattcatgtgacagaacatgttcagttacaaccttttatttaaatgcaacatttcagctctagcatgtactgttgacgttttaagtcttcctttgtcctaagattcatattctgcaacttttcatactggatttgaagaaaaaagaaggttggctattttgtgatgatggtttccctggaaattttttcattcaccagactatgactactgtacattttacatatagttgaagtggacataatgttttaagtcagaaatttttagagctggaagatgaattagtttagccccctcattttatatgtgagtaaactaaatcaagacattgttatccctggagccaaagtttacaaacttcactgctttagaatcacttggaaagcttttaaagcatacaagcttcccagttagcataccagcactgctgactcaatctctagaggatggacatatggtatgtgtttctggcagctagttttgggaattgaggctttgcagggcagtaattgaatcttactgctgtcagtaaattttatagtttgcagaatatttcctatacttgcctggacaata

SEQ ID NO: 9919 - DNA, 1086 bp, Homo sapiens
tatttttaatattaattttgtgatatagattttcagcataatcaagtacactgcagcctcaacataacattttctgctgtacctgaaatttgataatatttaggtctgttttggacctattcaaagggctttggtcatcagcagtactgaatatacttcagcacaacacagtgtcatctgtgatatgtcctcagaatggacccaaccaatagcagatttaaatagaggctacagtgtactcattgtatttgtgctatagtttagattgtattacttggtggggagggaaattactggataatagcaggaacattgtgtgtgttttatttttgtgtgtgtggttgtgtatgtggtatgtatgtttgtgtgtttgtatgtatgagagagattgtgccttatgtggagtctggtagttttggcccatgaccataccttaaagtttcatcacctatcctctgggaccatttctttccttaatatatttaaatcaccaaagtagcttggcacaaaacaggtgaggcctgtctgaaatatgctgaagcccgtgctgctttgtattaactcattaaaacaaggaacctggatcacctgcacctgatctgcattctagtctggctttagaaacacattagacttaaattcaaacgcaccagaaatgaaaataattgatatataattgtttttgtatagtgaagtagaactttctgagtttttgaaatttccttgtttctcaattattcaggcattattcatgcattttattatagcgtaagttaaactgaaataggcagttagatactccattctgtaactctgaacacaatgggtttgtttctccaatttcctagctgtaagttacaaactgcatcctaaaaaaaagtttcaggaagaccagatgttattccaaggggctgaaagttgtctacataacaggctcaattcatataatgaaatgaagagctgctagcagttgcctgatttatttagttggtaatatttgcagttacttcacacacacaaacatacacacgcgcacaaataggtatatataacatgtattaagaacaaatggtaaataatatatat

SEQ ID NO: 9920 - DNA, 1053 bp, Homo sapiens
gaaacacacttctcttttataagaggatatttttatgctttgtaatgtgacattgcatctgaggactttattgttcatgaattaagttaggcatgagatttttaaaacagtaactttagttcactgttgttttttttccccaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggtattggagtgctttagccttttatttacttgtcatgtgtcaatttattgcctcctgtgtcatttatttagaactcatttttctttttattcctacttacaaactaatatgaatgggagtatatgaaaatacagaaatgttaacttagtttttcatagagtattttgagtgtctggtgaaatgaaacattttaagagaagaattacttcacattttaattttgtgaaaatgcatggtttatcaatgtaagcacttcaataatttaacgatttttctgtaagatagtttatattatgcaagaataagctaatgtgattcaaacctatttaatcctatttaatcataattttacccaat

SEQ ID NO: 9921 - DNA, 1044 bp, Homo sapiens
aggttgagcctctgcatccggctgcattttctttttgaaccactggtggtttattgattgtactttaataaatttagtatttttgtcatgtgttggaggttttttttacgtttgtctttttttattttggtacttttctcatgcgcaaattttaacttaccatgtaagtttactctttaaaggcttttttttttttaaagacagggtctggctctgtcacccaggcccgagtgcagtggcggcaatctcagttccctgcaacttctccctcccgggctcaagcgatcccaccgcagcttcccaagtacgtgagactacaggtgtgtggcacacacctggctaatttttgtatttgggtagagacgggattctgccgtgttgcccaggctggtccagaagaacgcctgagctcaaggaatcctcccgtctcggcctcccaaaaggcttctgaagagcttttccaatgcagaaatacatttaaccgtattctgctctagttctgtcttgtgttttgtttttaacatttaaatctttgatctctcttaagtttatttgggcagaaagagtaaagtaggaattcaactttattttgataaaattgacttcacagttattctaacagatgattatatagttattctgaaaccatttattgaaaaattcaccattctgatttgaacatgccacctttattatttgctgattttccatttgctgttctttctgagcctgtagtttcatatatgggaagagccaatagtcccttataaactttacagctttagttccttgagcaagctattcataaagttcttatatgttaggaaagcatcctaattttaattttgaattacagtagtcaacatgtctttttttctaaataagtaaatgcttaccagtggtgcaagctaatttattccaaagaaaagagtttatttctcctaggtaattaaaaaaatctgaacagatactttttttaaacttttccaaactggtgttttgactgaattgttccatgaaatactaattccactaaaaaaaagg

SEQ ID NO: 9922 - DNA, 1616 bp, Homo sapiens
cagatacagaactcttcccacttactttcttacccttgtgtgtgtctccccacagggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtat

SEQ ID NO: 9923 - DNA, 1054 bp, Homo sapiens
cattaaattccaatccagatacccatcccctcagaggaggaggacaggacagttatgcctgcagttataaactgagaagtgttgtgttccaagctctgcatggaattgggtaaattagctacaagcctgaaataaggaagtatgcatctgcgtttttttctttccagcacagaagataagaaaccactttcagggcaaggacaaataccttcttataccccagtatctagcacacaggcactcagttatttttggagaagaaaatctaccataataccactctctcaactaatacatttttcacctaacatgctttttctgaatattaaaaaaactgtgataagatacttggagtatatacttctggcctttattttcctgtgtgcccaaggctatttttccaaaaatgggaccatgatggcgtgttttttgtagaaacttttccagtattactgaataatctaatgatttttaaaatgaagtttcaaatattttaaaaataaatcatccatgtggcaaattaaaaaaactcaatagaaacataaacgaagtgtattcttccatgatgataacactattaaattacttgggaatccttccagagaaaaataaatgcacttacctcaatgtatatgtgctttatttccacaaatgggtcacattctatacactgttctgcatctagggtttttattgagatataattcacagaccagaacgtttacattttaaagtgtataattcagtggctcttagtatatttacaaggttgtatgacttatcgcaactgtctaattccaggatctttctgtcaccttgaaaagaaacctgttagcagtcagtcctcattcctccctcctgcatgccccagcagtgactgatgtactttctgtcttcatagatttggctctcctgggcacttcatatgcaaggaatcatacagtattgtggcactttgcgactagcttttttttcactaaacataatgtttccaaggttcactcatgctgtggcatgtatcagtacttcattctgttgtggccacatagtattc

SEQ ID NO: 9924 - DNA, 1065 bp, Homo sapiens
cagtaattcaggagcaggttgttcagtttccatgtagttgtgcggttttgagtgggtttcttaatcctgagttctaatttgattgcactgtgttctgagagacagtttgttgtgatttctgttcttttacatttgctgaggagtgttttacttccaattatgtggtcaattttagaataattaccatgcggtgctaagaagaatgtatattctgttgatttgggatggagagttctgtagatgtctgttaggtccacttggtccagagctgagttcaagtcctggatatccttgttaatttcctgtcttttgatctgtctaatattgacagtggggtgttaaagtctcccactattattgtgtggaaatctaagtctctttgtaggtctctaagaacttgctttatgcgtctaggtgctcctgtgttgggtgcatatatatttaggatagttagctcttcttgttgcattgatctccttaccattatgtaatgcccttctttatctcttttgatctttgttggtttaaagtcttttatcagagactaggattgcaacccctgctttttttgctttccatttgcttggcagatcttaattcattgtgagtagccttccacgcccattacttttcctggctatgcggttccccaccatggaagtgtaccatagtatactcatttccttattgttggatgtgtgtatcactaaatttttgctattttaaagaatgtttgtatgcccttgactatttcttattcctgtgatgaaaggcctacttggagctcccattacggaaatgactttagagtcaacttacgcaccacccaggaaagcctgccgttccttcatcatgggggaagacttgttcctacatatcttctttgagggatttttcagttgtgcattctttagaatgattaaaaatcattcagaacaatagcagtattattagaacagtcgttagggacaaacccaccgttattaatgaatcctgaaatgtttggaaaggagttgagtgttgatgctttctgagtgtatcttgcatttaagtacttggtttggg

SEQ ID NO: 9925 - DNA, 1059 bp, Homo sapiens
acttctagctctgcctccctctgaagcataaagcactccccatctgccctcttttgcccagggcagacattgctaattaaatacctatcctctctttttgagccttgtccactttgtgctccaggcaaacattatcaatcgaatgtagaaagcacttgttaactctggttcaccatccctgcagggtactcccttcgctcgggtgcccagaaaacacagatgatttgtggtattttccaggttccaagcaactcccccaggcacccttccatccaccccgacagccggcactggacctcactgacattcgctgtgctgcatggacacatctctgtggtccaggtgagctcctgccaggtgaacaccatgccccccagcttaccaggtgacctgggccccaagcacagccccagcctcagctgagtgggcaggtgccctgaatcagagatcccaaaggcactgcttgaggccagctcacctgatcgatagagcagcagcccacctgagttgcctcaaggaaaggggttagtgcaaggacaaatggaattttaggaaacaagacccaggtccaggcagcactagggtcctgtcatgccctcccggcatctctctctctctcgtgtcgggcacactgggggctgtcccagtcccactcagctttctcgcctacagccgcctttccgacccttcccttttctcctccctcgtgaattctactacagggccaactctatatcatggggtctgtgcaattctgtcccctccttagttcctgagagaggtttcggattggcatggctcacccgtcgagccaagccacaggttgcccacctcagctcaggtagctgtgctggcgtggggacagtggtggttctagaagcagaagctgtgggcagagcagctccccatgccagcaggggctccagccacgtgcacttactcccaggtcctcagatcgctggcatgcgcagggtttcatggcaccccttccagggagttagcgtgacaccctcgctccccactaggttgcaagacctctgagggcagggattgtgtctg

SEQ ID NO: 9926 - DNA, 1032 bp, Homo sapiens
tctctttctctgtaaggaatcgccaggggtggggcttaagctgacctccgggggagcctccctgagttctcaggcctaagggaatatgggctggaattaacagtaacaggccctgatttgaggccaactgtgtctgacttgaatcaatctatcagttcacctggtgattttcaaacctgagtggacattagaatcactgagggaacttctacaaactagagatgcccaggtccagccacagaccaatgaaatcagggtcacagggatggaaaccaggtgtcagtaactcactgccctcagccctcttggccctagggtttgtcaggagcacccaggcagctgaactccaacggtatggatgagtagtcaggagtagggaggagtgaggaaccaggggtggtggtggaaagggacaaggaggactttcctggtggggatctcaaactccaggggtgtcatttgtccctgcctggaagccaaacaccatcaccgtggctgtcatgggagaatttagcagctaatgagctcaaatcaagcctcagcagaagttgtattttaaaaagaaatgaatgtgtaaggtgaattcttcattctccaaatatctgctgagaacctagtatgtaacagaccctgtgcagggctctgggacacaacggaacagaacaccagattcccagaagcagcatgaaggttaattgagtaaatgaatgaactggttctgccatgcatttcatggcacttcaccggccaaattaaaacctgttcatttcttccaccttaaggttagccgtgcccgcctgttgaagggctctctctaaggaatggccaggggtgaggctgaagctgaccccgaaggagctgcttttcttagagcggaggtgcctgcaggtgccagggctccttcagcccatcctttctcagcattgtggcctcacacaatgatgagccgtttcctgtctggggctggtgagatattgaaaatacttaagtagaaacacatcacaggatatggggacctaaggatcccacaga

SEQ ID NO: 9927 - DNA, 1028 bp, Homo sapiens
cagtccaaagaaaaggctgataggaagtggggagatgcgatggttcaggaagaggctcgtgcatctggcctcctcgctgtcactcctgccacggctttcccaggcatggagtcgtggggctctggccagctctggtgtgggggctcatgctgtgtcaggtgacttcctttcagctcagcctcatgaacccctggagcatgaactccgaaccaccatccgggccttgctgtgagttttgcagctttcatgaaactctcctcttccctgggattgcaagcccctgggtggaggggatgggagtggggtggggctgactttggcagcttagatccctgagtgccctaaacactgtgactcccaggatgggactgggtgaggaaagtctcctccactggctgcagatttccagtgagcacaagaggaaaacaataccaggaatgatttggatctttttctatcgttcaagctcctgtttttttagtctgcggtgaatcactcctcatgtctctgtagatagcctcacattctgctttagttgtttcctgaggaacagttgtgtcctccactccattttaactttctttactgtaattccttatatctgtgtagtgctctgacttgaagaacatactcacctttttgcattgcacctggtcccagcaaataaaaaaaagttcaggagtcttacacaaatgcacgtcagataatgagagaaagtaaagaaccctccatgtactctcttatagctcagagagtgcgcggcttcccccagcatagctgacatcctgctgggcatggcatggacaccggtcaacagttggcccaggggaaggaggaggacagggtccctttaacagagccagccaccctagcatttcactggtgcctgagacagtgtcgggagctgtgtttctggctgtatttctctgtgtggtccccctttggagatgagccccgcctcttcccctggggctgtcactcagccagagcagaatcagtgtcagcgctgtctgagcaggctccttgcc

SEQ ID NO: 9928 - DNA, 1009 bp, Homo sapiens
atatcagcactgctgtgaacttcatctgtaccaaaatatttccatacagtctcaatgacttgtttgggataattttttgaataatatcaaagtgtgacatttgaataagagaagaggcacagtgttccaagagctagaaggtgaaggtaagccttgcttccatcctgcgatgtagcttcgtgtctgtgaatagcaagcaacttcagatgaataagctatcaacatactggaactcggtggtgcagcttccttgtggggatgactcttaggaatcatctggattttctgaagaaaacaaatcatttgggttctggccttcattgccctgcccagcgggagtccccgaagggctgtgctagaatttcagagcatggttggcacagcgttggtgaaggttacaggattgtctagacaaaagggcccaggggaggcacagaggctctgttagtgggtggaagggatgatgctgtgtgtatgtattgagccacaccctggatttcagtaggagccagaataattctgaggcttgggtgtgggcagctgtgctaaacagggaactcagggtggtttcaagccagtacagagctaggacctgggatctaagattggagcagacacacatggagaagcagatagcggaatcaggatcagctgtctgagtgggaaggtcttagagaacccttgctaggtgttcaccaggaagatgcccacacctgtacactggatgggggtgcatgttcctgggccaggagggaccacgctgggtgttctgcttgctgagacagtggtttgggtggaggttcccattcctggaatgcctagaactttgctgcttggcccagtatgttctgggctcccccatttaaggcaactatgaccactttcattgccaccacctcctcctagcttgaaacaacctcccctgctttgctctatctgtgccacaattaaggagcttcccattttcttcattatattgcgggtagttatatgtgtatcttaggaaaag

SEQ ID NO: 9929 - DNA, 1050 bp, Homo sapiens
tgataggtatgctagaagcccaatccccaccattatgtgtgtaatacccatgcaacaaacatgcacatgtatccccaaatctgaaatttttttaaaaagccgttattaattttttttttttttttttgagacaggattttgctctgttgcctgggctggaatgtggtgacaacatcttggtgcactgcaacctccgcctcccaggctcaagtgatcctcccacctcatcctctcaagtagctgggactacaggcacctgactaatttttgtatttttttgtggagatggagtcttgtcatgttacctaggctggtcttgaactcctatactgaagcgatcctcctgcttcagcctcccagactgctgggattataggtgtaagacaccatgcctggcccattcttaatttcgttgaccaagtgtttctcttactgttttcgcactctcattgccagtgcccccttattgagcagtctgtgggcagagcgcaatcaagggaaaaatacaagatgcgggagaggagacaaacccccaactcccttgcccaggaagattatagtctccagggtagaaagcctgtaaacactgtactaatgattgtgatggagatctgaacagagggcagtggaatcagagggcaagattgcctaagccaggctcatcaggcatatctagaatataaacagatggcacaggtgacatgtttaacttacacaagagaggtcatgtctttgttaaacatccaaaaacctatggcatgaagtaccaagggttcttgcatgtgtctctggttggaattgttctagttctgttggttttgtagtcagttgcctatgagcagagcagaatcaaacaggctttgtgcctctaccgccctgagtacctcaggcacagtagttttgaagcagacactgatggggctggagtgtttcgtccagatctttctgttctttcccatgtgcctcccgggcttccccagtgaggtcattagtgtgtccagggtaagaactgtatcacaagcttcccacatatcttctgtgctaccactg

SEQ ID NO: 9930 - DNA, 1088 bp, Homo sapiens
aaggaaagctatttagtgaactgtcccctccagtagagttggccaatgtgctttgtaacagagccagactgttttcctatctcccaggattttactctttagttaaaacgttggcaatcccaaagccttttcaaccgcaggattgtcaggtttaggtgtctcatgtggccgctctacctccagatatatgctctcaaaaggtgtggcctgatgaaactatgggaccgtttggacctcaagatcagaggttcaagcttcctgggatcataggttttgattgtcacctcaatgggactgcttcacagaagaaaagcctgctttataaaactttgcctgatgttctagcagaaactttatcaagtgaaagacacaagtttgtgatgacacaatatgtgaatgaatttcagggtaatgatgcacctgttgaacaagaaattaacagtgcagaaacttaactttgaaagtgccagagtggagtgtgcaatacaaacgtgtccagaattgtggcgaaaagattttgaatcactgtttccagaagtagctaatagcaaattaatcattctgactgtaacacagaaaactaagaataatatgactgtttagagtgaagaagtagaaactgaaagagaagtgctcttagaaaagttcatcaatgttgctaaggaaatttgctgtactctttgtgctgagggatattgggctgactttactgacccatcatctggtttggcatttttttggaccatatacaaacaacaatctttttgaaactgatgaatgctaccgacatttaggattctctgttgatgaccttcgatgcttaaagtgattcgtcatagtctctggggtacccgtgtagttgtaggaagcatcttcactaatgcaacaccagacagccatattatgaagaaattaagtggaaattagcggaaatgtccattcatttgctgtattatttgtatgtaatatttgggttgatctataaacactgtcagactaaagtttttaaaatatacttatttctatttatttcagcatttatgaatttacaacattggtaagtgatatgggattttaaaattgcaaat

SEQ ID NO: 9931 - DNA, 1081 bp, Homo sapiens
tttgagaaccttgttatttccctaggctgagaccagcagccagtcagctgtgcccgtcctaaggctgtctgtgttgtggtctgctgttcctcctcctcaacccctgcctccttccctacacagcccctgcatgcaactcttctccccagacaggcgcagaatcggggccttcctcaacaaataagccaggttccggaagtgctgcagtttccacccaggtgcaagcccagcacaggcctcctcttagccagcactcatccgaatccactcacttgcactcaggtggttgtcctcctcagtaaactgagaagcagtagggccttgtgattgacggtgtgggtatgaagctggactgcctgcattcaaatcttggctccacttcttcttggacaaattacttcatatctcggtgcctcagtttacttgtctgtaagatagggataatcctgtttccctcatatgatagttgtggacaagattaaatgaactacacctcgtaaaatgcttggaacaggacctggtgtgtgagtctcccgtatgttagtcatgatgatggtgatgatgattaccagtttgggggttatctttggccacccttcctttggcatggggagggagcccacccatatgcaagcattaaccctgagtcttacagtagggaaataagggctttggaaacaaacccgggtctaactgcaggtaagctgcttttttttgtttgtttgtttgttttgtttttttttgagacagggcctccctctgtcacctaggctggagtgtagtggtacgatcatggctcatgacaacctcaaactcctgggctcaagtgatctttccacctgatccttccaaacagctgggactacaggcacaagtcaccacacccagataattttttaaaattttttatagagataagatctcactatgttggccaggctagtctcaaacttgtggcctcaagcaatcctcctgcctcagcctcccagaatgctgtgcctggcctggctgcttttttaatgtggtgctaggcaagtacctcaacctatttgttttttaatctataaacttggaatgatag

SEQ ID NO: 9932 - DNA, 1068 bp, Homo sapiens
ctaaccttcaattttgtcatctgcaaaatgggacatagtaagagcacctagcttatatgggtggtatgagaattaaatgagactatagattgaaagatcttagcacatagtaaatgctcaataaatagtaaattcattcaacaattattgagcactgaccctgtacccaccactgttaaaagtgctgtggactaagtgatgaacaaggggaaaagccctcctctcatgaagtttataatccagtggaggaaatgagaaaaagtaaataagcaaggattttctcttggtaatgagtgttgtttaaaatattttttttaaagggcagggtaatgggatggtgtgacggggctaatttaaatgacagtcaaggaatgcttctctgaaggtttattagtaatagccagtaatatcaatactactaaggacctttaggccaaaaatagtgactgaggacttttctgaatgattcagttattcaccagctgagagaagtctcaacatctcacttagagctgagaaagaaaagggctgcatgtagagcagggacgaaacctcttctggttgtgggatttatttagtgatgagattgtaggatgaatttctactgagagaagcaactgaagcagcaagggttgattgagcttgtcaggtggtgtttaatcagtttccacacctgggtagtctgaaggatgagggctgcttcctatctctttaaccattttattaaagccaagagagttggtaaaactgaaacagagcaagctttggaaatgaaaaatttttttttctcgcacgcctgagaaaggcaaccctagccttaagtagtaagaggaacaaggtagagttgttccacttcctcctactgaaagctctacctgactcccccagctggaagagccacccctttgtgatgtttcctcagcacccaggacatattcttaaatcatttcctgcttgtgtgtgtctctcccataaaactgtgcacttcataggcattgctgtcttccctgtacctctcatggtgtctacaatatgtgctctataaatgatgggcaaatgatagatccc

SEQ ID NO: 9933 - DNA, 1069 bp, Homo sapiens
ttaaataatttgaaaagaattcttccttctctttgataaatagaatactgatcattttatgcatataatgagatgtcgtgggatctgtgttaaataatactccatttaatattacacttctagacctattctcatgacacgaatgggatgtcttccctcctctcccgcccctaccccagccatggtaaattattagtaatatgaataatgaaatgtttgtttaaactgaaaaaaatcttgactgagatctctatcatgatggaaagattatgttcctgtattgaggcagccaaagatatcttcaacttcactttgtcttcagaaatttgaccagtgactacagtttatacttcatggtgatttaatttagtatttctggaatattttcatatttatgtaagtttttttaataaagtagatctctatatttttagaatttttcagtgtttaaggtgaaatggatagtaagtatagattaccattctagatcagtttaaataaattcatcagtccacaaaagtgtagtaattcttcataattctagaatataacggcaggaagaaacatgttctcagtgttcagggacaagctaagcatttcatttgagtttattagcattctcattcctgaaccttcactcttaatttcctaaagggcttgattctaccttgccttgtttagaggaaaacggtgccagttttactaaagtgttattaccacaatatcatattcttactgcatgtaatggaatgtgcatgtttaaactagtgcactgagaaattgatttgatttcagttaatatttattgtgtgcttaaagcattcctcaggactgtgaaacacctgtttacaaaagttaaatatttaaattaagagaagtgtacatactgaggaaagtagagccccagattgcctcttccatatctggggctgaaggagaggccttatgggtactatcagtttcatatgaatgttattgttttggtgaggaaataaaaataggtcagaagaatcagtttttctgaaaagagtttggaaaaagtaaggtagaggaacagggcataagagag

SEQ ID NO: 9934 - DNA, 1106 bp, Homo sapiens
agatatttcactttaatatttggcatgtttctattctaaaaagctctgtcatttttatatttttatccagatatctctttctttgtaggtgtaaatatatttttctaaaacatttggctaatcttttaattacccaaagttcatcaaagtctaaattaatttccattttacaaagacatttacaacataccaagtcacttgaataaacagagtacccttggttttcctactttatagatgggttttacttaccagcagaccattttgtactttatttgagtctattcccaggactgcataaatttctccccacataagaagacccacaagtccacttatctgtggaggtgagtggaccatgtaccatcctagagcttcttccatgttacacaaggacacaagatttggatcactggtattcacaaagagcccttgttaatagtatgatcccaacccattctcactggttgcagaggaatgtccctttatgttatccttatgttgcagaactcggaaacaatagccacttcatgaaagcaaatgctcgcgtgcagctaacagtgcattggatttccactcacattatcagacatttgttttctagactttatcagtggaaccttaaagaaactttgatttcaccttagatttttatcggttccaagcctacaggtttattagcaacctgaacttcagcagcttggtatataggccatcatcctcatttacactatgaaatgtttgatatttgttcaatatccctgtgtctgtgccttactagcagaaactagagcatgcaggtactggcattttcttggtttgcatatatgcagtagctcattaatactctctggcagcaactgaaactggtaagttatcaaagatatccagcgagaagagaaaaaacctgatatgtgagccaagggacgtttgtttagttgttgttgagggtggagggaatttagagaagatttgaaattaatttccaaatcaaatttgagagcaccttgtggtaaatggtagtctatagcatctcccttagtccaacatcctgtaacaaagagatcttcacatgtagccattctgatattttgaactctttgtag

SEQ ID NO: 9935 - DNA, 1021 bp, Homo sapiens
tagaccaaataaacaacttcctgtgagcctgaagcagtccacaaaataccataacctctgatacaggactttttttaatgtaagagatatgatgttaatgcaaccaacgtttattgagcaaagcactgtggtaggtatagctataccaagagcccattctctgcttagttgcagagaaaaaccaggtagggactacttctatttttttaattttaccttaactatcacagtgtcctatatatgttgacactgaacaaatattttttctttgatatttctgcagcacaagtacatccagtaccttgccctttttttttccttgacctcatcactgctgttcatctttaccgccccctcactctaacatcccattcccatggtcatatccttctctgcccaacccctacccttttaccatacacttttttgggtatattcaactatatgaattagtgtgtctacaagtattctggtgtcttactgcagctggcctctgagtagcatgtgacagtcctctggggagtttccttttacattcccctaagtagctgttccagaacctcatcatttcacctcatcctttaccccacacctgtttcaaaggtgaccttgcctccaaaatcacaaagaaactgaaagctattaggtgtgaacttcttaatgtcttcctctttccacatgcagtataatgtaaaggttaaggaccaggatctagaatcagactgcctgggttcaaattctggctctgcctcttgctatcttggtggccttggacaagttacttaatctctcttagtacaatagggttgttataaggataaagtaaagtattccatataaaggctttagaaaaatgcctggcacaaaataagcactctataaagaaatgttagcaattcttattatcagtggtattattacatatttaatattacattgttaatattattacatacttacctgcatctttacctttcctcccattcctgtttttctaatgccagcttctctatctcgacaa

SEQ ID NO: 9936 - DNA, 1032 bp, Homo sapiens
cagaaaatccttgaacctacctatcacatagaagccccgcccacccacctccttgcttccagttgtcctgccttttggaaccaaaccgatgtgcatcttacatgtattgattgatgttttatgtctccccaaaatgtataaagtgtgtaaacaaacaaagccatagcccaacccccttgggcacatgttctcaggatctcctggggttatgtcacgggccatagtcactcgtatttggctcagaataaatcttttcaaatattttacagagtttgacacttttcaccagtaaacactaaaagacttctatttgattatttttcaggagaatcaagtagttagacttaaaaaaaagttatccctctagaaattttcatgggattgatttttcatggatatacctataatatatgtggctggagtaaaccatattaaggcagcattctgtaaggatggagagtttatccataacgaatttattcatcatagatgaaatctatactaattagacacaagcatgatcttcaaaaactccacaatacttatctcactaaccaggaataaatgcctttaacattggtatattttatttcagatgcatgtacacatgtcaatacattttttatagtgggagcataacctacagatttttgcaacctacaatttttacttagcaatgtgttgtgaatgtatgttaataagtgaatctataaacttgtttaacggctgtatatagttttcattttttggaggtaccatgacttttacaaactatctcctattgttggatatttagcttgtttctaatttttcactattataaacgttttgcatgtacacctatgctgacctgtctcactatttcttagggtaggttgctagaagggaaatcactgggtcaaatggcacacatactcattattttgacacatgctgccaattagccagtgtctgaaggggcaggagattctccaatgcagttgtctttttgagtcccccttaccgctatgtctcttacttgcagttgtgata

SEQ ID NO: 9937 - DNA, 1064 bp, Homo sapiens
ctaatttttaaattttttgtagaaaccagggggtgtggtgcgggggtgggtttgctatgttgcccaggctggtctcaaactcctgacctcaagccattccccaccacggcctcccaaagctctaggattacaggcatgagccatcacacctggccgccaaatatttttagatgcattattcaattattttattcagtaaccaatgctaataaaaataagacctattcagctcatattccaacatttgaaataacccagaagcagctgtccttcaaggatttccagcaccacagttgttgaggataatggcaactgggggcaccttcaagctcctagagtttgggttttgttccctttgggtatggatgtagaatttctgtttttaaagtaaagcagcagggggcaagataaatggaagagggattagagaaaagggactaggaaatgtaaaagcaagtgggtggagcccacaatgccatgatataaacctgaacagactgcttgaaaaggccatgtatgtgtgggcccctggaggagacattacatctcgcctccttcgttcccttgccatctgtgtctttttctgttctgcagagaataatggtaatgtctgacaaatatgcatttttttcttcaaaaaccctttatgctcattgtgttttttcaactgcagtgacatcaacaatctcatccctgtgcctccatcctctcgaggctgtagggaaatgccgtggcaaggtttcttgtccgtggttgtccagcagcataaaggaggggcagattccatggatgtgggttcagagtatagcccagaagatcagaatccctttcaaggccactaagaagtcaggattattatctttcatctttagacaagtgggaaaggagaaccagtgcaaagtacagctttacatggactggagggaaggtgcctttttggtaacgcattctcctggatatagtaaaagcagcatcaccaaactgtgattttcaaaggaatatgcttatttgagaggcagagactttgctcccacctccagagattctgagggaagatgtctgga

SEQ ID NO: 9938 - DNA, 1062 bp, Homo sapiens
gagcttcagagagttgcgtgatgagccctaggttctcagctagttcctgacacaccaagaacatgaatgcactttacctgagtttcacctcagaggttttacaggacactccgtctttgcccagtgtgactcacatctgcagattctatctctatctcatgttttccacatagttacaggtgcatgttacctgtatgttacaatggctgctaaaactccaataatgaggacagaaaaaagaaaccaaggattgctaaaaagctagaatatttagacactcctttcccattccatggtgctttctctctcttttttgagacagagtcttgctccatcacccaggctggagtgcagtggtgtgatctcggctcactgcaacctccatttccctggtttaagtgattgtcatgcctcagcttcccaagtagctgggactacaagcatgtgccaccacaccctgctaatgtttgtatttttttttttggtagaaacagggtttcaccgtgttggtcaggctggtcttgaactcctggcctcaagtgacctgcctgcgttggactcttctatctctgttactagcacttatgaaagaaaggaagtggggaaggaaaatgagcaagaaaagttagggaaaagagagagagattatttttaaatacttttctctgcttacctgtttcaataagcagaagagctaaccaaagaagtcagagaaagaaagtgcaggtaatcactgattattgacttatttgctgagtgaaatttttttgggggaaaaagattatacaacaactctgagatagttaacaggaaatggtaacaagcaaaaagcttcctcctgtttttctgctcctgtgcatgataccccctctcactcagggcaaaatcaagtcagcagatcaaagcatgatgttaaactttgtcttcatctctccccattgggagggccatttagttaggggtgacaacaggtctgcatggctttttaggataagtgagagtagctggactatagaagtcttcccaccttggttttctcatttgtaaaaataggatattaat

SEQ ID NO: 9939 - DNA, 1027 bp, Homo sapiens
acatacaaataaaggaaacttttgttgcctgttagctggagtgttatagtgactatttcagagtaaactttaaaatgtgacctcacggaggtactgctaagtgcttaaatttttacttatgactgagcaattgcattatagacatgttattggtactgtgagcagcatattccatctttctagtgtattatataggtgtgacaacacagaggccagactgccaaaattcccattctttcacttcattttgtaccaatcaaaataccttattcagctaatttttctcaaaaagctggaatctatcccaccatataaaaatcccttagcttttgataggttatcagtatgctagttgtactcatttcataaaagaacagtttgtaagctctccataaaaggacagtttgttttggtgacctgcaatataatatgttaaattgtttttacttatgaaacagtaaatggagaatttatatatggtgaattaaagttgtttggattttctaatgtgagtctttaaatctaattgtgtgtattttgtttctgttagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggtattaaagttcttttctagctgttagcacatgtataaaaggaagttcctacagaatagggactttgctgtgtccatctgtgtattgccagtacctagcatatgatgattggttaataaattcttgctgaattaatgccaaccctttaattattgaatataaatgtaagtagaaaccagaaatatactgttttatctactctggctttgcccagcagtaatttttttaaaaaatcagtattgtttcataagcttttggtaagctttatctgcagtaaacctgaggagcattttaaatacaggtgtcggccaggcacagtggctcac

SEQ ID NO: 9940 - DNA, 1020 bp, Homo sapiens
tgtttggtggtctctttacccagatgtgcatgacagtggtaattctatgtttagattttttaagaaatcgccatgctgttttccatagtggctgtactaatttccattactaccagcagtgcataaaaaaatctcccttttctctgcatcctcaccagcatttgttatgtttgtgtttttaatgacagccattttaactgaggtaagatgctatctcattgtggttttgatttgcacttccctgatgattaataacgttgaacattttttcatatacctattgtctatttgtatgtcttattgtgggaaacgtctattcatgtcttttgcccacgttttaatgtgattatttttcttcctgttgagttgcttgaatttcttgtattctagatatcagccctttgtttgatgaatagtttgcaaatattttcttccatcggataaattgactcttcactttgctgatggtttcgtttgctacaaactctttaattttcttgctgacaaatctgaatatctatcattaaaattgttacagtagcatgtatggcttaatgatatgtttaattgactaaatgggccaaattcaaaattgcagagctgtgagttatcgcttttatgtagcagctacaaatattagcccatgactccaggtgagcaagaaaagactttttctggttactgatactcatttttatatatgttgttgtattagtccattttcacactgctaataaagacatacctgagactggataattatataaaaaaaaagttttaatggactcacagttttaaatggctggggagtcctcacaatcatggtggaaggcaaaggaagagcaaaggcacatcttacatggtgacaggcaagacagcttgtgcaggggaactcccatttataaacccatcagatctcatgcgacttattcactatcaccagaacagtatgtggaaaatcacccttgtgattcaattatctccacctggccccatccatgacacatggaagttattata

SEQ ID NO: 9941 - DNA, 1038 bp, Homo sapiens
cattccccttctcttgtttggttcaaccattggtttctgactttgtttcctcctccctcagctaaagagagctccctgggtgagccagagttaccccctgactctgacactgtggggatggacagcagctacctgagtgtcaaggaggctggggtgaaggggccccaggaccgggccagctcagacctccccagcccattggagaaggccgactcagagagcaacaagggcaagaagcggcggaaccggaccaccttcaccagctaccagctggaggagctggagaaggtcttccagaagacccactacccagacgtgtatgcgcgggaacagctggccatgaggacagacctcactgaggcccgcgtgcaggtcagtgagggccacctgggagtgaggctggtaaagcagagcctgtccctgggctcttggctgcagttggggtctcctgactgcccaccaaccacaccatggctttcctttcctcagttcattgagaacctgaaagtgggggctcctagcctgcccctcatgcccctgtcccaactagagcgactctgcttttatcctctttaatattgggcttctgcactgtggtggggggttgcaaaggaaggagggcctccagcagaggggcaggaaggctgctgctggctgtttctgggctttacacagtgtaagagtcctggctctttcacacagagaagggttacttgtccctgctctagaaggcctatctcttagacaggaaacaggacaaacatgaagacaatgtccacagcatcccagtgggcagaaacagagaacagtttagctcttccttctgcctagatggctgcatccccctccatttttcaagtcccaactcatacctcctctgagaagtcttcctgaccactgtggctaaagcagtagcccccctattaccagccaacaaccaaaacacccaacccagtacaatacagtggaacccaacactcaacccaactcattgcaacccaacagaacacaacccaatagaactcaactcaacacaac

SEQ ID NO: 9942 - DNA, 1113 bp, Homo sapiens
gatcagcttcatgccagatacggctgcttcttttaagtgtcctgtaagctccatgaagtgagcggccacatctgtgttgttcctcgttgtaactgagcaccagatacatagggagcattccaggatgctgaataaaggaatgcttccccaaacgcttgagggtttgaagatgtcaaaatgtgcaaaccagagctgcctttcttaaatccagcccccaagttgttcaggtgaggacatagaggttcagagagggcaaggactcaccctttgtcacacagcaagtgggcagcacaacacgggctagatccctagtccagtgcccctgcctgggcccctgtagcctcacaggaatcaggaccccatggggcagctagccatgggtgtctaaggagtggtgcctgaggcccctgaagctctttgggcgtctgggaagaagaggtgtaggctcattatcccagtgccctaagcgtggtcagagactatctttgagctaaccactaagactggccttttccactcacattccaggagtcaggacgctgaaatccacacctcattactcacaccctgcagcccgcatggaggaactggctcagggcccttgatgggacagtatggcaccttcagtgggcaacacacattctcaaggtactcaacatacctcgacagctgacctctcacctgtaacatcaggctcatggtgtctcctgtctctgtctacagttacctcccccactggaatgccacttcttaaaggcatggggctgtgttgcttactgctgcaacttctgcttctagaacactgcctgtgcatagtaggtgctcagtaaatatctgcgaatccccaactgcacaccatgggatagtggcaaagactggaaagggtttggtttgggtggagccatactctgaacccttcccaacacggttcctatcctggcttcccccctcgccagctgtgtgatcccaggcaagctgctcaatacctctgggccactgttcttcacgtgtagattggcaatgtgctggagtattttccaatcttcacacggaacatccatattcaggagaagaaaatgaggctcaggaagtgtgaggttcttgcctgaggcc

SEQ ID NO: 9943 - DNA, 1064 bp, Homo sapiens
cttttttattataacataatacatgtccagtgacaaaaaccatgagcaaaacactaaaataaatcaaccacagttttactacccagaggtgagggttatgagcaagttcagagcttggtttatgcctttttggtatgtatttgatggggtgaacactgtgggttgcctattcagtggcagtctgtcttcacttctgctcacttcttcttggctggcaaagctcttgttttgtagaagtgttcaagctccttgttgtcatgggctcagggaaaatgaccccctgcacagcgcagctccagggaatccaatcatgattggtttaagataatgacagtgatcccatttcccttttctgtgaatagtttagacattggacatgtgatacagttctggccagtgagatgcacaagaatgactttgagggaatgttttccttgctcttagaggtccacagaagatgatggtcctctttctgttgctcagcttggctctataaggtggagattcagggaactgctgcagccatccagcaagcaaggaagaactaggctgaaaacaaaaaccaacaccaaagaaaaaatctagatcccggataacatttttgagcaacttcattagccaaccctgaaattgccctatctttggactcctgttatttgagataataatctgcccttattttagaaaggtatttcattatttgcagctaaaagcattctaactgttgcaaataggatcatattgcttgtattattttgagcatgctctttcatttcataatataccatgaacattttcaaaagtcaataacttactcctgtaataggattttgaatggctgcactgtattcaacatgttgtgagacatttaggtgttgccagtttttgccattatacataatggtgtgacaacaccctgcacaaatctttgcatatttgtttggtttcaggggtaattttctagaaacaaaatattgggtaatggttgtatatattatcaaggcttttccttaaatttccctccaaaactttgcattgatttgtaatctgccattgttaccagc

SEQ ID NO: 9944 - DNA, 1034 bp, Homo sapiens
tggtgtggggagggagcatttgatattcataatctggttcagagaaggtcccgaagccctgagtcactgtatggtttccatggaaacagacttgttcagaggactcggtgtagcggctgtggtgggggagaagggaaacatatagtaaaaccaggctccacaagtgtggcgggacttggaccaactcccttcggtggggactgtgaggggtgggcaaggctctggcctccctgtcagaggggctgtctctccccacccactggggtcctgccattggatgccgctcagctgctgctgtgactcttggcaggctgctgcttctcccacggaccttctggctaggtgcccgggctcatggctacctctccctgcctcagttttcccctctgtaaatggagaaaataacaccgacctgatagcattgttgtgaaggtcaaatgcagtaatatatgagacacacttagaatggtgccatagtaagtgttccaaagcatcattcctaggaattaagtcaggacattggaagaaactccccaagcatgctcacctagatccttaccctaggtcccagcaggtggtcctgacatcttgctgggctggcctcctgctttgaaacagcctctccccagcggccccggcacaccccccgctgggaagcagccagccatttttttctacggagcatttgtttcaggttcctgagggcctggcacagtgctaggcagccctgggttttgttcagaccctacctgtctaggagccttgtgggagtaaatccagatggacaggcagctccctgcctcagccttcccgctaaaggcaggggtcagccctggagcccctaggggttgaggcagatggagaggagcagaagaggtccaggcagagatggtggccctctgtgacagagtaaaggggttggggtggggcaggccactgtccctgatcctagagaggctggttcatctggctggagaagcatctgtcttcctcttgatcagccagagagggacagggagctcttcagaaaggta

SEQ ID NO: 9945 - DNA, 1022 bp, Homo sapiens
acttcttatacctcactggccaatcctgcttaaactaataactgacaaggaggctgggatgatcagaattcattctcatgaatcgagatttagtgccacctctcccttctccaagtcttctcagaacagaaaggaataaaactgtggctatgtcagcgaggatgaaagatcagagattggtccacagggacttctactcactcccctcactgaaatcctatggccaatgtgtgcaaggctccccctacccctgttagtctaactacgtctaaagcatatcttccgtgtgcgaagggacacatccaaagctgccctacttgaagcaggagtgaaggccaggagcccacttggctcccccagcttcctggaggcactggatcttttccagcatctttattttatttatgttgagatggaatctcactctgtcacccaggctggagtgcaatggctcaatcttggctcactgcaatctcaacacgggaaacctcacccagcctggacacggacaggattgacagattgatagctctttctcaattctgtgggtggtggtgcatggccattctttgtctggttaattccgataacaaatgagactttgaaatgctaactagtagagacggggtttcaccatgctggccagggtagtctcaaacttctgacctcaagtgatccacccgcctcagcctcccaacgtgctgggattacaggcatgagccaccacgcccagcccctccctctattttatagacatggaaacagaggcatgggggaagttaagtgattttggatacactgctaaaaaccagtgtatctcaaatgcagtggaaacatggccttgcctcacaggattaggactaaatgaagtgaaggatgtaaagaggctagctcaggcccagcacatattaggcactcaagaagggcaggtcctccctccttctggcataggggaatgaaagatgaggtgaggcagggacccaaggtactgtgacctggggaggcagcagggctggactcac

SEQ ID NO: 9946 - DNA, 1034 bp, Homo sapiens
aaagcgttatcatatgttgtctccttatcgacttgcaccttcttgactaaccctggaacagcaattaaacactatagaatgctttttatgccatgtaaggcagctttcttctgagtttccaggccttccatgtccttgagaaacatgttaaatataacctcatggaactcagccagccttcagagtctgaatttgatctactgtgaatgagttctcagaaaacagatggggtggggagatcagctcatacagttgagaggtgtgcaggtttctatcatcagtgttttgggagtggggaaaatgaacaagacatacagtcccccagcagcccttgtttgctgcttcaaatacaattccaaaagtggaaagttttctttagagcaactgttgatcagaaactgttgagcagaaactctgctctttagagcagagttgatcagaaacaggttccggaaaaactgtcaaatacttagtagcccttcacccacaaactgcaggaatgtgaactagtgctctaaatgtttaaatgaacctcaacaaagctcagaattcactcagcagatactcactgagcgctactctgctgagcaagtgctattcttgaggctggggatacagcagggaacaaaaccaactccctgtcctcaaggagctcatctaaagaggcagataataagaaagtgaatatataatgtcaggtaatgataagtgctatgaagaaaaatggggccgggcatggtggcttatgcctgtaatcccaacactttgggaggccgaggcaggcagatcatctgaagtcaggagttcaagaccagcctggccaacatggcgaaacctggtctctacaaaaacacaaaaattagccgggcatggcgtgctcctgtaatcccagttactctggaggctgaggcaggagaatccctggaacccaggaggcggaggttgcagtgagcagagattgtgccactgcactccagcctgggtgacaagagtgagactccatctctaaaaagagatcaaaaatggaatggatt

SEQ ID NO: 9947 - DNA, 1049 bp, Homo sapiens
tagcagtgaatgtcctctggttttgtttatctgggaatgtcttaatttctccatttttgaagaatagttttgcaggatatagaattcttggttgataggggtttttttgctcagcactttaaatatattaacccatttccttctggtctgcaacttagttctggctgatagtccttcacaagtttacagtcaaactagttggctagagctgcagtaattttaaggctgtgctacagcttaataatccacatctgagctcatcacatggttgttggcagacctcacttcttcactggctgttggctggaggttccgttcctcacacctgggcctctccatagtgctgctcacaacgtggcagctggcttcccccagagcaagagatccacgaaggaaagacaccctccaccaccaccaatgttttgattgttttatttgtatttttgtttttggatccttttggtattatttatataacactgagataattgtactttttcttgcatgagagagagaaatttgaaccatgggtaattttttagtggaaaggaattgatttgcccttccttaaaagcactgctgctaattgctttactcagccttagaaatggaagtaagagactccaagagacttcacacagccttggaatggaacagcacacccttatagttgaccttcttttctccctcctccatcatacttctctccttcctattcaaagagacatgaaaataagatttctgggcatccaggactttaaaatgtcactgtaaactactttcccactggtgttttgttttatggaggaaatgtgtcctttttgattaaaaagtgtgtgtgtgtgtgtgtgtgtgtgttggagagagaaagacttgagtgattctcgcttagatcatactcttcacccagaagcccaatcaactctttactatacacccgctctgcatgaagtaccataataggcacaaagggatgcaaaaacaagaggtgcataaaacaattcccactcttacatagcgtttagtataaagggggaaatacgagagaa

SEQ ID NO: 9948 - DNA, 1045 bp, Homo sapiens
ggggaacctattcaaaccccaggaagtgctttgagaaacattcagaaataaattattattattattattattattattattattattttgagatggagtttcactcttgttgcccaggctggagtgcaatggcacgatctcagctcactgcaacctccgcctcccaggttcaagtgattctccttgcctcagcctcctgagtagctgggattacaggcgtcagccaccatgcctggctaattttgtatttttagtagagacggggtttctccatgttggtcagctgatctcaaactcccaacctcaagtgacctgcctgcctcagcctcccaaagtggtgggattacaggcatgagccaccacgcccagcccagaaataaattatttacacatattttaacacagaaaatttcaaacttattgacagcagaactttggtattaaactactgagagtcagatgctcaagcttaggagtttgggtggggacctgttgttttgcactggctctcaaagaacctctgaggagcctcagtgttccacagaacctcgtttcacaacactattttaggttattaaatattatttctctttacctctttttttgataaagatatttttaggagacaaattgttttggtttcattttatttttacatttcttttctgattacaaagatagtacaagttcatttttaaaacagattcaaacattacaaaaatataaattgtagaaggtgcttttccccgtaatctaaagagagagtaaacttttatcataattttacccccaggagttaattactattaacagtttagattatattcttacagatttttttttcttttcttttttttttttttttttgacacagagttttactcttgtcacccaagctggagtgcaatggtgggatctcagctcactgcaacctccacctcccggattcaaacaattctcctgcctcagcctcccaagtagctgagattacaggtgcccgccatctcacccggctaatttttgtatttttagtagagacggagtt

SEQ ID NO: 9949 - DNA, 1049 bp, Homo sapiens
tctttagtcccatatcgcagctaatggtcattttcagcagtgaattcagaagtgctatgagtactatcatatcttgatgagagagatcctgcaactctcagtagagtatgaagaagtagtgcttagcttctgttacagctagaggtgagagaatatattttctaaataacactgtattccttggcatatagtgtagaagtgaataatttgtttgcatagcatagtgagggaaatagtgtagcagtttcttcgtgctaaatatgttggtttcttctctatagtttgctgccttcactaacaatttgactggtactattgtgttgtcttattttgcttacacctatcaagcagttaaaagggctaatgtactgtcctcagctctctagtcaatcgaaaaattagaatctcccctagatcattatttttacttatcaatgttgtttaaaaagactagagatgttgctggttgtttagtaaatgtcatgttgcagccttgcagaatattgcgactttctcttagcacagaggataagacaagccttcctgttcaccactgctatgcctcatcctcaagagaaaagttacgatgtttctatatactggaggcagtaggtgcttgaacaaaatgaaacatgatgaatttctcacccactgggatacataaattctcatgtaggtatcagtcccttatcatctctgtgctttgtcatcactaaataagtaacataatatttggtcctttcaaatctgtgtttttagatgtatttctgcatgttattgacattgttcttcctcttctaacccactaatccattaaatattcagctcctcctaaattatacattttttgtcctctatagatatatttttaaatttcccttctcaaaataagcttgcattttgaagtacatttgttagaaacaaggtagaataattctactttctagtctcaaggaacagtcttctaaatgtaaagaatagaacctggtggaagtatatactatgtgctatttcactgggtacatattagtttatctgtttagagacct

SEQ ID NO: 9950 - DNA, 1028 bp, Homo sapiens
aaggccttgccagtacttttcaaattaaaattcatgtgctctgtagtgtgctgagccatactcatacttccatctttacttctcttctacataatatatcattcttatttttaatcttctataagtactagtcatcatcctagtgagaattgtagcgttttctcactctgcccttcgtgaaaatgtcatcatcattatgggcagcagggcagctttatggtgttttaaaaatcaagttcatcagcatttttaagctatcaatttcttgttttagtgtcattagtactatgaatattgaatattttatgactctttagttttataaaatatttttttcttttagcagtgggggagaggataggtattatcctcattttgtaacagtattaacaccgaagagagtctgagtgatgactagacacatagatggtgtgaaaagaaaacttggcatttttttttttttttgaatgttagcctttaacccaagctctttcctccatacactatatgcacaaagtttttaggactttttttagtggcactctcatatacagattttcttttcaaagcaagaaataatctgagctttaaaaagattctattgaggaaattattctactcctgtttttatagtctcagaatgtctcaagataattttaaatgggtttgtgctatttgggggagaagagaaagtcacagaaacttacctgattttgcaaatccaaaacagttagaaatcatagtattcaatctttagaaaaatttctgtagcagatatttatccaattaattcattttatttgaattcatttaatttgagctgtgttttaagtaaaaaggtatcaatgatctacttaatgttaaatacattgggtgtttttttgttttgctttgttctagagactttttttttcattacaaatttcggccttggggaagaagggtcttttgaataaagataaaactagttctgtggaggggtttgagggggtgcctctaaattccctgaaatgtgtgcaaaattgttt

SEQ ID NO: 9951 - DNA, 1033 bp, Homo sapiens
gtgtacatgcttaccaatgaaagttagcttctggattagttctcaagtgaaaaaaattaagatgattcatttgacatgatacttaattttgatgtgactttatttggaactcagatcccaagctaatcaaaaagtaccattaaaagcgacattcttttcccctatcttctagaaagaattaaaaagcagtttcttcttttcctctttagagaagataaagcgaaaaaccaataactgagaaattaacagccacaaaagtttgcaaatggagtctgtgagtttcaaaggctccaaattaaaaaaaaaaaaaaattagattaggcttccagaatgagaaaggcttattttcttccccctttctttttcttgccttattttgaccaaatgagtttgtctttaaacacagttttagcttcttacatgatgtgtgtgttcttgctgcttacggtatgatacattgattttgtcataaaaagtcttgcattggattgcattactctgagatgttattttagaaattggtgatgtgcatctgtgagagcgtgtcatggtatgcagtaagcagtgccattaagtgagttatcaccatctgctcctacctacagttattcttggtacagcatcatcattttttctacaactatcaattgctatctctgttttcttgaatttaaaaaaaaaaatgtgttgtccatatcaggattttgttcatgtttaccaaattatcttttgccaagtcatgtgacatatgtacctgtatggaatctcttccatatgaaattgagtcaaataggttagtgggatttaaaaggcatttaaatggacacataaattatgcacagacggctatttcaggatagctgttttctctgaattgatgagagatgaagtctttagacaaatttctttcagttttaaggagattcttttctttttcccctatagatttttcccaactggccaaatacaccagaggctaagtgttaatactatactgtacattctcctgaaaatggtgctgagcttgagccca

SEQ ID NO: 9952 - DNA, 1044 bp, Homo sapiens
tagcactggaacacagcttttactacgtgatcgcttgtcgtacatgaatttcctgtaaaagttcactcactggtgtaggctctagctccttatggctctgcattatttgcattttaggacatttatttatttgtgagcaaatattgatagatgctactgttttaaaatcagcaatttctctggtcagtctcctccacttcccccaaaaagtagaaattgctactggaaacacacacacacacacacacacacacacacacacacacacgcacacacacgcacacacacacactatgtggtttagaagaaatgatcgtcaccttcttaaagttacaaattaaaaaaaaactgaagtaaatatagttgaatgggaacataaaatatttgaatgcaaatgtgagatttagtgaaaattggttttattatgtttatgatgcagttgtttaaaagatacaaatatgtgttttaggattaaagaatctttttgaattttgtgttcaaggtgatataaaagttaaattttagtaacattcagagaacagactaatgaaaagtagcttatttatacacttgagactgaaaaagaatactttccttgttgtctctttttggatctttttaaaatgctggtattgaaatctgatattagcccccattggttcaaagaataatctcttgatcataatattagaagacaaatgatgaaaacctgggcaaatcatttggtaagaataaaagatcgtgcaggatcgtcttgttatgaaagaagcattcttgattggagcaagagaacttatggagagaaaaaataattttatattgtcttgacacccttttaaagaaatcagaatagaaactaaaaatgtaccttggtcttattctctggataagctcttttcagaggctgggattctaaacctgcagtagcttttaatgtattagcaagatattctccagatagagtcagcagtttgctctattgtttagcgttgattctttgtccaaagaccgtaatgaataacaacctactgtattagttgtata

SEQ ID NO: 9953 - DNA, 1035 bp, Homo sapiens
tatagaaggtagtatgttaaccagaaaggattaatttgaggaaaaccttgtattgataaaggtgatgatgtgggtaaacagaagtaacctgtgtcttcagatgcatggtgtttctgaacaaattccacaattgcataaatctgttttatttttctatttggacatgataactttcgaaagaagtccttggatagaataggatcattgataggttgtcagtcttattcccacatcatttatttctgcttaattattatttaaagtgtactttacattgattgaatttcttacctctaaaggacccaaatggcatttaaacatgaatgccatctttttatcctcacaaaattaaaatttcaggtatcttttatggaaaggaggggtaggacagtaggatgagaaaggaaggagagttagagtaataataggaattctagatggagagagatctggagatcctgattaccacatgtattagttcattcaggctgctataacaaaatacctcagactggatcatttataaataacagaaattcattgcttacaactctggaggctgggatgtccacgttcaaggcatcagcagattttgtgaggacctactgtctgcttcatagatagcaccttcttgctgtgaggacatagcaagaaggtgctatctatggcagaaggggaaaaacaagctttcataggcctcttttataaggacactaatctcatttgtgaaggagggccctcgtgacctaatggcctcttaaagacctcacctcataatacagttgcactggggattagatttcaacatacgtattttgagtggacacaaacattcagatctagcaccatgtcctagtcataagacatagatgagattgagagagttcaggttgcttgtttaggagacatgctatacatttcaccaatctctttcttcggttttctaggatttataaaaaccattcagtgattttagtccagtcttataacgtgtccctggcctgtcctgtacctcagcgtagaccagctcaagtg

SEQ ID NO: 9954 - DNA, 2009 bp, Homo sapiens
ataatgcttcctaactaaaagtcatttacctttttgtctcggtttctttatccagaagaacaagccaggaatatttcctatctcttgggcatataataaggactaactaataaaaaaaaattataaaataccttaccagcctataaaaatgcttcatgataaaccatcaaggagtattgtttttccctttctttcatgttttcaactccagcagtgtataatagtaaccacttatgtcacttttcactaaggagttcaaagcactttacagacattatcaaattaatcctccctacacccctatgagttacatagggaactggtatcaaaagagctagagcaaagtaacctgcctgaagcctttatctcagactgggtccatactctaccaattgctcattaatttgtccctagtgatatttatttggtcaactacatttattttctaaaagtttgttacttgttaaacatgagaagaatgtttgaatagacttcctgaatcactttaaattagcttaaactttatcagaggtaaagctgtttattttgacctgcccatgtcatcctcaatctagactagcaaacaaacagctcagacttctgaatatacacttttgactcaaactttcatcatggggagcagtgccaactggtgtcttactgtgtggatgggagaaatccttgatcagtgtttggaaactactctcgtttgtccagacactcttcacagagtgaaggcaggcttccttctatgttgttgggttttatagtgtgtttacatgtagaaagctcatttgccatctgcattaccacctagatcttcaccgctgccatcatcatttaatattatttttgtcttgtggcataccattaccaacccttttgacagagaagatatatgagggaaatatatgcacaaaatgattagaaaggcctctgtgagattgccttagaatggcttctaataaccattaaaaaagcagagtgaagcctgacccaaacagtggaaaacattaaatcctggcttttctcttgccctgtatgacgagctctggtttcttgttgaggctgtcatggcaaggttttttggtttgggtttggtttgttttagtttttggtttctcttttgccatattgatctctcattttgcttgatggggaaatactttttttgcctccagaagtgggtttcccttgcatattagccttgttggtgtgctgccccataggaggatggccccagtgctattggcactgtcctgtgtacagttaattaaacctcctgctgtggacctggatttctgctgctgctattcactgatgtgtgtgaattgagtgaagcacatgtgcataagctcagggacactcttgaaaacaaaccctgaaaatagcaaaagatggagtcagggcagagccttcagctttcaaataagtttggtaatctggctagctgaatgccagagctcacaaagctgagaattgcatttctgaagataagacagactctttttgtgtttttatcttttcttcccaaaatgtattgagttttaatacggtactttatctctgtaagcaagaaaacagagccagttgtgaactcttgggctattgagtccaacccagtgaggagtttatcctcatttttctggtgaccacatctcaaggtaaaccatgagcagagtcttactaagacacctgcctgctgtggtctcataaaggggtcttggagcagaaaggggttaagaaactcacagaaggcaagagtagggcttccaaaaagtctagtaacctacgtgttttagagaacagatagtgatttcctttgaagttaggccccttctctttttcatttaactaaatattcagagagagaaacttgatttctaaccattctttttttgaatacattgtagtgctttgagtccttgtgattctgtttactaggacataaaatgctaattttagaagctctaaataaattttttccaattcctagcttgcttacttgg

SEQ ID NO: 9955 - DNA, 1031 bp, Homo sapiens
ctctcgaggccccagaaggagtctggacactggaaatgaaggcctagtaaactcttttgtgcccaagatggtatgagaatggaggtgggaggtaatggtaaatgctctggttttcattccggctgtcacaagaataaaaatgacctaactgtattttgggcccccaggcagcactgaaatgacatgccacctgctgacctaatccatttcatttctggtactaggatagccaaagcaatttgctcaatttgcaattgactatttactctttaaagcagcaatgattagatctagtataagaaaccacatactttatttatcaagaattaaaacttgaaaggtggaaagttatcctttttggaagaagccatttaaatgtggtgtattttacctcagagagactaactatgcttttagaaagctactttttgctgctgtttcccaggaaggagtacaatctgctgatgaaatttaagataacagaagtgtttctcagcagcagctgaatggcacagagaactcggagactgctatatttatctttaggtaaatttttgcaatttactagaaaaaaatctgtgtagcatacaagcagattaactcatgttaatccagcagctgcctctctggcaaatagtagagaggggtgtatgccatagctgtagtcctgcacacatactcagttgctggacatacttcctttgtctcgaacaatgccaagagccacataggctgatgtgttcctgtttcctcaattttaatttttaaaaatcttattaattcccattctttctcttctccatcaaattgaagtaattaaaaattgtaaattatagtttcaggatcttggactatgctcttgaacattgtgcttaatagttttatgtatagtactgcaattgatgaattaaaattatagaagtacctacttcattcccctcccagagatgcttatatcagtaagtaacatgctggcagaattaaggtgtctgcttccagttcagccctcttttatttcttgttgctttctg

SEQ ID NO: 9956 - DNA, 1022 bp, Homo sapiens
aaaaccggaggcattaaattacataaagggtattttgttactttaagataggaaacagagaagcaataactttatttaaaaaaaacaggttacatggaaaacttgtcattgagaaagtattgcttgagctataaagaagcaaaaatattttaaatttcaagactttcaataaaaggtacattaaggaacctcctggtggcagcagttctttgtcaccagtgtcctcatttgagacacctgccaaatgggaactgattctgaattagcaaaacaaaactattcaatttgccatatccttttaactccaagtaaaataatatgttgagcgtttaaaaattctgattttaggcttagatcgtattatattttcaatgaatcccctgctatgtaacttataaatgccttaaaggtaaatcagggagtctggatgtaaattgttggggcgtttatataaagagattccatgactcctgctgcctctgtgcctgacattcctttgatgatgtaatgtatagacttggtaattttgttggatctcagttcagatgacctactagtaaagggatgaattgactgctctagggaattggaaaggtcaatggaaagaaacctgtggctagcatttgtgtaacagtaaaagctctgtggagagcaaagtctcaactgactcactggtttaattgtcactcctcattctgaatgccagttctggtgggttactgtgtactctacacttttcccatcagttgtagaacagttatcaagagtgagttgtgtttgtttccaaacttgtttctgccatttgttcttgttactgtaatttaattaactattattaaaccaatgagttttaaaaaaccaagttgttttcatgaaatccataatttaatgctttggaaatgataaaaaaaattactaaaaatttgctgctttgttatatttgggtaagagatctataacagaatgggataaattattaatgtccagaaggattctacattcagattgcttcaaagtatctt

SEQ ID NO: 9957 - DNA, 2029 bp, Homo sapiens
atgaaggcattggttccgaaaacagggaattcagtatcaaagaaaatcccatttgatgaagggaaaaacttagataattgatgtacaacaggtttagaaaacagccagtttaggttggacaggaggatggaggacttaggagaaacaaagctaagaaagtggaccaatatatcatacaatgtgttttgagccattattgagagacattgtatagtttctttggaaagtatgggaaagaattaattgtaggaatatagaaaaccaagcaaatgacaaagcaagtcaattttaagttccaggaatagcaaaatgttgtacaagaagtatagttgtctcaccaattaattaatgttatttatataataatacaagccttaaatatgggtttaatcattaaaatggcaataacgtccaaagcaatttacagattcaatgctattcctattaaacgaccattgaggttcttcacagaactagagaaaactattttaagattcatatgggatcaaaacagagcctgaatagccaaggcaattctaagcaaaaagaacaaagctggtggaggcatcatgctaaccgacttcaaactatactacagggtcacagtgaccaaaacagcatggtactggtacaaaaacagcatagactaatagaacagaatacagaacccagaaataagaccacacacctacagctacctgatctttgacaaacctgacgaaaacaagcaatggggaagggattccctattcaataagtggtgctgagataactggctagccatatgcagaaaattaaaactgtagcccttccttacaccatatacaaaaatgaactctagttggattagacttaaatgtaaaacccaaaactataaaaaccctggtagataacctcagcaataccattcaggacataagcatgggcacagatttcacgatgaaggtgcaaaagcaattgagcaaaaattgacaaatgggatccaaataaactaaagagcttctgcacagcaaatgaaactatcaacagagtaaacagacagcctacagaatgggagaaaatgtttgcaaactgtgcatctgacaaaggtctaatatccagcatctatatggaacttaaacaaatttacaagaaaaaaacagtcccattacaaagtgggcaaaggacacgaacagacacttttcaaaagaagacacacatgtggccaacaatcatatgcaaaaaagctcaacatcactgatctttagagaaatgcacatcagaaccacaatgagtggttagaatttacttagaaatagtctcttttaatatcaatgaattcttaagtaaaaaatattattttatataatataacataattttatatgagtatgtgctaagattacaacttgtttcttgcctttttttctttcttagagctgtaggaggagactagaatattggcattaggagttgaagtccatcatttctttaaacatttgtttttcaaaagtttataaaagtaattcatggttggggtgtagtggcttatgcctgtaatctcagcattttggtaggctgagatgggaggattgcttgaggccaggagtttgagaccagccaggccaacgtagcaagaccccatccatgttttgaaaaagtcatgcatgtttatttggcaaattcagcaaagagagaaatcaaatttagctgtgatcctacttccatgttttagatcctttaagtctttttttctgttccataaatttatattaaaaaataaaatgggctgggtgcagtggctcacgcctgtaatcccagcgctttggaggccgaggtgggtggatcacctgaggtcaggagtttgagaccaggctggccaacatcggcgaaaccccatctgtactaaaaatcccccaaaaataaataaataaaatcagctgggcgtggtggtgggtgcctgtaatcccagctacttgggaggctgaggcaggagaattgcttgaatctgggaggcagaagttgcagtgagccgagattgagccactgc

SEQ ID NO: 9958 - DNA, 1077 bp, Homo sapiens
gtttgctgagttaaggcagagcaatcctcttgtaagtttatcctaataacgtatttttggtgctggcaaatggaatgacttttaaaattcaaattgaatttcttagcccttgtcatcaggtgttatatatgttgacactgggctactagaatctactgactggaatctactgtattttttttttccactttgctcatctattgcttagctgagagcagttgcttcaagctatgaatatcaaatcaaaggccaagtttgtggaatgtttttcaagcctgtggtatctgtcttttttcttttgcatagaacatatctgtatttcagaatgtttagggactcttccactctttggagaacgttaatttttgagtgataggcagtgtgaataacgaatgctttttaggagccaatataactgacaccacctctctactatatcatgtgctttcaaataatgtgcatatattatatatatgtatgctttcaaaaaatccattcccatttattcccttttctctaggatctgtgcttttcagacttctttatcattcagagtctgattcatctgttttattccacatatatttattgagagtttactctggtgaaaggcatgatactaggcccatggaggatgcagagaatgaaaatcttggcagtgttacttccatgtgactggttatgacctacaaggcattcaagctcattagcactgatacctttagcaactcattctcatacataccccataaattctctgctgtcacctttactccctgggctctctcaagactgtgccttcttcacacatcctcttctctacacctggaattttcttacctttttacctgattaattcctatgtatcctttgaagactcagcttaagcaaggtcttctataagcttttcttgacttctttctaccttccaagcagagttagacactcctcttctgtgtactcatggtacttggtacttgtgcctactttatttggcgctcattgtggtacttatttgcactcatcaagttgtattgtaattatttgtaagatcctcacaggcaaggactgtgtctt

SEQ ID NO: 9959 - DNA, 1023 bp, Homo sapiens
tctattacagtagcatatctgtatctgtaggattactattttttaaatatctgtcttccttattagattgttagtttcaggaagtcagggaacgtgtttgttttatttgcttttttattcctagtataatatttagtataatatttaacatagaatattaacacagaagaggcacttatattctttaaatgaattattttatccacccgatcttttgctctgcttatattgtaatttttttatagaacggtgtgtcttgctttttatgctttttaaactaacttatgaaaatcttcttagatttttgagtgttctttgagaacatgatttttaacagctttaaatattagcataattggctatatcatgattttttaaaactattcttctcttgatgatagggtgtttccagtttttttttttggctattatcaatattgctttgatagatatacccttttatatgaatgcgtgtttctctctgatggtcttaggagaaattcctagatgtgtgatgactggatgtgttggtcacctattaccctaacaattctgcatcagaaactagtgttttattgagtggctttcaacactgccagtacttatacctaactggtcaaagatttgattatctctttaagaaaaataagcttgatgaagtaacttacactttaataatgtgccatattattatagggcattttacctaagtgtttattttcacactaggtctgtaggtcatctggggttctcctaatctaggctgtacttggccaggcacctctgcttcagtttgtgggctggctgaacttgcctttcaggctgcaggtttggttaggtctactctaaatgtgtttattctgaggccttgcatgaagggacagcagctacctggggcgtattcattttgtagtttacctaagagcacaagaagcaggccaaactactaaaataattttaagactctgctggcatcaggtttgttaacatctcattagccaaaagaagccacatggccaagcc

SEQ ID NO: 9960 - DNA, 1032 bp, Homo sapiens
tctgaaggactttattcatgtgatttaacttgcatgttttaaataacaacatgtctaactcaactaccatatgtactaaagtttttacagatcatatgactcagctttatgcgttgattccaatcttaaagaaaatgtgattatcttcacagatgtttaaatttcagatttcacaattcttatattttacaaaaagctatctttatataattacataattaaaatttgttatgtaaacagagtaccactgttttatatctttctagactttagctggacatcaggcggaagacacacatacacatgcatgtatctaatccttggtactcaaaagtgataaaggatgatgcattgactacttttgaatttgtaacaattggggatatgggagcggagagaaggataagtaaaactactttctaaagatgtttgttcttaggtatagtttcctttgtttatctgagtagtctgaggtaacattaacttttgaaatcgttgggagaatatcttgggcctttggtaactactagatttgcacattgctcagaattagtgtgggtgagaacttaaaggaagcttcaaaagcacctgttcagaaatccctgctgctgctccggatctcgttaaactcttgttccgctgcagagttggccctatgcacgtgggcttctttaagtaggtaataagctgtgtacttttttttttttttaactttgcttctgttactaattgaggagagcagaaatttgttacaaaaacaagctcgtctttttctgagtgaaattagtttaacatagaggtgtgttgaatacccagtttggctgaatggcaagtgataaaaattaaattcacattttattcaaagctgacatcatcatagaatgaattttgggagtacagtaatcaatctgaaatttgtgtggatcaaggataattttatgatgttgtgtgtgatttttggagtttttcctcctctgaagaagtattgagatggcaaagttaacattctgctttagttcctcttcacaagat

SEQ ID NO: 9961 - DNA, 1034 bp, Homo sapiens
attagccgggtgtagtggcgggcacctgtagtcccagctactcaggaggctgaggcaggagaatggcatgaacctgggaggcggagcttgcagtgagctgagatcgtgccactgcactccagcctgggcgacagagcgagactctttctcaaaaaaaaaaaaagatagtagctaaaactacccagatttgttcaccatagtatgtctccctttctaaattgttaataactcccttaaatatactgccttttaaaatgttttgtttaacattatcattatacagtaaatttttcctatcctttgcaaatgtgaatttaaaggaattttgcacttttggaatttattcttttttaggtttgagtattttgatgttatataatctagtatataagccctgagagagagatttctgctgatgttttatgcctaatgagaataagcaaatatattgaaaactcatattcacaagaatatactccctagttaatgattccattataactctgttaaaccagttttcaaaggactcttagaaaacttaggttgaatatagactgtacccataggtaaataatatttagaaatatgaagatcatgaatcttattgtattggtttaaggagtagtggttcctctaacttcctgattgttccattccccaatttatatgaatgctaaaaagctgctctagctacaagctttataggtgcaaagaagaaaagaaatttgaagtaaaatttaaatttattcaggcaaaaacagacttttgctttgacagagtacctaaaatcatgtctaaggccacattcaagaaaagaaaacaacaataaaggataaattagccatcgaaataatttaaattagagcagtgatgactgagggagataggaaggtcaagctgggtgtcatattaacagatttagacttttgacattatctccacatgccattatatgtatagtcaaagagatgactggcaagcttgaaagaagatgattttcattgtaaagctggacatgtgttccattactagac

SEQ ID NO: 9962 - DNA, 1034 bp, Homo sapiens
ccttcagaagtatgtctgctggtgtttcacctcccagagaattctctgctgttttcttggttagcatgcagcccatttctggcttctagtcaattataagttcctttcattcttttggggggatggggacagagggtggggcagagggaaggagctcttttccctggttttaggaggcaagacctggttcctcgccccactatcccctcctcctgtaaagtagagtaggcggtagaggatggccccagctaagctgaggctctggtcagcgggagcagcaggcagagtgagaccgggcagctggctgcttctgcctgcctgcatccctgcatgctctgcgtataccctgtacccacagctgttccacacaccatacccctttcagaaaccagtcagggcaggggaggtgtgggtcagagggtatgggcacttgatggatgggtgtcattctccagccttgtccctcctagggcaaggagccttgctctgaggcactcacaccactattgtgctgtcagactcttcaggggagcccagggatcagggctctctttgagcccagatttccccatgcagaggcagctggcaggttttgtattgacaaaaccagagctgcaagagcatggatagtgaaaccctctggtcagggagttcagctcttctgggctgggctagaagggagatcccacctgtactcacacctgctacaggcaccaagatttatttattttgtttttattttttgagacaagatctcgctcttccatccaggctggagtacagtgacacgaacacggctcactgcagcctcgacctcctgggctcaagggatcctcccacctcagcctcctggcacacgccaccacgcctggctaattttgtttattttgtttgttgtagagacagggtttcaccatgttgcccaggctggtctcgaactcctgggctccagtgatcctcccaccttggcctcccaaagtactgggattataggcgtgagccgccacatgcagccacacagatttattaatgtg

SEQ ID NO: 9963 - DNA, 1063 bp, Homo sapiens
ttttatggggtagggggccgctggtaggcgaagattgtccgagggagagggggaggatgaagccagtgcgtggcggagacctgccagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccagagattgtgcctgccatcctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttatagccaaaaaaccttaaaaaaaaaagaagaagaagaagaagaagtggaaaagatcctcattgcctaatcgctgcagatcctagaggcactaggaacttgaatctcaccaggcgtagtttgcttttctctcgggtcattttattggcagaagggatgactaaggacaccttcatttgacttgggttgaggaggaagctctgggatagaatgcagttttgctcccccttctccatggaacagtattgtggtctttaagggaaagcctccaatacctaagggtcaattttattgaaagctttttctttgtggccatgtggtaaaaccgtagccaagagttgagtgagtgttacccagacaaatcaatagttcgtaggacacattgaaaagaaagtatccatctctctccctctcctcttcttcccctccccattccccttcttctt

SEQ ID NO: 9964 - DNA, 1069 bp, Homo sapiens
gcgtatgtgtttaatccacccaattcggttcagtgtaagctccttagagggatatccctcaggtccctcatttagtgctgtgcatgtagatggctgttgaatatctggaatgggaagcatttgttttaaataaaaaaactagagatagcacccattatatacaaagtgatagaaagtgggtggcctggtgtggtcctttcctctccagcctcttctccctcctgtctcctacagatatcctctgtccaactacactgagccacttttcaagcttcttgaatttgtcaaagtgccttcttgccagggtacctttacttggaatgccctcctgtcccctatctccagctacctgcaagctttttactttctgtggcatccatcttaatagaattgatcactcgttccttgtgctatcattgtacctcttacacattctcatgtcagtacttgtcacaccaaactgcagttatttgtttccatgtcactctcttctcctgggctgtgagctccttgagaatagagactgtgtctgttttatctttatgaagtccaagaacttcatgcggaacctgacacttagtagaaagtgaatgaatgaatgaaagagaatctcaaaaaaaaataaataaataaaaataaagcatcctctttatcatttctaggtggtaactagcagaaccaatgatgggtaacataacatcatgtcccaccaagcttctgaaaggaaaacaagtcattctgtcctcttgatatcacaatgacaagaaagttctgatcttgaattccatatggctggaaatatttgacattgggtgaataggagatgtcattgtgggatgttcatcaagtctattttcttatctagatatttgaggatggaagttgagttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagctt

SEQ ID NO: 9965 - DNA, 1027 bp, Homo sapiens
tgctataaatatccatgtgtaggtgtttgtgtggacattagttgtttttttttttttttttgagacagtctcgctctgttgcccaggctggagtgcagtggcgtgatctcgactcactgcaagctccacctactgtgttcaagcgattctcctgcttcagcctcctgaatagctgggattacagatatgcgccaccacgccccgctaatttttgtatttttagtagagatgggatttcactatgttggtcaggctggtcttaaactcctgacctcatgatccacctgccttggcctcccaaagtgctgggattacaggcgtgagccactgcgcccggcctatattaagtcttgaagttgggttgtgtcaatcctccaattttgtgttttccttccatattgtgttggctattctgggtcttttgccctttcatataaactttagaatcagattgttaatattcacaaaataattcaggattttgattgggattgtgttgaatctgtagatccagctgagaagaattgacattgtaacagtactgagccttcctattcatgaacatggaatatctcgctaatttagttttatcctttgtgatgtctttcatcagttttgtagctttcctcctatagaccttgtacatattttgttagatttatacctaagtttatttttttgatgctaatgtaagtggtggtgtatttttaatttcaagttccagtcattcatttgttcattgctgcaatataggaaagcagttgaccttgtatcttgaaaccttgctataattatttaatagttactggagtttttttgttgattctttgggattagacagtgatgtcatctggcaacaaacagatttcttccaatctgtataccttttatttactttgttttgcggtggggggtggtttctgattgcattagctaggacttccaatatgatgttgaaaagtattggtaagaaggggcttccttgccttgttcctggtcttagggggaaagtatctagttcctcacc

SEQ ID NO: 9966 - DNA, 1026 bp, Homo sapiens
tgtttatggatgggaatattctaatcccatggctggacagtatctaaaatgtgaggttctggtcatggtgactcaagcttttagtcccagctactcaggtggctgaagtgggaggatcacttgaggccatgaattcaaggctgtagtgagcaatgatcatgccacagcactccagcctgggcgacagagcaagatcttgtctcttaaaaaattaaaaacttaaaaaatattatatgaaggaaaagttgatcccttctctcaaggagttcaccatctcaagaagaaggaaaaatcacacagtaccaatggaaaatcgatggctcagtgtacacagaggcaaaaacacttgaattcggaggaaactttatgtacttgtagtcaggtaacctaacagatgacaaagttttgtgttatgaaaaacagctaatagtgtgtaggcagggatttctctctaattcaggaaagcttctgggaggaggtggggttttaaacaggcttcaagactgaaaaggctcatctggatggctgtgttccaggtgcgtccttttagcagcgtctcaatatatggcttgctaatattgcttttccactgtgttcctggtgttaatgtttgaacactggattttaattagaagctatttcaaattagctatctttttatgacaagtgctgttctcctcagattccacagcatatgcctggttctggggacttctcaagtttcagagcagtttatgctgtgaaacagacccattcaccatgctctctctcacttatttttgctcctgattttccattagtgggttcctgcacttcagaacaagggtctgaaatcttttttccattttagaatctaaaggaaaacagcatggctgggccagtagggtggaatgtctttttttttttttttttgcaacggagtcttgccctgtcacgcaggctggagtgcagtggcgcaatctcgactcactgcaacctccacctccctccttggctcaagtgattttcatgcctcagccttctaag

SEQ ID NO: 9967 - DNA, 1084 bp, Homo sapiens
ctcactgtaacctccgcctcccgggttcaagtgattcttttgcctcagcctctcaactagctgggattacaggcgcctgccaccacgcctggctaacttttctgtatttttagtaaagacggggtttcaccatgttggccggactggtcttgaactcctgacctctggtgctccgcccgcctcggcctcccaaagttctgggattataggcctgagccaccgcacctggctggcaccaggtgctatttaaatgccagcaataattctctcattctaatgggagaaagacaataaaaaaataagatatctagtatgccagacagtgataagttctatggcaaaaaagagaaatgtataaaaaatgtaggggatgctgcaatttgaaataggatcatcaaaaaaggtttgataaggttacactggagcagaggagaccttaaagaagtgcgaaaacaaaccccgtcgacactaggggaaggacattttagacagaggaaagggcgaatgcaaaatctctgagatgcttggcaccgtcagccagtgcagctggagcacagcaagggatggagtgatagaagatgaagttggagaggtgacaaggatgagattatgcagggtcttctaagccatttaaaagatttttgccttttcctttgagtgacttgggaaaccatcagaagtggagtagcatgatcttatattttaaaaagataactgtggctgctggttgagaatagacctaggagctaagtagcgtaaattaaagctaggccaactctgcacacttttagattgatttgtgtcttgagactgtgttgagaaccaaaaaggaggagtgacttgttctgtcaagataagagaggccttaaatgtttgggtgaagagctgatgaacggttgaacaaatgaatgaatcaatcatctcagcaggcatattacctgcaacaaagcccctccactcttccccaacctccaaacaagaaggcgtgttatcgaactgtgaggaagggagagcttgaaaaattaatagtaaacaagagatcataaatggaaatgaaattcctgttttttgctaattacaaaac

SEQ ID NO: 9968 - DNA, 1036 bp, Homo sapiens
aacagtctgaagccctttgaggcttcgtgggccaccacacttatttgatccctcagctccagtcacttggggattctccagggaggcctcggcccaaacattgatggaggaaaataaatgggtgtctgcggggctgattgtaggtccacaaaagggggccggcaacctaaaaatgaggaaagtagcagtcttcttagcctgactactatagaaaggggtccaaatttagtagtttttctgtgccattgatctagctgagtctaaagagtttcgatatctaatctctcccagtttctttggatggggaatatacacaatttattattcaaaacccagcacagctgtcaccgtgtcccttgggaaaccttccctgactgtcccaagtaatcacttccttttctttgttgcatgtgtactagatacttctttgtgatattgcacccatgacagaaaattatttgtttacctttccgtcagtgagctccctgaaggcagtgatcatgtctgtatatatcccttgtctacctagaatactacctggccacacagtagatgctcagtaaatgttagttgaattgaataagtagaattgaaattatgttccttatggtttcatatgcaatataagtcctgtttggcctttttagtaaaaaagattaaaaaacctattactatatcccatcatttggtcttacagagagtcattggctcaataatcacttgttaaataaatgaaacggtattacttagagttgtacaaggaagtcacaccttccaaaacttgagctccggtgacctctgatgtttcactgtgtgctatgttcctaacttgtgaatgggttgtcctgaagcctgtaataagtctgttgcacctggccaatatgtgtccttcatattggctttacactgatgactcagggtctgcgccttcctcgagagcactggcatcatatgcagccttccctttttttatctttttggtaccccattcctattgaatacagcttgctcttgacaccattttgttggtctttgg

SEQ ID NO: 9969 - DNA, 1046 bp, Homo sapiens
tttaagtaatttaaataatcacatgtgactaatggctatgatattatacatctaaaatattattaatcacttaataaagtaggttatttaaaacccagaaactactgggtaggtgcagtggctcacgcctgtaatcccagcactttgagaggccgaagcaggcagattgcctgaggtcaggagttcgagaccagcctggctaacatggtaaaaccgcgtctctattaaaaatacaaaaaaaattagccaggcatggtggtgcatgcctgtagtcctagctacgtgggaggctgaggcaggagaatcacttggacccggggaggcggaggttgcagtgagccgagattgcaccactgcactcaagcctgggcgacagagcaagactccgtctaaaaaaaaacccagaaactattaaggatgtaccataattttttgtttaagtatttttttcttttctggtgccaaaaaatatatgcattgtggtttaaagttcaaccatttaaaaatgtgtattataaaaatgaagtccctggtcatctcactgtaaacaattttatatttatgctcattttcttttaaaatatacaaataactcagggttctcattgtaagatagtatattaatacagtagttacattatttatatggaatcacttttaaatgagctaggatgtcgtataccataagggctgacagctgtctcaaaaatgaggtatgttgtaaaataagtgcgtacacattaaagaaggaccaccatttgaatggctgcattctgatgtaaatcactaagacaaacaggtgctggtctgcctcttcctctgccttctaaaggggctgaaagtctctaggtgatgagccaacccttgcttctagttctccagcaggtgtcactgttgggctgctgctgctaggttaggatgactgggaagaaaaggtgtccctgctgtttgtgtacgaggttggttcttttaacaaagcctgtttttgtagatgactgttgttcctgagtgagtggagttcataaaaggtgattgtacttgaaagg

SEQ ID NO: 9970 - DNA, 1034 bp, Homo sapiens
tcacctgccatattttctttctagcctttttcagtacttgaaagtattgttaatatttaattatataaaaatcacataagcttttggggggcaagaatgttcttctttactatagtatcctcagtgcctagaacagtgccaacataatacctgcttaatcaatgcttgttggttatttatcagtgcttttacatccttccccatctttaagtgttctttatttggaaagttggggaaatggaatccagcttctactcagatttaaataactaggttcttaaatctaatgccttcttttgattggctaagaaatgtgattggcatggtagggtggcatgtcggccttttagcataagaactctgtgtttaataatttgacttcttttcttgaagcctcgagggaaattttttctttccctattttagtcagccaagaacctgacctgggctgactataagattggaaaacactgaacacagtatctactaagccaagcaaggactgggagtgtagctctggtactatctgaaggaaaagcctgaattcaaatcctgctttggctccagactcatctgtgaatctagatgaatttcttaacctcttccaggttttgtttttcttatttgtctgatgagtaatcacatctgtcctaggacttgtgaagattcctgggttaatgttctcaaagcttttttttttttctgacaatattctttccttttttttttgagatggagtctcactttgttacctaggctggagtgcaatggcatgatctcggctcactgcaacttccacctcctaggttcaagcgattctcctgcctcagccttccgagtagctgggattacaggcgcgtgacaccacgcccagctaatttttgtatttttagtagagacagggtttcaccgtgttggccaggctagtctcgaactcctgacctcaggtgatccacctgccttggcctcttaaagtgctgggattacaggtgtgagctactgcgcctggcccaacaatattcttgctgtagctc

SEQ ID NO: 9971 - DNA, 1094 bp, Homo sapiens
gatttcaccatgttggccaggctggtcttgaactcctgacctcaggtgatcccctgctttggcctcccaaagtgctgggattacaggcgtgagccaccgtgcctggcctttattatttatttattttgagacgaagtctcactctgtcacccaggctggagtgcagtggtgcgatcttggctcactgcaacctccgccttctgggttcaagtgattctcctgcctcagcctcctgagtagctgggattacctgtgcataccaacacacctggctaattttgtatttttagtagagatgggatttctctcatgaccagccatgttggctggtcatttctcaacatgactagccatgttggccaggctggtctcgaactgctgacctcaagtgatacacccaccttagcctcccaaagtgccgggattacaaatatccatgagccactatgctcaggcagaccttgcatttttgcagatctctttggaatgctatttctatagtacacagactctactctcactgaatatggctaactcagctatcctacattagcatggtaaacatctgctaggtttgccccagtcagaaagtattctgtacctgccatcttgcttggcactttatatatatatatatatatatatatttttttttttttaatctctcagtgatatagtgataataggtgaaaaaggtaggctgcagggtaatgtgtgttatatatgatcccattttggtacaggaaacaaaaactattatatgcatacatgtttgtatgaactatgagtttataaggttatctcaagagggtagggttggagggttactttttttttttttttttttgagattccctcttgtcgcccaggctagagtgtggtatatataatcccattttgattcaggaagcaaaacctattatatgcatacatgtttgtatgaagtatgagtttataaggttatctcaagaaggtagggtcggctgggcatggtggctcacaactataatcctagcactttgggaggccaaggcaggtggatcgcctgaggttaagagttcaagaccagcctggccaacatggcaaaaccctgt

SEQ ID NO: 9972 - DNA, 1029 bp, Homo sapiens
acgctgggataattttgtgtttttagtagagatgggattacaccatgttggtcaggccgatctcgaactcctgacctcaggtgatacacctgcctcagcctcccaaagtgccgggattacaggtgtgagccatcatgcctgagtggtttttggtattttgttaaagcagcccaaaaggactaagagggagttactgataccactggtacttttaatgaaggatttattaggtttgtttatgctagttgaactatgggagcatttacttgttcacttctctgctgccaagaatatcttcagatatatttattgagctttcttgaattggcaacaactattaacactgtagataaagaggaaggaaactaacttttgaatgtgaaccgtgtatagggagttttacatttattcttccatgtaatatttgtaacaaacctgtaaaggatgagagaaagtgaaacattgtttgaaaaagtgaaacattgttttttgtcaaaggttatacagctggcaaatggtagagctgagatggagaaagcagagtcttcagttttaaaccagtatttttcaaagtattctttggaggtgcccaagagttggccatgagagtaaggatgagctttagttctctcaaccttgcttaagccagagcagctcaactttgacctgctttacattttggtgttttcacataagatttcctttagaaaaaggattctgcaaactttcgcaacctactcatctgacaaagggctaatatccagaatctacaatgaactcaaacaaatttacaagaaaaaaacaaacaaccccatcaaaaagtgggcgaaggacatgaacagacacttctgaaaagaagacatttatgcagccaaaaaacacatgaaaaaatgctcatcatcactggccatcagaggaatgcaaatcaaaaccacaatgagataccatctcacaccagttagaatggcaatcattaaaaagtcaggaaacaacaggtgctggagaggatgtggagaaataggaacactt

SEQ ID NO: 9973 - DNA, 1031 bp, Homo sapiens
accacgtccggccctacctggaattttatatggtaactttcctgggaaatgcttatatggacattgtcctttttagttctcctagcattcttttatttgtttatttgagacacactttcttccaggctagactacagtggtgattgtagttcactgtagccttgaactcaagctttcctcctgctttagcctcccaagtagctggattacaggtacaaaccaccacactcagcttctagcgtttttgttttgtttcgttttgtttttgagatggagttttactcttgttgcccaggctggagtgcagtggtgctatatcggctcactgcaacctcctcctcctgggttcaagtgattctcctgcctcagcctcctgactagctgggattataggcatgcaccacgatgcccggcacattttgtacttttagtagagacagggtttctccatattggtcaggctggtctcaaactcccgacctcaggtgatctgcccgcctcggcctcccaaagtgctggcattataggcatgagccaccgcgcctggctgaattttttttcttttttcttttttttttagaataaggatttactgaactgaaattcacttcacgtaaatttagccatcttaaaatgaacaattcagtggcatttaagtacattcacaatgttctgcaacctctttagtttcaaaacattaccatctctgcaaagtaaaaccccttaccagttaagcagtttgtccttattctgcccttcctccagcccctgataaccatcaatctgcattctgtctctgtggattgatttattctggatatttcatgtaaatggcatcatacaatatgtgatcttttgtgtctggcttctttgacttagcgtaatgttttggaggtttatttatctccattggaatatttatcagtacttcataccttttcatgactgaataatattccattgtgtgtatacatcacatttgtttatccattcatccattgaagaacatttgggctgtttctgccttctgc

SEQ ID NO: 9974 - DNA, 1022 bp, Homo sapiens
gatctgcggaggttgagactgcagttagcttaaaccatgatactgcactccaggccgggtgacagagcaaggctctgtctccaaaacaacaataacaacagcaacaccccattactgtgggtacattgtggggaggggtttggaaagagaagaaatcggggaagtatggttaggaagtattgcagtggtccaggcaaaaggcgatgatggtttggattagactgtaggcagtggagatagaagtagaaagattcagtagatattttagaattaggacaggcaagacttaatggattggatgtgtgggaagaagaaggtgtcaagtatgattccagatttttggcctgagcatctgggtagatgaaggtggtgtttctgagatggaaacattggaggaggagcagatttggattagagttggggagtggaatgaagacctcagttttagtcatgctaattgtgagatgcctgtgaaaacatacaagtgcagatatcaagtaagtagtctttaggctgattcacaaaagtagcgctggagagaaatctggatggtattagtatatagatggtatttacaaccaagggaaatggatgagatctcctagagaacaagtatagagtaggaggagaagaccacactccaaggaattcaagagaaaatgtaagagcttgttattagagaaaccaacataggaacatatttcaggaagggagtaatcactgtacattgttggatttgtcagcacagagatcattgatgattatagcaagaacaatattggaggaaagtagggccagaagctaaattgaattgggtttaaggcatgggaagggacgaagtggagatggtctgtgtattttgattattgacatgtgtaggctgggcgtggtgactcacgcctgtaatcccagcactttgggaggctgaggcaggtagatcacatgaggtcaggagttcaagaccagcctggccaacatggcaaaaccctgtctctactaaaaatactaaagttagccaggcg

SEQ ID NO: 9975 - DNA, 1029 bp, Homo sapiens
aacattcatccccacctcttcccttttcctgttcaccagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggtatggtttcctgttatagctccaggaataagctcaaaatagctcctagcacaggaacctgaagttttggttagtttaaattcatatccatgaacctcaatacttaatggtcaccaaatggccttcccattgctatatccagtggtcaattcttagccacctgaattgacccatcatcagtatttgacaatggtaaataaattgttccctgcccttgagacagcttcttcacttcgcttccagttctccatgctgtcttgttttcctccagtctcactggctattccttcttggcctttgactgattcttgctcacttgctctgacctctttttttttttttttttgagatggagtttcactcttgttgctcgggctggagtgcagtggtgcaatctcgggttcaagctattctcctgcctcagcctcccgagtagctgggattacaggcatgcgccaccacgccaggctaattttttgtatttttagtaaagacggggtttctccatgttaggctggtctggaactcctgacctcaggtgatccgcccgcctcagcctcccaaagtgctgagatgatgctcatgagccactgcgcctggcctcactctgaccttttaatgtggacatcccccagggttcagtctatggttgtcttctctctttctcttatttccttaatgagttcatctactttcaccactttaaataacatttaaatctccagcttagacctccttcctgatttccaaactgctatatcctacatgatatctccacctgggtttcaaatagattttttttttttttttttttttcttgagacggagtc

SEQ ID NO: 9976 - DNA, 1050 bp, Homo sapiens
tgctcagtaaatatttgccgaatgactgaatccctaaggactagttatttatatttaaatggggccaggtgcggtggctcacgcctgtaatcccagcactttgggaagccaaggtgggtggatcacgaggtcaagagttcgagaccagcctggccaacatggtgaaaccccgtctctacttaaaatacaaaaattggcgtggtggcaggcgcctgtaatcctagctacttaggaggctgaggcaggagaatcacttgaaaccggaaggtggaggttgcagtgagccaagatcgtgccactgcacaccagcctgggtgaaagcaaaattctctctcaaaataataaatgaataaaataaataagtaaatgggcttttttttaaggtaagactttagaagtactttgctaataaatattcttatggagaagtttcatatagtgtcttccgctattttagaagtatgaagcttggaaaatatatcttgaaatttttgttatcagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcggtaagggcacctctgcagaatttcagcttcccatcaatctctcagcctacagaggttcaaaagccagagtccatgcagatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccatagctgcctttccacagataagtatggttctattaaaaatgctaattagcctggtttgatcagtatacattgtatacatgtgttgaaataccactctgtattccata

SEQ ID NO: 9977 - DNA, 1023 bp, Homo sapiens
tagccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagtgagttaaactctttcatttaaatatgagcagttcatgatgatcagacggcctacgtgaaatgtgccctttgtaatgtgcagttaaaactttttagaactgattattttttgaatgatagcagttgttaactaagacctggacctagtggagaattgtataactccaactgactgggatgtcttgtaatagaggttgaagttttctctttgttctgctatctaggatccgggctgtttctccacacttcgatgacatgcacagtaatacagcatccacaatcaatttcattatctcccaagtagccagtggtgacatcaacacaagtatccaagctctgacacaggtaatgggtgtgctcccgtgacagggattccattggtggacatagaggctataaatgtgatgaattgcacactcgcagagtcatagcattaggggatgcaggcagtgtttcatactttcccgaggaaagaaatgcacaggtgccactcagtcatcacttgcctcagaggatgtgactctaatagagccttatttttttttttttttttcctcttttgagaccaggtctcactatgttgtccaggctggagtacagtggctattcacaggcactatcatagcacattgcagccccaaactcctggactcaagtaatcctcctctctcagcttcctgagtagctgggacaacaggcttgcatcactgcacctagctaagccttgcattttttataattgcattgattcaccagaggctagagataaaacagcagctaacaagtaaggaccaactctcatggaacttatttagattttagtggacagagacaagtaaacaaga

SEQ ID NO: 9978 - DNA, 1091 bp, Homo sapiens
gcccaggcaacaggtgagactctgtctcaaaaacaaacaattccaaaaatttttattcctagaagattttcagagttgttaagcttcaagaagtatgacaccttgaaatttgcattcatatttaattacaaatgaatattgttgaatttttaaatattttattgttcctgcagctgcattatataaggctctctacctcatttcagttgaacaccctgtagccccttttcaccgtttgttttttccaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatgtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaagacacttgcctagtagaattaagattttgattattcttatttgtgggagttttgttttgttttattttaagcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggtaatgtggtgttctctctctgggagactgcttaagttcccagctgacctcagtttctgtacttttatttcctctcccttttttactgattatatcacggtaccttccctacttatccctatttccctattctttcaaaacatagtaatgcatgggagaatcattgctacttaggaaatgcctcactt

SEQ ID NO: 9979 - DNA, 1027 bp, Homo sapiens
aaaaccactttagtgacttaaatatttaaagcatttcttgtaactttctctagaagcaagttcaaaaggtcttcagttacactgttatgataagagatacatttaaatatcaatggaaagaaacagaaaagctttcaaactaagtgtttggaaatgtgtaaatgccattcaagatgtcattaatggctgaggtgggtggatcacttgaggtcaggagctcgagaccagcctggacaacatggtgaaaccctgtctctactaaaaatacaaaaattagccaggggtggtggtgggcgcctttggtcccacctactgaggaggctgagtcaggagaatcacttgaacctaggaggtggagattgcagtgagctgagatcacgccactgcactccagcctgggcgacagagtgagactccgtctcaaaaaaaaaaaaaaaaaaaaaaagatgtcattaatatggaaagctataaatagtgttgaagatttcaagaaaacaaaaacaaaaagtttgtgacctagactaatgatcagtaatagcagtttttccaactacataacatgccagtccaagaactaaccaacagttacttaagaatattctcagaaaaatttctagagaacctgttcaaaaacatatacaagattctgtgatgcatgtttttttcatgtgaaatatcacgtagaaagatatctctgttttctacagtgcccttttactgggcagcagcatcatattcttaaggagaagtggccaagctaatcagtattccctgaaccttggttgtagagtgcacaagggaagaagatgccaagcaaaaccagcttaaaggaggatgaagacaaatccgggcctatttttattgttgttccaaatggaaaagagcaaaggatgaaagatgaaaaaggattgaaggtaaggaaggattaagaatcgtcaggagatttttgcttgtattgttattcaagaatagttttgctgtctgaattcatgttattgtttaatatctaggaattaagtgtttcttt

SEQ ID NO: 9980 - DNA, 1055 bp, Homo sapiens
tggctcatgcttgtaatcccagcactttgggaggccaaggccagtggatcattgaagtcaggagtttgagatcagcctggccaacatggagaaaccccacctctactaaaaatacaaaaattagctgggtgtggtggtgcatacctgtaatcccagctactcaggaggctgaggcaggagaattgcttgaatccgggaggcagaggttgcagtaagccaagatcacgccagtgcactccagcctgggggacagagcaagactctgtctcaaaataaataaataaaaataaataaaatttgataatatataacctgtgaccaattcatttttagacttactgcttaaacaaaacaatattcttgaatttagtggaatagaaattgttgatgctataaagttagaaattttacagcctgagcaacatggcaaaactccatctctacaaaaattacaaaaattagctagtcttggtggcgcacacctgtggtcccagctacccaggaggctgaggtgggaggatcgcttcagcccaggaggttgaggcttcaatgagccacgatcgcaccactgcactccagcctgggtgagccagaactagtctcaaaaaaaaaaaattttacctgtgtaaaactctttattaaagtacatattcagtttttattgaaatcttgctatgtagcagatactgaatatcaaagatgtctttacctttaagaaagtatcagtctgggctgggcatggtggctcacgcctgtaattccaccactttgagaggacaaggaggtcaagaccagcctgggcaacatagtgggaccctgtctctaaaaaaaaaaaaaaagttgttttaattagttgggcttggtggtgcacgcctgtagtcccagctattcaggaggctgaggtaggaggactgttttagccagggaggtcaaggctgcagtgagccctgaacgtgctattgcactctagtctgtgtgacagaaaccctgtctaaacaaacaaatgaaactacagtttaaatgttggtaaatgagatacagattttctgaattaa

SEQ ID NO: 9981 - DNA, 1032 bp, Homo sapiens
caggagttcaagaccagcctggccaacatggtgaaaccccatctctacaaaaacaaaatttagccgggtttggtggcacatgcctgtaatcccagctacttgggagggtgaggcaggagaatcgcatgaacccaggaggcagaggttgcaatcagctgagatcgtgccactgcactccagcctgggcaacaagagagaaactctgtcttaaaaatatatatatattaaacatgaatttatatgaggaaaaaaccatattacctcctgtgagtctcaatttgaaatcgtaacaagcaaaaataaaatattaagcagtgtagaagtaaaaatctgctgacctcacaggggtgaaaactgtgaccttctagaatgatacctaccttagtgtgacttcataatgtgtgtgacttctctgacaccatgtactgcctcccttacttcagtggtatttcaaaactaggagctcaatcatttgtttgacagaggatttgttcataagctttgtatgactttatcatttatgtgacctctcactttttatgtcattttgtctctctagccaacttctaaagatcaggtattggccatgctagagaaagccaaagttaacatgccagccaagcctgctccacccactaaagcaacttctaaaccaatgggagggtccgctccagccaaattccagcctgcatcaggtaactctatcttaagaaggttaaaggggaaggaaatagccctgaggaactctaaaaagacattcagccttgtcttttttaaatcacatttccttacagcgtagatccaagctctccttccttctctgcttactttcctttcacaaacacttgtcaagtagtcaagtacctattttatgccaggaactgtactaagggtacaaacgtgactaatttggtttctaattctaaaaagttttttttgtttttgttttgtttttttttttagagatggcatcttgctctgtcacccaggagggagtgtagtggcgtgatcatagctcactgcaacctcgaa

SEQ ID NO: 9982 - DNA, 1024 bp, Homo sapiens
gcctgggtgacagagtaagactctgtctccaataaaaaaaaaagaaagaaattgggtcctgatatgtcaataaatgtaagtattaagtatgttaactaatggtggagatgcagatattatttaaatattatatgacatttgcagttgaaagaactagaagaagaatgggtcaaactgccaacaagtgctcctagacctactcgatttcttcgttcccaacaagaactagaagctaaattggaacaacaacagtctgctggtggagatgctgaaggaggtaagccaattttaaacaccggtttctgcaaaaattagcaagaactggcactgccatgagaatctgtgttcattaggcatattttgtaggattgcctttaataaaatataagttgcatgtagctttaataactctggtcccttctctattaaaatttcatcagggttgtgaaaggactgataactgataagtaaaacaattctaagcatttttaaggtttgtgttgtttttctccttaaaggtggtgatgatggtgatgaggtgccacaaatagatgcttatgagcttttagaagctgtagaaatcctttccaaacttcccaaagacttttatgacaaaattgtaagtaatagttaaacttctttcatttatttcttgtaaaataattacttgaatagaattagaatactctgctgagcccttgcctgatgcacccccttccatcccatatcttccctagtagagtgagttagttgcttcttcctctttgctcccacactactttgtacatatatatattatagcacttttttaaaacatgtcttgccataaaaccagaacattcttgacttcctttttctaattttctctctggtttttaacactaaagagctccggattcctcccctttctccgtttctactgccactactttaccccaaggtttcttgaccttagcactgttgacattttttgtcagctgtcctgtgcattgtatgatgtttagcagcatctttggcttttatc

SEQ ID NO: 9983 - DNA, 1031 bp, Homo sapiens
aggcagaggttgcagtgacccaagatcatgccactgcactacagcctgggtgacaaagcaagactccctctcaaaaataaataaataaatacattttaaaaattggccttttggtggaaaagcactgaaaagaaaagtactggccttttgttggaaaactactcctcagggtatttaagcagctctttttctcttgctatcttaagtatagactttcgaagtctatactttgagatgttggctaaagataaagtttgtggactaaagctaacctttatttaggtgcctttttagtaaagtagaagcaaatgctatatgcctttaaagagacgcacagtgaaagcaaatagaaaagtaacttttgctcttatgtagtaagttcttttcaaccctagactttcttgtttggccatgaaatttttcatgaataggatctctttcaggaacaagtggatgtaatttgctatggaaatctgaattagacagatcactagtttgttcagacttggcagttcttctaatctggtatcctgtccccaagtactgtctatatcagatattttagaaagcagctgtagtaaaatcctcacggaatgaagatcatccatctcacctctcatgattttgtgtatgacctacatcttggagaaaaatgtttcctttggtgtttatcttctgtgaaagtataaaaactcttgtattttgttgaatgatctttgatttataggtctttaatattgttttttgctttgctcataatgtacttttataaaatttgacttgcttagattcttacgtgaatgaagtttccttgtttctagcctattacaatatagtaagcagatgtttttctgagtagtaaacagtatgctcattctattatcttagaaatttagtgactcatcttagttatcagaactatgcttatatcaataaatcttttgtgtccttagtgatgtctaaattttaaaaaatactgtaatctttttttttttttttttttttttttgagacaaggtctcgctctgtca

SEQ ID NO: 9984 - DNA, 1738 bp, Homo sapiens
aaaaagtgtttaaaacgacttaaaaaatttttttgcccagatgcagtggcatgtgcctgtagtcctagctactcaggaggctgaggcaggaagatcgcttgagcccaggagtttgaggtcacagtgagctataatcccaccactgcactccaactgggtgacagcacaagaccctgtctctctctctttttttttttttttctttttgatacacagtttcgtacttgttgccctggctggagtgcaatggcgcgatcttggctcaccacaacctccacctcccaggttcaagtgattctcctgcctcagcctcctgagtagctggaattacaggcatgcgccaccacacctgagtaattttgtatttttagtagagatgaggtttctccattttggtcaggctggtcttgaactcctgacctcaggtgatccacccgcctcagcctcccaaagtgctgggattacaggcatgagccaccatacccgaccaaccctgtctctttaaaaaaaaaaaaaaaaaaaaaaaattgaaagcaagcattctgtaaccctacttttgtaaagtatatttgtatgtccatatacacacacacttagagaaaggtctggaaggagggatatcaaaaagttgaaagtagttttctctgggtggtgggatttcaagggatctttaattttttgtttgaattttctacatttataaactgttactatgcctgctatgacatgtcttaaaattttatgtttaacgttaagtttttaaaatattcttgaacataaatttaaaaattaaagactcatttactgtatttctagcatttgtaaaagtactagtacaccccctttccgtgacctttttccaattcttactacttaagtgggatttttgttctttataatatgttacagaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaaggtaagactttgttttagctttgttaactagagcagcagtccccaacctttttggcaccagggaccagtttcatggaagacaatttttccatggaagaattgtgtgttggggggaatgggggggtcgttttgagatgaaacagttccacctcataaggagcatgcactctagatccctcacatgtgcagttcacagtagggtttgcactcgtatgagaaccttaatgccctgctgatctggcaggaggcagagctcagggggtaattctcgcttggtagctgttcacctcctgttgtgtgcctggttcctaacaggccactgtactggccacagcccaggggttagggatccctgaactagagtatctcaattgagtttggattccgggtttaaacagaaatggaaactgcagaatttgacttggcatgccaaaacaagcaagaaagtgacctgaataaggaaagtcattccccaagtgtggcacttcatgttgactaattttagccttcaagtgtgttgtgtagttattttatctgaatccctttctaatgaagatgaatagagatttctgacctgttatcagattaagaattaggcttttcagttgggggcagtggctcat

SEQ ID NO: 9985 - DNA, 1016 bp, Homo sapiens
agtaattctaggtgaaagtatgactttttccaaaacttttttcttggccttttaaaaggccatttagctcagcaattcagttttattccagcttcgttttatatctaagaagttcttatttgggaaaataaaagcatcattttttagaaaacaaatttttggtttttttgagacagggtcttgctctgttgcccatgctggagtgtagtggcatgatcacagctcactgcaacttctgtctcttgggctcaagtagtcctcccacctcagcttcccgagtagctgggactacaggcacacacaccactacgcctggctaatttttgtgtttttagtatagatggggttccaccatgttgcccagactgcaatatatttatatttatattttttgagtgactttatttttttgagatggagtcttactctgtcgcccaggctggaatgcagtgggacaatcttggctcactgcaacctcctcctcccaggttcaagcgattctcctgtctcagacttccgagtagatgggactacaggcctgcaccaccacacccagctaatttttgtattttcaattgagacgggatttcaccatgttgaccagactggtcttgaactcctgatctcaggtgatctgcccacctcagcctcccaaagtgctgagattacaggcatgagccaccactgtgtcctgtcttttgagtgactttaaaaaaaaaattctattggccgggcgcggtggctcacgcctgtaatcccagcactttgggaggccgaggcgggtggatcacgaggtcaggatcgagactgtcctggctaacatggtgaagccctgtctctactaaaaatacaaaaaaattagccgggcgtggtggcgggtgcctgtagtcccggctactcgggaggctgaggcaggagaatggcgtcagcccaggaggtgtagcttgcagtaagcggagatcgggccactgcactccagcctgggtgacagagcgagactccgtctcaaaaaaaaa

SEQ ID NO: 9986 - DNA, 1901 bp, Homo sapiens
atcatcacactcagtggtcattcaaatgggttgctttttgatggagcagaagtttttctcaaacttctgttaaaatcattctgtgcttctgcaatagcatctccttagccagaggtgagagtccaggaatggtaatcaaattcagatctcttgtattgtgatagtgaagagcttttgtaggtcaagagcttgggaatttgccataaaaaagtcatactgccagtggtttttctctaagtagaagagaaaataatctgtacagtagctctgtaattactcttatagactatcaaaatacaggaatttaaactaaaaagacaccacacttgggcccatgggttgtagggaagagagacagactgagaagtaggagacataggttctaggcccagctctagtattactcatgacttaatctctctgtcccttttaaatggttggttaatgagaaaatgcacagattttggggtctcttttatgatgggatatagtgcatatttaataggaaatttgttatttatttgaacactaaactgaaaaatcagacaatttggaatttattctaagttctgccttcatgtataaccttgaaaacatttcttaacctctagtctaaaaataaacaattatgcctaaaccttttcagcaatagcatggactatatggtatttgagctcttaggaagacatttttagatcagtggtatatgattataatatatctgtaaaacatacttactttagctgacctacttgtctttgcctcagttttagactgggataaaatctgagagctctgaataattgaaatttctgaatatgtgtctttactagggactagatcaaataaaccacagcaagcattatgtatagttcaaattaatcttcttaatgcttctctttgttggcaattttatttgctctttaggcatcaaactctactgtgtagcaaaaacttggttcttatatctgtttataaaatccagatcagtctgctcatccctatatgatacttttaactttttgagaaacttccaaatggttttacacagcagctagaccattttgcattcacagcagctggaccatttggcattcaacttaaaaaatacagaggtataataatttttattgtattttacagacatactagtattcagttggtgggggtggtagggggaagactggtcctgagtttgaaaagcacagtttgatgaacatgtgaactgtttccagcttttgactactatgaacaacattgctatgactatccctatataggtcttctggtgtaatttgcatcagtttctaggctatacacctaggaatggagttgctgggtggtagggcatgtgtatctgataatgccatactgttttccagactgttaaactattctgtctcccatcattggtgtatttgagttcctgcagattctcctgactcctttaaattacactgctgctgtttcatggcaatcctagggattttgaagaaaaatcttaatgaaagttccacatatcctaataaacttttacaattccatctttctctgggacattttcttctttgccatgggagggaacaaaatgtaaaggaagaagcatagactatgaatcttagtttaatttcattgcttaccagttttgttgttttggcaggttacttaatatttgtgaagctagtgtgtaaaatgagaatatctttccttcacatagttgatgtcagtataaagtgaattagcgtgtttaaaaagtactttgcaccatgcctgattcagaatagatattaccagagtatatattcaataaacaaatatttattgaaaacatattttatgtcaggccagaactagggatggagaattacggaggaccgcttctatgttattaataatattga

SEQ ID NO: 9987 - DNA, 1048 bp, Homo sapiens
tttacacacaagatggggaaggttatttttctttttttcttttatagaggtatggttttggttagttgttcagggtggagtgctgtggtgcagtctggctcactgcagcctagtcctgggctcaggatcctcccacctcagcctccggagtagctgggactagtcttgtaccaccatgcccagctaattttttattttttgtagagatggggtctcactttgttgcccaggctggtatttttctatttcaccttctattaccttcctgcccatcttgtatcattgtccaggattcctccagttttgtaaagaacgaattccgtgaaaaggtgaggtggagcattgtaggatcttttccaggcctttgagttgccatttgaagaactgctcgagtccaaaggaggttaatgaagtaagcagcttacatataatgaggggctatgtatctaccttgatgctttggctgttacctgcagtaatttttttcacccttggaggagggattaggattgtgatagtgggaactggtcatctcctttgtttctggaatattacgtgtaatactaccaaaaaaagaggtccacccaactgcagtagtcttcctagttggtccatcatttgcctcttgcctgggaaagcctaggacctagaagcagcgcctgaggcctgcaaacctctgggcgaagatacactgcggcccctttaagctttcagagtgtgcggagaggggagctgagggtggggcgggcactctgacagtggcgctccgggccccgccctcggaggaggcgtttcccagcggaccgcagcaccaatgctgctgccgccgccgccgccgcctgccgggtattcctgctgatcctgctcggaccttagcttccctgacctctccctgcccggggagcgtaagtgtcaaaccacgggcaaagggcaagcatcccgcgaccgtgctgcaagtcctggtggacagtactggggactttgctggcctatcagaggctaaggcggcgaaagagcgtaaacaatgccggctccagtgagctaaagc

SEQ ID NO: 9988 - DNA, 1015 bp, Homo sapiens
atgctacaaagcatacagatgaagagaggcgtagggcttgtaggtatgggagaagggtgtggagctcttatgctctcatatgaagtgtgtttgaatataccaactctcctgtaaacttttatcttaattccatcaacactcactttcttttcctttttttttttttttaagacagagtcttgctctttcgcccaggctagagtgcagtggtgcgatctcagctgactgcaacctctgcctcctgggttcaagcgattctgccacctcagcctcccaagtagctgggacttcttgtgtgcaccacaatgcccagctaattttttgtatttttagtagagacagggtttcactatgttggccaggctggtctcgaactcctgacctcaaatgatccacccgcctcagcttcccaaagtgttgggattacaggtgtgagccaccacacctggctaaccctcacttttctaactgtagcttctattaggactttatcaacaggttttgtttttgcaatactaggtaggggaagtgttccccagccagacataatatccattcctaataaaacacatttacatataggagacacagcttccaactttcatagttctgtcaacacttacatctttgtgttctctcaattttttttttttttttttttcaatcagatctcactctttcgccctggctggagtgcagtgctgctattatgggtcactgcagcctccacctccagggctcaggtgatcctcccatctcagccttccggtagctgggactacagacgtgcatcaccatgcctggcaaatttttttagtttttgtagcgatggggttttgccttgttgcccaggctggtctcgaactcctgggctcaagggatccttttgtctcggcctcccaaaatgctgggattacaggcgtgaaccactacgcctggccttctcttaatctaactgtagccctgttcggggcttcaccaatggctcttggtactactgtacctggggcttcca

SEQ ID NO: 9989 - DNA, 1079 bp, Homo sapiens
taatttgcctaaggtgacaaagccagtgagtggctgctgcaggaccggaagccatggttttccctcctcctgtatggtaatggtaataattatcacagctgcctctccccttttaggctaggcctcatacacttgtcttaatcacatttccccatttgtttgtgggatttttgtgcgcttcactcctactcttaccccatccacttcctttttcagtttaccatgggatcctttgtagaaggccaactgactgaccatatctgcccactctccaccctagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaag

SEQ ID NO: 9990 - DNA, 1050 bp, Homo sapiens
gttcaggacagagaccactggcatctggtgcacaatattaaaattacaacacgagccaggcacagtggctcacgcctataatcctggcacttttggaggccaaggcgggtggattgtctgtactcaggagtttgagaccaggctgggcaatgtggcgaaaccctgtctctactgaaaaaacacaaaaaatcagctgggtgtggtgacgtgcactgtagtcccagctgctcgggaggctgaggcacaagaatcgcttgaacctgggaggtggtggttgcagtgagccaagattgcaccactggactccagcctgggcgacagagtgagaatctgtctcaaataaataaataaaattaaattataacaggcaaaccgtcactggccagggaactcctacgtggaataaacaaagctgatgtgtaaagaattctgaggtgtgcttcacaggtcaccacacacagctagccttctgttggggtctggcccagccctgtgcttgggtaaggacagaaggctctgggtgacgctccgtgaaggagaacccagttgctgggcattgtctcttgtgcggtgatgctgatgcctatcctttggtctcatgcctggctctgctttgctgcgcagctctgtctcccactccgtgctgtctgagatgcaggtgattgagcaggaaaccccagtgagtgcaaaatcctctcgctcgcagctggacttgtttgacgatgttggtactttcgcctctggacccccaaagtaaggctgttttctagctgtaaacttggctgctgtgttcctcatcaggcttctctgagccactctactgtctccctaggtacaaggacaatcccttttccttaggggaaagctttggctcccgctgggatacagatgctgcctggggtatggacagggtagaggagaaggagccagaagtgaccatctcaagcatccggcctatttcagaaaggtagagtgggctgttttttcttttttctttcttttttttttttaaacaagctgaaggtagagaattctaaggcagcactgtct

SEQ ID NO: 9991 - DNA, 1031 bp, Homo sapiens
gcacctcacccaaagcctcactgggtcagtatgccagcgggcaggcgtggggtgtctgggagagggtggacctcaaatgttcttttcagaggtcctactgcctggccgtgtggacagaggccacaggagactgagcatctatctgattctctggagtggggactgtgattgaaatagtggatgcaacactgattttagagccaagccctttgaattgatgaatctgggtgggctggtgtataaggcctggggtctgcctctgagtgtggggctgggtctagccaaagtgttggggaggccagcatgagactggacacctatccctgggctctgaggcagggctggcttgtctggtgcatttccgggggtggagggacagctctgagctgccgaaggctggaggtgacattgttctttctcagccagtaccccagcctgtcctttaactctttcctacattttccttagtgtctttcagacttggttcagggcgaacagtccatttgctgacctcggtttgttctgttgactcttgggggttggggctggaacccagcagagtgactgtcagactgatccatgagaaggctggcatagcttggtctgaagcagggcttcatagagaccgctgggcttgggagctctgtggaggctctggggtgggcctcttgttagccacaagtctgtttctcctccagagtccgtgtatctgtcagctaaaggggcccttcctgccagaggtaactgacagctgcttggggagcccagcccctgttctcagcttcctgctttagaagcggagcctggtgctcaccatatgctccctgcctcgcagtctttgttttggttcagggaatttggacgtctctggtgcttcggacgtctctggtgcttcaggtctaggttcctgtctcactctgctgggtgccagtaaataccccagccacgtctgtctttggctttgacaccgctggttggagctggtggtggcagctttgccttcccttgcctgaagctgttcttaggagctc

SEQ ID NO: 9992 - DNA, 1204 bp, Homo sapiens
atctctgaaaaaccggtgtcagtagcgtgtatcatcctgtatagataataacttcgctgtcataaggagatgtctcctacagccaacacgtttccttcttgagaatcacccgtagcacgcgctgctctcttctttgctctccagacggctttttttcgccaacatggatgcacagccaatgatgccaacaccaaatataatagccgagctgcccagatgtaccgggagaagatccggcagctggggagtgcggccctggctaggcatggcactgatgtaagtgcctgttcttggggctggggcaggagggttaggagtattcagagccctgtgttttaggggtgtcttctcctttctagctttggatagacaacatgagtagtgccgttcctaatcactccccagagaagaaggactctgatttcttcacagaacacactcaagtgagtgcccacaaggaaccgttttcccagttgttcttgacaggcaatttaccaaggcccaggccttctgtgatcatggttgtagattccatttgctttgatgtgatgtcttggacaccacgtatgaagtccactgttcctgctgggtaggcctaggtgtttcctcctccataaatggaggtgcagtgtagccctccttagaaatcgactcctataaattgggctggcggggaagagaggcagcttcttgaagtttcaagaggtgtccggtgccccaaacaaattttcctggattcttcccctataagaaaggcactgtgggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaggcactgtgcttggggacagtgaaaggattctctcctccccgccccacccctttgaggagggtttcctctttactggccctgggtgctgaagttagactcttggcttcaattcc

SEQ ID NO: 9993 - DNA, 1070 bp, Homo sapiens
ttggaccaagcattcccacagctgctggagcgggcgcgtttcctgcgctccaggtggacatcgcttcttttctcacttaactaattattgctgattccagcgcgtggggacacacaaatcagaatcctggaagcctctgtcggtgactgaagatagacactgtcctgtcagccacaactccatgggttatacaccccggctgaagggtcacccggggctacaggagcaaggacagagaaacaggggaagtgactgaggagaagatgccttaattggaggtttgaaggagaagcagaggtgcatgagtttggaggaagcgctgtgacagcgccctgctttggggacaaagggcgcacactgtcctcctgggtctggctgtgtcccttgggcctgctcagagaggaagcgatttccttctagggtctgtgagtcagtcagtgctggggacagctgagaccctgcccagaggcaggaggggagcagccacatgccactgtgtccttgagtccctggggccatggctctggggttggaattggcttgccgtcctctgcgattctagggaacttttttttttttttttgagacagtctcactctgttgcccaggcggtggtataatctctgctcaccgcaacctcctccgcctcctaggttcaagtgattctcatgcctcagcctcctaagtagctgggactacaggttcccgccaccacgcctggctaatttttatatttttagtagagacgaggttcctccatgttggccaagctggtctggaactcctgacctcaggtgatccacccacctcagtctcccaaagtgctgagattacaggcgtgagccaccacacccagcctgggagacattcttatagttggccatcgcttctcacttccccatgctgccctggacgccaggcctttggagggcaggcccgggttgtgtgttccccacggagccttgcgggccctcagtggatgtgtggagtgagatgagtatcttccgtgactgcagggcccctcgtatttctggtgcgttgcttggtttgagtttcacaccagccctggc

SEQ ID NO: 9994 - DNA, 1102 bp, Homo sapiens
tcagcaggtggcatgccctctctcagccttacttttttttttttttttaatttttggagacagtgtctcgctctgtcgcccaggctggagtacagtggcgcgatctcggctcactgcaagctccgcctcctgggttcacgccattctcctgcctcagcctcccgagtagctgggactacaggcgcccgccaccacgcccggctaattttttgtatttttagtagagacgaggtttcaccttgttagccagaatggtcttgatttcctgaccttgtgatccgcccaccttggcctcccaaagtgctgggattataggtatgagccaccacgcccggcctcagcctcacttttcttatttgggacttggggatgatagcactgatttcacagggtcgtggtaaggattagatgtgacagtgtcaagcgcagtgctgggcacaggatgaggacagtcagtccctggagtcccagatgcagatttctagaaggccagagctcaagagaccctagaaataacctgttataacctgcattaacttcctcccttcatcccccacatcttgtactgagaagaaaacaaggcgcattgagtaagggacttgcctctgatcacagggcaacttgactttgttgcttgacggggccaggggaggatatttggcccctctgcccattccgcataagccactgagcctgtggtatctgtcctgtccccagtcctgacgtgaactacgaggagctggcccgctgcacagatgacttcaatggggcccagtgcaaggctgtgtgtgtggaggcggtgagtggtcagctggggtgggtgcgttgctttgtgccttcttgccccctccctggacaggatgggggcatttggctggtggagacggctgagggaagaggcctgagcctcagggagccagggaaggcattcaggcgttcagacctagactctgtttgtcccggctgtagggcatgatcgcactgcgcaggggtgccacggagctcacccacgaggactacatggaaggcatcctggaggtgcaggccaagaagaaagccaacctacaatactacgcctagggcacacaggccagccccagtc

SEQ ID NO: 9995 - DNA, 1135 bp, Homo sapiens
attttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctcgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaactgatgtcttcagagttactgattgttggggagggtgatgtgtccttggagcaggtggggttgccatgttcctgaagagggggtgtgggtgccctataaggcttcatttttatgtacctgaagatgtgcagctgaaccccccaaaagctccggaaggaaaacataatttctccccagaaaactgccttccccatctttttgtattctccaggatttctacttatgcggaaacaccttaaaacttttttgcccaccctaatttttgagcatctcctgttctccttggctgccacaaaacaga

SEQ ID NO: 9996 - DNA, 1522 bp, Homo sapiens
ccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctg

SEQ ID NO: 9997 - DNA, 1048 bp, Homo sapiens
gttcctctttgtcagggaccagccctctgccagtgtgtgcttgtcattgctggaatggatatgaagcacccttatctgctggctaatctcttgctttggatgttgtagggttgaatgcaatgcagttacagaatttggctgcactagctgctgcagctagtgcagctcagaacacaccaagtggtaccaatgctctcactacatccagcagtcccctcagcgtgctcactagttcaggtaagcatgaggatgacccagtgtgccattatgtgccttggacagatgctttgtgtttaaaggcagagtccagagagggaaaatagttaacacctgtttccagagaggtcagattatgagcaacaaattttcaaatgtcatcttttgtacttaagagaaatcttcctgattttcaatgtgctgtggccattatttgtctctgtcctgcaaggacagttgttagaattagtaactgaaaacctctttacaaatagcatacttggatagtgacactttttcttgtatttggcgagaatgccagtgatgggttgaattttaactccttgctttctaatagcagggtcctcacctagctctagcagcagtaattctgtcaaccccatagcctcacttggagccctgcagacattagctggagcaacggctggcctcaatgttggctctttggcaggtaaggggcagcacctggctgtcatcagactattctttgtgcaggtagcacatcttaaccctggtaggggcaccactggaatgattgcagtggcccagtgaagttaaaaataatcatgagggccaggtgtggtggctcacacctctaatcccagcactttgggaggtcaaggtgggcgaatcacgaggtcaggagatcgagaccattctggctaacacggtgaaaccccgtctcccctaaaaatacaaaaaaattagctgggcctggtggcgggcgcctgtagtcctagctacttgggaggctgaggcaggagaatggcatgaaccggggaggcagaagttgcagtgagccaagattgcg

SEQ ID NO: 9998 - DNA, 1027 bp, Homo sapiens
atttttaaactttttgtagatatgaggtctccctgtgttgcccaggctggtcttgaactcctgggctcaagctatcctgctgcctcggcacctggcctgtcttactcttttgaagtggatcttatgcctcctctgtagtctccaaaattacggtaatttaaatgtctttttatgagagttctttactactaaaattttattttagctgtaacaggtgaaattaaagtgaatatcatgataaagatttaatacataataaggatatttccatgtcccaggatttatgatccttagaaacaaggctgttgctcaaattgtctttcattgtaatacttcctgtgctttgccactgcctggtgttcaacccaacattgacacagcattcttctcagcctgctttctaatcttttaagagattggacccattcaatatcccattaaatctggaccatggaccactgcatgaaagtcacctggaacttaaaaattcagatgtttttattctagaataggacccccaagactctagaaacaagtgtccagcatgtttttttgtgcacactaaagttcgagagctagtggacttaacacaggtcattctcagagtcagtcggggaatggattgtcaacattttttccaagtacgtttgcatctgttttagtcacccatcttcaccaaaactttgcaagggtgcctgggcgtaggccattgccccgattttaaacatgagaaacccagttgagagagagattgaggacaaatagtaatcagtgttgggcctgaagtacaagtttaaaggtaaaggtctttttatttttgcccactagaccaggctgcctctagtgtcagtgaacggttagccaatgttcttgattcttcattgatcactcttaagcttccactggtgctactttgcctgcatcctaagatatggatattttcatgagttgtgtcccagacttttttcttttcattctcccattgcttaaggggacactgatgtgcttctctgcttctcagatctct

SEQ ID NO: 9999 - DNA, 1034 bp, Homo sapiens
ttacaggcgtgagccaccatgagctgttgttgctcagcctttttaaagcctggaatgtctttttagaggaattcttgcactaaaagatctaatttggttgtcgactcagttattctttggtctaggcagctttctataggaagaggcatgccatcagttccaatgtacgtaggagaaactaggacaaacatagccagtaatctaaccagccccagctagggttaccatcttctgcctgacaggcatgggcttggtaaactgtgtactgtgtgtcagttgcacagtctcctctcacttgcagtttgtttttgccgctttaatagggtggaagagagctcctgccacttctgcctctatagtagtaaatcagatgagcgagtctctggcaaaaatagaaaaagcagtaagctgctgttacagtacagttctagattttggatgatgacgtctggacatggacagaagagacagttttcaccttcctgggtcaggtgcagacagatgttagccattgttacacagattagaacttctaggcctatgccattgtgtgttgcctttcttttttttttttaacgttaactctgtgtgtttagtagttcattcgttttacttctttgcaggctgaacataacttctttttttcaaagttccctgtgttgtgaactgagcttgggtgaagtgaaatctttgaggtaaggcaactctaatgataaaaatggaaagaaagcctgtgaaatttgggagccttcagagataacattttagagtcactgcctaaatattgaaatgccgccatttgttgtttggggggatgtggagctaaattgagaacgggagcacacatctgccttgactgctaagtatatccatctctactgctcacccataatagaatttttatgtgtgcactcactagtcttggttttatcaacagtttaaaggaggaaaaagagaatgaagagacttcatttcttggtttttcccttacatgtttgagtgttgtccctggtaggccctagttctttttcatt

SEQ ID NO: 10000 - DNA, 1069 bp, Homo sapiens
caggtgcaagtaaatgcttttaggaagttctgtttttttttttaattagtttaaactttgcccttaaaattactggaactatcactactttattagcaaaattggaaactaattaaatctgcatgaaaagttaatacttgagcacctattttatgccagttaagaaatctctctgtcttcagggaggataggcagtgtcttactagttagttctgggtctggctttgtctttcagaattcttgtactttccagtttagacattgtccttggtgaatttgaatagtttattgtctgtagtgaaagccagacagaaatacagctggcaggagttgtatttggaagtttgtaggaatttgggcagttttatagaatcagtctttacttgcaagattgttcgatatgcttaaaaataaaacaaattggttttgtggttcctctgtttgcttttaccatcaattaacttccccatcttctgatttttttttttgtttcagtggttcaccgccaccctagggccaccaagatgcatttacagtggcaggaacgtggttgcttttgtagagtttcatgcccggcacctatgtattcaggaaggttgctttggggaaatagtgtggtctctccacatgaataacacgatccttaattgctaaaagaattatacagccattagcttttcttagtctccaatccaaaagcagatgttaaaaatgattgttttggtgacctagatgtactgaaattcaacctcataaattttagtcattgttttgctatttgttacgacattttagggcaagactcttttaaaccttttagtattttacttcccccatcgtttaagttgatggtgttttaaaattagccttgagatattaaatgcaacttatctttaaggcattgagtaaaaagggcgcaggaggagtacttctgtatttttatcttctgccatggtgacagaggggcttttctttggaaagaggtgatatatctggagtcatgagagacgtctaggcatggcccacttatttttctttccttggttttttagagtgaagacatagtcca

SEQ ID NO: 10001 - DNA, 1057 bp, Homo sapiens
cccttagcatttaaacagactttctgtgggttatgtgcatgagcttccttggagacaatttttaacctgaagcagccttcttagcccggatctctgtgatcttgagggagtcatttcatctctgtatcttttctcatctgcaaaatggagatagcgtacgtatgaggattaaatgtaaagcacccaaaacaggtcatagtgtatggtaaatgctcaaaaaatgttagctcgtacttattgccactttacaaatgtctagacatttctctttacttttaggtgataagggtttacaaactttaaatgccatattccatcaatttgaagatgcacatttattagcactgatggtatgttaaatacattgattctaaagatagaaaaatttattgttcaaaaaaccatttatgtcaaagccagatataatattgatgaattatctattgtttgaattatttcatctagttctcatatttcccaagaggttatcctgagggccaagagagactgacagttggggcctgcctctccctcctctatctttgacctgaacagcctgactttcatgtttaggagaaaaacagttctgcttttaagatcgtttaaaaacctctaatctggatagtagttagattatttttttgttttggtttttgagacgatcttgctctgttgcctaggctggagtgcagtggtgccatcacagctcactgcagcctcgacctctgggctcaagcaatcctcccacctcagccttccaagtagctgggactacagacacatgtcaccacacccatctaatttttttttttctttttgggtagcaacagggtttcatgatgttgcccaggctggtctcaaacttgtgggctcatgcagtcctctcacttgagcttcccagagtgttgggattataggtatgagccactgtacccagctaaattctttttcttcctggctaaattctttattagctccctgtcttatatcaaggaagtttttcaaggaattttaaggttgcttactaacagttgttagttaagagtgagttggccag

SEQ ID NO: 10002 - DNA, 1032 bp, Homo sapiens
atgactccgcaagagacatcaagattataaggtgattttaaaagtcgctctgacagggcttgagaaaaaaattagtcacattctgcctacatggtactaacatatggtgcagccctgatgagctgcacaagtgggctgaaatcaaaatgcagttggaaagaggagcagtagtgactcactagataagacagatttggcctcatggcagggcagtgaaactaagaaggaactgtggtcttagaacatgccagatttgagcaagtgatcatgaatattatggaaaggttgaatgactgagcctttgggtttgaattaggtactttgtctggtgtcacagtccttggagcgagcaccctccctcggtgggttcagagctcccactccctccacctccctcacttctgtgtattacttctgtgtatcattccctgtgcctttgaaggtagaagccaccaggcaaatacttaacactggtgtgcctggaacattgggttcaaactgcaatgataggtagaagcgttagtaattctgcccagagaaagctgtgcattagcttagctaccatatgtaaattgctactgctgcatccagcaatttgttgtccattgttgacagtactgccatggtaaagaaacaggaactatagaaagaattagattcctcctcccacctcccagctctcaccacagtaggaagctgtttggggagcagagaggaaatacgggggatttgagagttacacccagtgtgtgggcatttggggaggaaataggaaaagagattttttaaattattttattttttgaaacaaggtcttgctctgtcagccagactggagtgcagtggcacgatcatggctcactgcagcctcaaatttctggactcaagcaatcttcctacctcagcatccaaattagggctacaggcgtgcactgccatgcctgtctgattttttttttttttttttttgtagagatagggtcttgctatgttgccgaggctggtctcaaactcctgggtgctagagatgtt

SEQ ID NO: 10003 - DNA, 1024 bp, Homo sapiens
gtgttgggaatagaacttgtcagctgagtggggatgagacagttctctgcccatactatttgtaactgtagtcaatgaggagaggaaaggacgttattaaatgctggagaaacaccttgattgaggcagcttcttctgtggctgtgtggtatggatgcagagttctgtgtgactatacactgatgtattctggctctgaatcacttagggatctcttctgcaccttgtgcattgtaggttttggatgcttatttgtttagggtctaggacctggtgcttagcctctcctggatcctgtatatttactgactttccaaattcttttgagtgtggcattatatctgcttcatcttctctttcttggctattcttagtgcccttctcattttactgtcctaatgttttcccatttatactatgaatcattgtgcaccctatgtagagcctgtcattggagattaaaatcagtggcagctctttgattttacagctcagcctcagtaagtgacactctgattagcacacctatattctagctttctttttgttcttggccttttttaaaatttataacttccctggtctcattttattagtttatatttttccagtgtgtccattttgaaagcttcatgaaagaaattttttttttggtttgatggaaggaatgaataaatgtttatacataaataagtgttctcagaacaagtggtttggtaatccataatgaagatatactggactctaacaggcccagttggaggtgcaagatctgtcagcctattgctgccagaattcttacctattcacttccccctcctgctaggaaatattttggaataatctcaggtacccaattttttttttaaataaatgaagcctattttattacttcaagtttgcttttttttttttttttctggagatggagtctcgctctgttgcccaggctggagtgcagtggcacgaactcagctcactgcagcctccacctcccaggttcaagcaattctcctgcctcagc

SEQ ID NO: 10004 - DNA, 1023 bp, Homo sapiens
tttgagacccgcctgggcagcatggtgaaaccccatctctataaggggggaataaaattacataggtggtatgcactaagtacttcagtaagggctgaagaatagaatcatttgagccaatcagccatgcatttcttattgttggaaaattcactctggtcagcaattaagcttttcacatacttcacattgaagtgaatctaaatgaattgttctaagtaaaataatttttggaacacaaatatttggcttctggttatataagccatcatcctcagacatagattttaaaaattatattagagtttattttaacttgtatcaaccataaaataaaaaagagctcaaaacatacacagttggaatgagaccttcattctgaaagcagcaaggaactagtgaaagttaacattgttcactcgaatggagaataacctttttttgcatgttaaattttaggatttaaatgataaattgagcctcaccactactgctgatctgggaagaatctgacctagtaaaggttttcaaatgtcttttccatttcccgtggctgagggattcttggtgtcagtgactgaaattatttggaagttccttgactgaaatagaatatctcaaaccttatttcaagtaccagcctgtgtgtttctgttttttgtctggagcatgtgaacagaatgcatgtgtgtgagataattgggctttcactaatggccccctttcagcaaccatgtatgggtaaagctgttcagttccctgctcctccctctctgagcacggagcagaatctgttctgctgaagctgctgttccactttttagcttgctatatttgtacagcaacagcaggagcagcccactagctaggccgtgtggccaccctttggcacccgcaccggctcagacctgctcaggactcagccagggcacacagtttgtgttcttacgtgcatccatctgtctgtctgtgtgcgtctctgtggaggactgaggttttcaagtgaaagaggtgactcgtttg

SEQ ID NO: 10005 - DNA, 1039 bp, Homo sapiens
cggccaatttttgtatttttagtagaaatggggtttcaccatgttggccaggctagtcttgaattcctgacctcaagtgatccccccgcctcagcttcccaaattgctggtattacaggcgtgagtcactgcgcttggtctaatatttcttcagaaatgtatactgtatggtactatttcttgaaggtagcttgctgaaataataagatcagctttctgaattgccagatccagaacatcaaaaaaaaaaaatactgtgatagaaaaaaaaaagccttctggatccacccccaggaatcctagtgggttcccatggtaacaacctctttgcttacaacttgtcactgtgtaactgtcactggggttcagagaaaagccagtatagcaagaactgtgtggcattaacaactccttaataaaatgctgttgcacatttgcagtgagccagaaatagaaaagaaagtttaaaggttttaatttctgtgttccgttaattagaagctttaaaaagctgcctaattatggtaaggtgctgcagcagtgggaaggtggtgggtggcccaggctggcataggagggagaaaaagtaagctataggctgaaaatgctagaaacttcagagatttttttcttctttaatcctatcattttgaaaatgagggacatggaatgccttacttaaattcacatagagatagaagcaggaattttcccagcactgttctgttgtttctacccacacattggattcacctttcctctacttttcatagtgaaatcagtttctgaggttagcaaaggacctttacaaaagttatgcagagaaactttctatccatggaaggaatcccttctacagcatcctgggcaggcagcgtctgcctctttcctcaggtggaggtgacttgtttaattggcaaaagcccctgtactggagttcaaagggaagatagttttatgtggattccccattttaaagctatacattgtttttctctcatcataaaagagcaattgtacactgggcatggtggctcac

SEQ ID NO: 10006 - DNA, 1061 bp, Homo sapiens
ttttttgagatggggtttcgctcttgttgcccaggctggagtgcagtggtgcaaccttggctcactgcaacctccacctccccgggttcaagcgattctcctgcctcagcctcctgagtagctgggattacaggcatgccccaccatgcccggctaattttctatttttagtagagacggagtttctccatgttggtcaggctggtctcgaactcctgaactcaactgatccgcctgcctcggcctcccaaagtgctgggattacaggtgtgagccatctcgcccagcccaagacataatatgtttgtggagtatcttaataactattgcctacggtagttaatggtatatcttatctccatagaaccattttttttttcttttggtttgtgaatttgttgtatgaattggttctgagtttggttttcaacacatttaaatggaatttatatttaggtttcagtagttattagtgtgagggatactcttgaaatttgtgccaggtacttttctggctcaaactattatggatcaggcgtagggtagctgaagttctagattattactgtgaaatcaagtgctgtttttgttaatgttcatttgtctggtataagtttgctctggggctaagctagatctatggaaagacttaacccttttccagaaagcttccaacttagggaaaaaaatttttttttttctaattctgactgttccacttctgaaaaaaacagatccacagatcagacttgtaaatgatctgttttcttaagatatcttctaacagaatgggtctccagggaactgagtgacaacacacatttagctgggagtggcagttcatctccctaaacgtaatttaacatcacatttatctacacactacagttttggaggcatacttggagattgaacttatacttctcttggcttattttattttattttatttatttttgagatggagtctcgctctgtcgcctaggctggagtgcagtggtgcgatctctgcatactgcaagctccacctcctgggttcacaccattctcctgcctcagcc

SEQ ID NO: 10007 - DNA, 1772 bp, Homo sapiens
gaggcaagaggattgcttgaggccaggagtttgagaccagcttgggcaaatacagggactctgtctctacaaataaaattatttagccaggcatggtggtgcacacctgtagtcctagctatttgggaggctgaggcaggactcaactccttgagcccaggaggttacagaaagctatcattgtgccaatgtactccagccagcctgggtgaaaaagtgaaacacctttctttaaaaaaaaaaaaagaaaagaaaaaaaagaaaacaaaatgattatgcctttatgtgttgtgtgtatcgtactaaacccagtgctgtgcatagaggaaattttacagtctatagtgttacataagtactggggccttgcataaagtagatatctggtaattatttgttgactactccatgtctagtcaaatggcactttaattttatgttttggaacagttcagtattaaggattagtaataggaaaaagacttaacattttaattctgtgaatttaagtcattgtcttctgaagatggagtactttaaaagctccaaggagttatctggaaaaaaaatgtaagcagctttccatcaaaagacattatggttaaggtttgtactgtaggcctggtgtggtggctcacgcctgtaatcccagcacattgggagactgagtcgggtggatcacgaggtcaggagatcgagaccatcctggacaacatggtgaaaccccgtctctactaaaaataacagaaatttgttgaatgtggtggtgtgtgcctatagtctcagctactcaggaggctgaggcaggagaattgcttgaatccaggaggtggaggctgcagtgagccaagatggcgccactgcactctagcctgggcgacagagtgagactctgtcccaaaaaaaaaaaaaaaaaaaatttgtatggtaaaaaccttgtggagctctgatcttgaaacttcgtaatttttattgcctgaacagtcagaaggctcctagacaactctgattttggctcagttttcagtagctccaaagaataagaaaaggataatctgatattgctggcagtctgcactcttgcctttctgggccaagacatgcttttccaaataaaatcaaggaaatagtaaaccactagtaaaaatgaataaagcatccaagagtttgcctcctgtcatgtcctgttttctcctttttgtttctaggctgtttgatattaaactcatgtgccaaaactatactgtggacttgtccttcctacttcccctttcaagctgatgggaaataattatggaaagacattatgtttattatatattcattgtttttattgcgtgctatttctgtttaatagtctctgcatacatttacaagtgcaatttttattttttattattattttttgaaatggagtctcactctgtcacgcaggctggagtgcagtggtgtgttctcagctctgcagcccccgcttcccaggttcaagtaactgcctcagccttctgagtagctgggattacaggtgtgcaccaccacgcccaggtaatttttgtattttttttagtagtgacgggttttcgccatgttggctaggctgacctccaactccacctgacctcaggtaatctgctcaccttggcctcccaaagtgctgagattacaggcatgagccaccacacccggcctacaaatgcagttttttaaaaagctttgcaaacctctttactgagctaatttgggttatagatagcattgggaaactatctatc

SEQ ID NO: 10008 - DNA, 2023 bp, Homo sapiens
aaagtcattttatagcaggctttcaacaaggatattttactggaagctgtttatgtggtaaaagattatttatcccttaggtctgtatttcctagatggctagagcaagaggagcagacatcacatttcgtgtttaggaatgctcttcagcccctccatgctcatgattcagtatttgtcatttagtgcacagctaatctttttcatgaggcttttcctgtccattcattcctgtacctgatttagtattttattatttcagcaagattttaagctttttgaggatggaaactgccttactgcttagtgtattgcatatactttaggggagtggttcaggcatatagtccctactctaattataccttgtgatttagcccctcttgtaatatcttattgcaccagaggtggacacctggcccaagctgggcaaatcactttgtcctaggaatttgagattagaactgagattcaagtctttaagatacaaatagtcacctacattcagagaactcaggacataaaatcagatgctggtatgcagccaagttcaggctcgtacaggtggaagcagtgaaggtcattccgtagggagggagaagtaagtagatttcatctggaaagaagcatagatgagaaatgcagctctggagagagggcagccatccacatgcagagcaaaaatctggatgcctaaagactttccaggtgtgggcctgtttggagttcttggagtggtctagtaccctttcagttaactctagtttttatgtaagctttctgttattttcagccgaaataactttgagttagacttagtacagagctctgcacagcacttgtaaaatttgaaatttagaatcatcttgtcagggatcatggctctttggaagagtagctgggattacaggtgtgtgccaccattcatgcctggctgattttttgtatttttagtagaaacagggtttcaccatgttagccgtgactggtctcgaactcccgacctcaggtgttctgtccgcatcggcctcccaaagtgccgggattacaggcttgagccaccacacccagctgttgggaagagtgctttttcccccataccctccttagccccaggcaaaaggccgctggaggtcttgactccttcagtatatatatttgcatttggtgtttagaatgctttgccagatcaagattatgagtttatttttttaacaagttttttataattatttgtttttaatttttttaggaatatgagcctgttaaaaataatactgctatttcagataggaaacttaaagtgagccatcagttttagagaatttttgtttgtgaggcatatggattcagtcttttcttcatttctagttaagtggcgtttgttttagtttcctgattgtttcctcttaaaaaaatgttgatgggcttgagtggaacacaataatgtgggttgaatggctgttgagactttaaacaaagggtaatggtgaatggctgtgtgcccagttgatggagtctctctggtcccagctcagtaacttcatgaatgatctgtgagaggagcatcacagtggtgtttttctctttgagaaatgttaataagggagagggggaagctctgagaaagacagtttagcgcttctaacgtgattttgtttttttcctgtgatattttggtttgttaggttgaaagactttattccagagaaatgtaaacattccctgtaatactaatgagcaggaattaaaaagagacaagctagttttgaaatggagattttttttttttttttttttgagacggagtcttgctcttttgcccaggctggagtgcagtggcgcgatctcggctcactgcaagctctgtctcccgggttcacgccattctcctgcctcagcctcccgagtagctgggagtacaggtgcccaccaccatgcctggctaattttttgtatttttagtagagacggggtttcaccgtgttggccaggatggtcttgatctactgacctcgtgatc

SEQ ID NO: 10009 - DNA, 1371 bp, Homo sapiens
agctgggattataggcatgtgccaccatacctggctaattttgtatttttagtagagatggggtttctccatgttggtcaggctggtctcaaactcctgacctcaggtgaactgcccgcctcagcctcccaaagttgattgctattaatataatcctatagttaccagaacacgtatactagaattacagtacactgaaatggtcaaaaggcaaataaaatagaaataagaaaattttgatgaaaatctggagaattaagtctttctgtaattgagagttgattttttgattgtggaatccttgaaatggtttgaaagaatgatgtgacttgaatgggctttataaacacagcctggtaaggatagctgtgacagcttgggacagtggatttggggtaccaccagttaacatttctggccctgttttcctgtctttaaagtggagataccaactcagaatagtaatgtgaggattaattgaggtaacttatgctaggcactgaacagtgcctgatacagtattgataatgctgtttctttttccatgtgtaaaatgggcataccactagtctcttgggtcagtaatgcatttcagccaaatgaaataaataacacaggtgaactgcctaggagtgccatacatagatgagcagtagctactatgtcagtgttccttttgttcccttttatgagtgcattttgttttgcattttcttgtgtctgttgtggcttaagggataagatttgtgtgtctgaaatgctgtgctaaacaggacgttgttccttgtggaatacttgggtaatatggtttcctagatttcatattcactatttctactttgagagtctactgttaggaggcttctgtgttcaaagaaaactgaaaattataaatgaatattttggatttgtaataggggacacttgggtctcttcgtagtttcaagtgacaagttgaggcggggaggagggctctaatatttagagttgtaatgcagatttaagacttaatcagttttagctatttgctttgtaaactatattgtatcaagagtccttatttgccgaaaacagctttcttttttttttagagacggggtggggacaggggtccacgggtccgctatgtagcccaaactggtgcaaactcttgagctcaagcagtcctcctgtctcagcctcctgagtagttgggattgattacaggagggcaacatcatgactgccttgaagacagtttccttgatgagacctttgtaaaataactttggtcttgtcatagaattggcttagaatcttcttaaagtagaggtttctttatagaattctatagttattttttaacctctgctgtgctgtggaggccatgag

SEQ ID NO: 10010 - DNA, 1022 bp, Homo sapiens
ggagatcgagaccatcctggctaacacggtgaaaccccgtctctactaaaaatacaaaaaattagctgggcatggtggcaggcacctgtagtcgcagctacttgggaggctgaggcaggagaatggcgtgaacccgggaggcggagcttgcagtgagctgagatggcaccactgcactccagcctgggtgagagtgggagactccatctcaaaaaaaaaaaaatatatatatacacacacacacacacacacacacacacacacacacgcagacacacacacacacacgtatacatatgagagagaggggctgggcatggtggtgcatgcctgtaatcccagcactttggaagactgaggcgggcagattgcttgagctcaggagcttgagaccagcctgggcaacatagctagacctcatctctacaaaaaatacaaaaattattgtattttcctacaaattttgtaaaacttttctactaaaaaaagaagaaatagaaataaggtctctggcagctaggcaaactttatgctgtaagacttcagattcactccttgttattaacctcttaatgctccttgttattaacaatatgttccttattaacctcttaataacctcttaataactcttgttattaacctcttaataatgagtattggagactttatggttctgaatgaaggtcagtatttatttgttcttttgagacagagtcccgctctgtcgcccaggctagcgtacagtggttcaatctcggctcactgcaacctctgctgggaggggttcaagcaattctcgtgcctcagcctctcaagcagctgggattataggtgcccgccaccatgcccggctaatttttgtatttttagtagagatggggtttcttcatgttggtcaggctggtctcgaattcccgacctcaggtgatccgcccacctcggcttcccaaagtgctgggattacaggcatgaaccactccacccggtcttaatttttgtatttttattagagatggggt

SEQ ID NO: 10011 - DNA, 1040 bp, Homo sapiens
cggcccggtccctcacctgtgaagagttgcacaggaacctcgtctcgtactcctcgttcatggtgatcaccccgcgcacgttctcgtcctgtaccagctgccgaggcaaagaggtggctcagcaaagacggtggagaccccagcggcccgacagggacggagcggcggggacggggcaggggcccgggctccccggcccggctcacctggcgcgtcaagctccgcaacggcagcgcgcccagcagcacggtggggtcgatgcggtggtaccagtcccggtgcgcccgacccggcaccttcccgcggaacagggtgtagagcagcgtcgggtagaagagcacccgcgccaggccggcctccagcagcgcggtggccgccatcccggcccggcgcagcggcgacccgtcggcccccgcgctcgcggtccggacccgcgagaagagcaggcgggtgccggggcggggctgccagctgcactaggcctctcgcgggctcgcaccgggtgacggcggggactggcctggactctgggggactggcgggactctggaggagggcccggcggcctcggaggagggaccgaggtttcctgggcgggaaactgggaccccggcgaagggagagcgcgtcgcaggccagacacgtgtgagccctgtagcgtgggaaactgaggcccccgcctgtggccggtgacctccctcctccgagggaggggggttgtgaccccaggtgagaggggcaggaaggacccctgcgtgtggaactgtgactccggccgagggaggaggggacactccccccaaccctcgaccagaggaagggggcagtgacccaggtgcgggtgtgaccccgccaaagggaagacaagacaaggagaggctgtgtggcggggtagccctgaagaggacagtggaagggcttagagctttcaaacagaggagctacctgggtgagggcctgatcccagggtgaacaggggtcctgggttgaggtcgccttcctcctcccctcccctgtcctagggcagggctccctccttc

SEQ ID NO: 10012 - DNA, 1066 bp, Homo sapiens
tggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaagggatatgtgtgtctgtgttgaattccaaaggggtgactttgaaggggtgagggtgtttcattccctcaggggaactcattacgtaccatcacatggctcagtctgcagcagtcctgactgcagcccatgctcccacttctccagataggatccctactccacagggccagtgagattcagattctgacagtggcaaagagccagaggtgagtctccttttttcaagtgctaaatgttttttgagttgtggtgctaaatattattaggcacaatattaggtacataatagatttttgttaaaatacttctttagccctattcaagaaaa

SEQ ID NO: 10013 - DNA, 1032 bp, Homo sapiens
ggagataaaaggcacagacgcgcgggatgagccctgaggagctctctgcactgggcacgccgctgcgcctgaccccggtctcagctggctgcccgtgctcacccctggtcagcgccgaggcccccaagatcccgcgccaccacagcctggctaccgccgccgccgccatgttactcagatgcagactaggcagcggacggaaagacagcaggacacggagccccaagggcacggaccggaaacggaagtgtgcagcagatcttcttccgggcggacgtggagccggaagcggaggttccgggctccgggatgaaaggagggaacgcaggtgagaaagcgagacaggcaggtagggaaatcgtgaggtgagcgtggtcctagctccttgtggcagagcctagagagaaggcgaggacgctgaagaaccaggcgggtgagaggaggggagggggcgggcgttttgggttctacgctacacacccctcccccgctctctgagccaagcttttgacgagggcgggcgggcctgagcgggaagaacggtttccctggcgaccgtttccaagacgactcaaggtggagcggggacattgcacagggtgatgggcctcccagtgccccggcctgggggcggatggactcaagttctgggacgcagccatagggagtctttcgagcgagcggggaagtgtgggggaagcagctcagaagagagcaaatgtaagacccacggatatcccaggctaggcttcatatggagcgtcttaactccatgcgctgggaaggagaggacctggccactaggccggggccaggggtcctttttgtctgattctactgcccctgagcttcactagttttatgccccagttatttggttagtaaggcttttacgatcacaggcctctcccagccctttgctttcatatattgacctaaatcccaagtcttttgttaacattatggaaaggaattattccgtgttttctcaggaaaacacccagagttggaacttttatttatatcattagc

SEQ ID NO: 10014 - DNA, 1030 bp, Homo sapiens
aaaaaaaaaaaaaaaaaaaaaaaaaaaaagcctcactgggctttatagaaaagctagtggggtcgtggctggtctaagtgcagcagtattgcaactagttgatcacaaccagttaacagatttttttttccttctccctttccactgcttcacttagcctttaaaatgtatattaaaataaaagactgggtgcggtggctcacgcctgtaatcccagaactttgggaggccgaggtgggcagatcacttgaggccaggagttcgagaccagcctggctaacatggtgaaaccccatctctactaaaattacaaaaattaggtatggaggcgcatgcctataattccagctacttaggagactgaagcaggagaatcgctgaaacccaggaggtggaggttgcagtgagccaaggttgcgccaacgtactccggcctgggcaacagagcaagactgtctcaaagaaaaaaaagaggctgaggcaggagaattgcctcaacgtgggaggcggaggttgcagtgggcaaaaatggtgccattgcactccagcctgggcaacaagcaaaactccgtctcaaaaaaaaagaaaaaagaaaaactagctggtcaagtggtagtaattgtaggtggtcattttaaggtactgtggcagataagggagcaagacaggagaacagattggttagtagtgactgccaagcctgttgtagaagttctaattgtcatgattttttggtaggataggcatcctcgttttatgtgagactctaattaagcaactcactcgaaatcatagtcaggaattttcagggctgaattcaaaccagggtctatcaaattccaaggtttttttttttccttaataattcttccaggacatgaagccagtcgaggcatttttattctttcgtggaggctataaaatgctaaaattgtagccagtaaaccacattgtgtttttgtgtttgtttgtttgtttgtttgtttttgagacaaggtctctctctgtcttgcagtggctgatctcggct

SEQ ID NO: 10015 - DNA, 1048 bp, Homo sapiens
ccagaccctagaaatgtggtttttgatgcctctcatctgtatctgtacttgggaccattcttgctttgtaatttttctcgtcttttgctctgccaaatatgaatatcagatagcttagcaaaatcatttttttaagctagtcaaagcaaaacaatatttaagtctcttctgcaaagcacctcgcaaatcttttgcctccctgcttacagttatgaatagtaaggtgagccactgagggtatagccgacctgcattttaaacataggaacaaaagtcactggagatcagcttcaagtacagctgtgttaacgagaatgaactaggtatgcgggctggattctggtgtttgattccttttttacttccctagaatgttttgtgacctctaattatttgacaaacatttgtactgaagagcctgtcatgttactgatcacattttttggttcttatttttattgtttcttcatgtaggggtcttgttcctcgccttctaggtgacatcctttctttgtggctgtgtaactcactggcctacctcgtcaatacctatgcactggacagtggggtaggttgtgaccttcgtgagatgtgctcaccttggctttaatctggcagctagattagcttttaaagtaagatgggccgggcgaggtggctcacacctgtaatcccagcactttgggaggccaatgtgggcggatcacctgagatcaagagttcgagaccagcctggccaacatggtgaaacctcgtctctactaaaaatacagaaaaaattagctgggcgtggtggtgcgtgcctatagtcccagctacttgggaggctgaggcaggggaattgcttgaacccaggaggcggaggttgcagtgagccaagatcgcgccactgcattccagcctgggtgacagaaggagactccatttcaaaaaataaataataaataaataaacaagatgacagtttgctacatgccagactgaacaattatatagctaaaaattatcagtcaaattttcaaatgctaatgaaatgagcatactgttc

SEQ ID NO: 10016 - DNA, 1021 bp, Homo sapiens
aggctgaggtacgagaatggcttaaacctgggagatggaggttgcagtgacctagatcgtgccactgcactccagcctgggcgacaagagcgaaactctgtctccaaaaaataaataactaactaaataaaaataaaaatggttacttggtagcactttcagggagctcagacaggagttatttgtttatttatttgttgttgtttttgagatggagttttgctcttgtcacccagactggcatgcaatggcacaatctcggctcactgcaacctccgcctcccaggttcaagcgactgtcctgccttagcctcttgagtagctgggattacaggtgtccgccaccacacctggctaatttttgtgtttttagtagagacagggtttcaccatgttggccaggctggtcttgaactcctgacctcaggtgatccgcccaccttggcctcccaaagtgctgggattacatgcatgagccaccacgccagcccaggagttacttaataggacagattaagagtcacaacaataatcaaaactatgtcctacagcattcattctgtcaagtatctgtagtgttaaaaatcctgggtatattgtacaaagaccatggtaatcattaactatataaaatggacttcattagctgttaatgacagcctgtgtttttttgtttgttcgtttgtttgtttgtttttgagatggagtctcgctgttgtcggcctcggctggagtgcagtgacacaatctcggctcactgcaacctctgcctcccgggttcaagtgattctcctgcctcagcctcccaagtagctgagattacaggcgcccgcccctacgcccggctaattttttagttctagtagagacagggtttcaccatgttggccagactggtctcgaactcctgacctcaggtgatccatccccctcggtctcccaaagtactgggattacaaggcatgagccactgcgcccgaccgacagcctgttcttctaacatgaagttagcttgtaattc

SEQ ID NO: 10017 - DNA, 1027 bp, Homo sapiens
agttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcct

SEQ ID NO: 10018 - DNA, 1017 bp, Homo sapiens
aaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttaaactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagatttt

SEQ ID NO: 10019 - DNA, 1030 bp, Homo sapiens
tccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttgg

SEQ ID NO: 10020 - DNA, 1001 bp, Homo sapiens
gtgcatcaatgtggcttaatcatagaaacaataatatttactttcggagggcaaagcggaaagatcatttgaggccaggagtcaagaccagcctggacaatatagcaagacactgtctctaaaatgttttttaaaaattagccagtgtggtggcacacggatataatcccagctactcaggatgttgagggaggaagatagcttgagcccaggagttcgaggctgcagtgagctatgattacaccactacagtccatcctgagtgacagagcaagaccctgcctcaaaagaaaaagaaaaacagactggcgcacggtggctcacgcctgtaatcccagcactttgggaggccatggtgggtggatcacctgaggtcaggagttcgagaccagcctggccaacatggtgagaccccgtctctaccaaaactgcaaaataggctgggcgtggcggctacttgggagactgaggtaggagaatctcttgaactggggaggtggaggttgtggtgagctgagatggcaccactgcactccagcctgggcaatagaatgagactccatcacacacacaaaaaaaatgtggctgggtgcagtggctcatgcctgtaatcccagcactttgggaggccgtggcaggtggatcacgaggtcaggagatcgagaccatcttggccaacatggtgaaaccccgtctctactaaaaatacaaaattatctgcacctggtggtgctcgcctgtaatcccagctacttgggagactgaggcaggaaatcacctgaacccaggaggcggaagttggagtgagccgagtttgtgccactgcacttcagcctaagcgacagagtgagactgtctcggggaaaaaaaaaacaaatacatatgtatgttgtgcttaaagatctgtccatgaggaagctaaaggaacataatgactggcaccatgagggtagaggtcatatctggtgtggctgtgatggcagagaaacctgggaagactc

SEQ ID NO: 10021 - DNA, 1063 bp, Homo sapiens
aacgtggtgaaaggcctctactaaaaatacaaaaaattagctgggcatggtggcgggcgcctgtaatcccagctacttgggaggctgagacaggagaatagcttgaacctgggaggcagaggttgcagtgagccaagattgtgccactgcactccagcctgggtgacagtgcgagactccatctcaaaaaaaaaaaaagtcgtttttaccttgagtattcagctactgaaaacagttaatatgaatgtgtgtgcaattgaatgtatgtgcaggtgagatttgtttcagaattaaatgagactaaattattttgttctttataggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagtaagcttttgaaagttacttgtagaatgttttttcctcagtactactctacagggatcattgtgcttgacttacaaccattattgggattttgtttttcttatcccatcatctaggtatgttgaagcttatgcagcaaaaactttaaactacagaggtgtaggttttttggtccttgatgatacttttggtagttatcgggggaactcacccccaatatttcaacctaggttctttctattttccataagtgtcggccagctgagaaatagaaagagtataatgagaggaattttacagctgggccgccgggggtgacatcacatatcggtaggactatgatgcccacccgagcctcaaaccagcaagttttttattaagggtttcaaaaggggaggagg

SEQ ID NO: 10022 - DNA, 1057 bp, Homo sapiens
cctcggccttccaaagtgctgggattataggtgtgagccatcacacctggctgtctctccttttttttttttttcttgagatagaatctcactctgttgcccagtctcgagtgcagcggtacgatctcgcctcaccgcaacctgtctcctgggttcaagtagctgaggctacaggtatgtgcacccgagtagctggggctacaggtatgtgccaccacacccagctgatttttgtatttttggtagagacggggtttcaccatgttggccaggctggtctcaaactcctgacctcaggtgatcaacccacctcggccttccaaagtgttgggattacaagcgtgagccaccacctcccttttctttttgtaaagctttcaaagagaagaaaggcaaattagaagagactggggagcttgtataattggaagatgagggttttgatttgagaagcttagaatgagtatctagaattttttttttctccctcgagactgggtcttactgtcacccaggctgaaatgtggtggcgtgatgttggcccactgcaacctctgccacccaggttcaagtaattctcccacctcagcctcttgagtagctgggattacaggcatgtgccaccacgcccgataataattgtattcttttttttttgttttttgttttttttgagacagagtcttgctctttcacccaggttggaatgcagtagcgtgatctcggctcactgcaatccccgcctcccagattcaagcaattctagtgcctcagcctcccaagtagctgagattacaggtgcccaccaccacatccagctaatttttgtatttttagtagagacaagttttcaccatattggccaggctggttttgaacttctgacctcaggtgatccgcccgccttggccgcccagaatgctgggattacaggcgtgagccaccgtgcccagcctaattttttttatttttagtagagggagatttcaccatgttggccagcctggtctcgaattcctgacctcaagtgatccacctgtctcagcctcccaaagtg

SEQ ID NO: 10023 - DNA, 1071 bp, Homo sapiens
accagcctggccaacatgatgaaaccccgtctctagtaaaactacaaaaaatcagctgggtgtggtggcgggtggctgtaatcccagctactcaggtggctgaggcaggagaattgcttgaactcgggaggctgaggttgcagtgggctgagatcgcgccactgcactccagcctgggcaacaagagcaagactccgtctcaaaacaaccacaaccaagagtacagtatataggccaggcacagtgactcacgcctgtaatcccagcacattgggaggccaaggcagacagatcacctgaggttgggagttttgagaccagcctgaccaacatggagaaaccctgtctctactaaaaataaaaaattagctgggcgtggtggcgcattcctgtaatcctagctacttgggaggctgaggcagaaacatcacttgtacccaggagggagaggttgcagtgagccgagatcgcgccattgcactccagtctgggcaataagggcgaaactctgtctcaaaaaaaaaaaaaaaaaagtacagtatataaaatacaaaatatgtgtgaattgactgtttaggttgtcagtaaggcttctggtcagtagtaggctattagtagctaagtttttgggtaatgaaatgttatatgcagagtttcaactgctcaggagccagcatccctaaaccctgcattgttcaagggtcaactatacatgcaatttagacagtagttatattgtaacatatacagttacattgttatatactatacatagtagtaacgttatatactatatattatatataataattacattgctgtaaaaatattgtaaagttccttctttttagtttattttcagcattctaatctgctaaaggttgtctggtagcacttcgaaaatgttgtacaacagtaagagaaatgaaaatgcttaaataagaatgtggtttttttcttgaatgttgtatttaaatcagcttagttccaagctttttttttatcaagttcttttgctatttccacagaggcatgatatccttccataaagagccgaggctctagatttgg

SEQ ID NO: 10024 - DNA, 1022 bp, Homo sapiens
tcctgggttcaagcgattctcctgcctcagcctcccaaatagttgggaatacaggcgcccaccaccatgcctggctaatttttgtaatttttactacagacggggtttcactgtgttgtccagtctggtctcgaaattttgggtcaagtgatctgcctgcttcagcctcccaaagtgctgggattacaggtgtgagccactgtgcctggccctcttctttaattctgaacccacagatttaatgaaagttaagctttttattgttggtttcttttcatcatgagcttccgttacttggtgagctgtttttgattattttttgactgttaatgtttgggaagatattttgccacttgctaccgtaaaatgtaaaacgtgttgcttttacagtattgtgacctttgtatttgttattttattttacctccacctgagccgtaagagttaccattactaattgctataatttcttgtctggtccacctacccataatgtataggtgatttggggaactggtcagctctttcaagctcagcaagacctactacatcgaacagctcccctactcttatcttattacctcattaaatggggaagtgagtgcttggcaactgatgttccacttgacacactgtgagtttcattatcccaattatttaaaatgtaaattgtgagtttaattatttttccccttgtcttaaagggaaaaagttttagtgttttgtttttgtttttgtttttgttttgagacagagtctcgctctctctcacccaggccggagtgcaatggcatgatctcggctcactgcaacctccgcctcccaggttcaagtgattcttctgcctcagcctcccaagtagctgagatttcaggcacctgccatcatgcccagctaattttgtacttttgtagagatggggtttcaccatgttggccaggctggtctcaaactcctgacctcaggtgatttgcctgccttggcctcccaaagtgctgggattacaggcgtgggccaccacg

SEQ ID NO: 10025 - DNA, 1124 bp, Homo sapiens
taaaatatgctttaacaattaaccgagctaaaaattctaaaaagcaaaagtgttcttctcatgtttgttttgtgtgttgtttatgaaaaactgagaggaaatttgctatgcatagggactgtatcttatatgccagagtgattatcttcattcctttatctggttctcttgtttcataatgtatttagcttataggacatatagaacttgccttacgtattctcggtagtaataagagttttgtaattgtccttatagagaaaatgtgatggaggatatttgtagtaaactgcaagagattaggaacccaatccatgcaattggactacttatacgggaaatggattatgaaacagaagtggaaatggaaaagggattcaatccaggtaaatgacagaacaacaaatgtgcctctttgattaaaacaatgatgcattcaactccatttttcttctttttacagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtaagtactgcttgagggaaaacttgtaaaatctaaaacctgttataggcctacaagcacttaggagcaaaatgtcagccctactagcacagatacttttgtcttggttcactgctttattctcccaagcttggccttatgagatgctctataaatatttttgaattaagaatgaataagcattgtaatccttgtgagagtatagattaagagcatatatggaggggacggtggggagggagaacatcagaaagaatagctaatggatcctgggcctaatacttaggtgttgggttgatctgtgcagcaaaccatcatggcacacgtttacctacgtaacaaacctgcacatcctgcccatgtaccctggaacttaacagtagattttaaaaaacatacatgaagcagattgctttactcttaacctttgtatgtgtagtagtggaaaattttcccaagttggctctcccaaaatgtagtattattagtaactatgaatg

SEQ ID NO: 10026 - DNA, 1083 bp, Homo sapiens
taaaaatacaaaaattagccgggcgtggtggtatgtgcctgtaatcccagctactcaggaggctgaggcaggagaatctcttgaacccaggagacggaggttgcagtgagccaagatcatgccattcactccagcctaggcgacaaagtgagactccatctcaaaaataaataaataaatataaataaataaaataaactagccaggtgtggtggcacgatgcaccctattagactgaggcaggaggattgcttgagcctcagagttcaggcttcagtgagctatgaatgtgtagtattttatgagtataaaattataacacaatttaatgttgattgtacctaatgttagatatatttggtatctaatattttttaatgtagatgatattagtttgcaagccttaggtagttaaaaatacattttacaaaacaatttttggctggtcccatgataatggattgtcagaacttaacattagtgtcactaaagttggcatacagccctccactgctaaatttggccaaaaataaaaaacaaaccattttgaagcaaagacttgtctaacccctgaaacatctgtagaggctcccttgggacagagcttgaagaccactgaactaattgaaccctctgggtccctgataaccctagagcctaaggtagaattctgggaatgattgccctccagattgacctcaggccatacctgggaagataaaaaaagcactccttgtagatggcatttgagcaaagtagtcagaaagcacaggctgcagagttggagcagggttggaatcctagttgtgcaacttactagctgtgatataccctcagcctcactgtgtacatctgtgaaatgggagtactatatccttcaaagaattataaggcatacatgaataatgtctaaaactgcatctagcataatatctagcaaataataaatgcagaataaaagttagttattctttgtatttgatgccttagtgttaaaatgacattaaagattatgggcttgagatctgaaacaatgagtttcaattttaggaagataattattaaaacatggtaagcaaactt

SEQ ID NO: 10027 - DNA, 1050 bp, Homo sapiens
ttgttgttgttgttgagatggaatcttgctctgttgcccaggctggagtgcagtggcgtgatctcggctcactgcaacctccgcctcccaggttcaagcgattctcccgcctcagtcccccaagtagctgggattacaggctcacgccatcatgcctggctaatttttgtgtttttgtagagacggggtttcaccatgttggccaggctggtctcgaactcctgacctcaggtgatccaccagcctcagcttcccaaagtgctgggattacaggcatgagccaccacgctcggctgctctttttttttttaacttttgttttaggtttgagggtacatgtgaagctttattacataggtgaactcatgtcatggggctttgttgtacagattttctcatcacccaggaattaagcccagcacctaatagctatcttttctgctccactccctcctcccaacctccaccctcaagtagaccctaatgtttgttgtttccttcttcgtgttcataagttcccatcatttagctcccatttataagtgagaacatgtggtatttggttttctgttcctgcattattttgctgaggataatgacctccacttccatccatgtttccacaaaagacatgatctcgttcttttttgtggctgcatatattccatgatatatatgtaccatgttttattcagtctgtcattgaggggcatttaggttgattctatgtctttgctattgtgaacagtgctgtaatgaacattcatgtgcatttgtctttatggtagaatgatttgtattcctttgggttatatacccagtaatgggattgctgagtggaatggtagttctgtttttagttcttagaggaatcaccacactgctttccacaatggttgaagtaatttacagtcccaccaacattgtataaatgttcccttttctctgcaacctcaccagcatctgttattttttgactttttaatagccattctgactgctgtgcgatggtatctcattgtggttttgatttgcatttctctaatgatc

SEQ ID NO: 10028 - DNA, 1060 bp, Homo sapiens
atagaaacaggaaataaccgcaattattaaggtcagttttgtttgatgctgtagtatatatggaggccacattccactacaagcaatggccggggtatggtgttaatttttattatagtagagttaattgcataaaatattgtcctaaataaatggcctatcaagtttggaaatgtctctatgtaacagaatcacagtgaaatttggattttgttatgctgttttttataaatgtacataatgtgatttggcatgcaaaagtggtccaaatctgtttatccaaaattttcaaatttggtgagttcacttggacactgttctcatatatttcagtagaacagtcagtgagaaaagcataaacttttcaaacaaatgtctctttttcaacaggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgat

SEQ ID NO: 10029 - DNA, 1258 bp, Homo sapiens
ggcgtgggaggcattctctttaccttctcctgtccaccaccagtaggacctgttcttccttggggctgttttttatagccagtgattatagccttgagggttatcttcttggaaatttttctcactagccctgagattaataagcttctggaaggtctgaattaggagatgggcttctgtcctggtaagctaggcactgaattgcagaggggaaggagatactatccttgcccttagggagctctcgtctcgcctgatgctatttagtcctccactttttctccaagttaagtgatctaaataatttatttgggaaaatgtatgggttctgtgggaaatagctgaaggcatttgggttcttatgtaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggtgagtagcagcagaggaggggtgatgcctctcatgggctggcgagaggtgctgtcttggggtggcgagtctcatgactgataggggagcagtatgagccattggtgggactttctgtatcgattttgcctgcatcaggggagaggggagatgggagaggtcttattcttaactgtttttttctgtgtgtgagacaggagtgggatcgcaaggctgaggatgccaggagggactatgaaaaagccatgaaagaatatgaagggggccgaggcgagtcttctaagaggtgagtgtcgagaacatggcccagtcactgatttttgtggcagacttttttttttttaacaggccgaagttgagcattggaaagttaaagacagcagagatgcttctgactgcagtagggtagtgcttctcaaacctgggtaggccattgcccaagtatgggtgacacaatagggcattcaagtcactggggaaatatggcctcttttcctggaccattttatttgaaggtatgggggaacgaaaaaaatactattatggagtgcagtgcacagtttgcatgaactctaaaagataaagcaagaaatatcaagtaggttttgcacattgggctgctttaggctgtgccctctgattcttctggtgtactcatgatactctcccttggtgccctccaggctgacgcagctatttacgttcagagtgaaatgggct

SEQ ID NO: 10030 - DNA, 1034 bp, Homo sapiens
ggtctgatgggccagaaataggccaagtgcccacccttagagcctgtggttggggtaagcccttcctgagtgggggcaaggtggttcccaacagaaaattgggactctgctctcttaatccagaaggattgtaaaagaatgtcgggcagcaaaaaaaacacccaacaggagtcctctagttcagcctgccacatgcttatgaaggtttatgaaggtttaatgagcaaatacttgtgaaagtgccttgaagactgtccagcagcatacaggtgtaaggtagttgcattgtttgaggagtttcacatatatcagacaagactgtcaattacaggggtaggcactgggttggactgaagttggttttcctctttttgtagtaactgattatcttttcatcagaagactgtaggggccaatccttttgtagttcataaacataatggttgggtgttacgtgcgtgtgtgaaatgtgccaccctccagccttgttacgatgttgacacattacccatctgacatggaaaaaaaaagaagacaaaaaagactatagggtagattaaggtgattactccgagggaagtggtgaagtggatttgggccatgttccaggcatgaatgaggcagtgtttctgccagtggtgtcctggggatggactaggacctggtttggccatgcccagggagatccgctgaagctcattgatttgtttttcattcattaattccaatcaagtaaccaattgctgtggctgggtctggagagggcatggctgaagccaccacagtgaatgggagaaagcagtgttggggattggtggtggatactgtcctctggtcttcctcccttgccccttttgggtgggtatctttggatttgtcttcctcctgtcctgaggccgtggggtcctgtcttccctcctcaagtctaagcctggcttgttctctggcaggtttgacagcaacgcctctgccagctcctccagtaatgagggtgacagtgaccgggatgagaagaagcggaaacagctcaaaaa

SEQ ID NO: 10031 - DNA, 1063 bp, Homo sapiens
ccaatatcacacatacaggaggtgtgagaacccagctcagtggccctgaagttggagcatttgccctcaaggctggggaccaaagagcccatgcaaagagcccgaacgcttaagcaccaccctgcctggccagcggggaccatggtggggaggggataggagaggtgctggcctgggctggagagggccacacacccctgatactccccgtctcgtggacaggttcccatccaaccactttgggacgctgacaggcctgcagtccctcatcagtgctgtgttcgccttgcttcagcagccacttttcatggcgatggtgggacccctgaaaggagagcccttctgggtgagagcgagggttggtgtggggggagcaggagccactctcctgggggcaggggtagggccttgtatgtggtgccatccctcactcatctcagccagaggcacctcagaggtctctaatctgcaggtttccaagttgtctgccttttagaacccctcacggagtgttaaaaatacagattccccagtcccctgaatcaggatatctcagcctgactgtaggagtctgtttttgtttttaatttattgttattttatttatttatttatttttatttttattttttgagacggagtctcattctgttgcccaggctggagtgcagtggtgcgatctcggctcactgcaagctccgcctcccgggttcatgccattctcctgcctcagcctctcaagtagctgggaccacaggcgcccaccaccacgcccagctaattttttttttttttttggatttttagtagagacggggtttcaccatgctagccaggatggcctcgatctcccgacctcgtgatctgccctcctcagcctcccaaagtgctgggattacatgccttagccaccgcgcccggccctattgtttttttttttttgtagagaaggtgtcttgttctgttgcccagtctggagtgcagtggtaaaatcacagctcactgcagcctctgattcctgggctcaagcgatcctccggccccagccttctgagtagctgca

SEQ ID NO: 10032 - DNA, 1166 bp, Homo sapiens
cgggtcaccctggctgagctcccctcaccatacgtttccctacccacagagacaaatgaacagcaacaaaaggtggcagagacaggtagggctatgaaagcagggccctggctcacgcccaccccactgcaacccgcttctcagggggcgggactcctctaggcctgggcccacccaggtaacccttttgtgggatgtaagagtctgggttcagaggaaggctattttggtgctctctggcctccgctggaaggggtgatagtgtccactgagtgccagttcctgaccccactgcccttcccatcctgcccagttgggttctactcctccgtcttcggggccatgcagctgttgtgccttctcacctgccccctcattggctacatcatggactggcggatcaaggactgcgtggacgccccaactcagggcactgtcctcggagatgccaggtgacctgcctgtacagggatggtgacagcaagtggtcaggcagtgcttttcattttctctgtgcgtttacatccagcaacttgttgctttctcccaagaaccctaggagatcaggggtacctccccattttacagatgaggaaactgaggctaggaagggacctggcttgcttaataataagaatagctaatgcagagtgctgactgtgcacttggcaccttgccttgtttagtcctacaacacctctttgaggtagatgcgttaatatcttcattttgcagttgaggaaaccgaggtacagggttgcacagttaggtcattcacccaagatcacacagctttcagtggcagcctccagaacctgtgttataagggtacacgctaaagtcttgttagggctagaataggtagagttggtatattagatatttattgctgtataacaaatcaccccaaggcttggcattttaaaacaacaaacacttctcatctcatacagtttctgacagtcagaaatcagggagagactcagccggctgattctgagtcacagtctctcatgaagacatagtcaggctgtcagccagggctgcagtcatctgaagggctgactggggttggagaatctatgtcagttcaattacccccatggcctctccatagggctgctcaggacacagcacctgctttcccttgagcaagagggctaagc

SEQ ID NO: 10033 - DNA, 1055 bp, Homo sapiens
tctccacagtgcctgcttcactgcgtcctgcaccctcatggccctggcctcccgggacgtggaaggtgagttgtctgtcctcttgtggccccacaagaaaagaataggtgggatgaaggcggatgtttaccccagctcccgcccttggcttcccacagctccccaaatgccctcatctgctgctttcccctttccagctctgtctccgttgatattcctggcgctgtccctgaatggctttggtggcatctgcctaacgttcacttcactcacggtgagtgtcacaggcctggcctggcagcagagttcccccgagtggggtgagggcagagtgagtggggtgagggcagtatgaatgggctgggggaggggcctgtggacgcagatcactagatcaagtgagtgtgtgagaaactgtgcaggtggctgcaaagagcaggtgtgaggctgtgtgtgtgtggatgaggctgtgtgtcggggtgtatgttaatgtgtgtgtttgtgtgtacagagcccatgaatgtccatggagctctgttctaggtcctggactacagcacaatcaggactgaccgagtcatcctccctgctggaggttacattttgggggtgaggggcacagataacccaataaacaagtaaactaataaattatgtcagtcgtcataggtgctgggaagaaaataaaactgggtaacatgatcttgagggggagggagcagcttgagatagcgtgtgcacgcttgccatgtcgtgggagagtgggtgtgtgaccccgtccctgtgaaagccatgagttggtaggtgtgtttgtgagtgtactaggttgaaccatatgaaattgtcgacacctcgtcgtgcacatggcttgacctattacatgtggtgagtggtgtatgtgtgttgctcaaagtgtgtttatttatgtgagtgtgtaaacgcgttaaaggcttaggagtgttaaaggcttagggaggttggaggggaaggttcctggccgggctggctcggactgtttatctctgagaagggctgcctgactgggtggttttggc

SEQ ID NO: 10034 - DNA, 1027 bp, Homo sapiens
agacggagtcttgctctgtcacccaggctggagtgcagtggcgcgatctcggctcactgcaagctccgcctcccgggttcacgccattctcctgcctcagcctcccaagtagctgggactacgggcgcccaccaccacgcccggctaattttttttttgtatttttagtagagatggggtttcaccgtgttagccaggatggtctcgatctcctgactttgtgatttaccctccttggcctcccaaagtgctgggattacaggcttgagccaccgcacctggccgatcttctaactttttaaagagaagcaagacatctggatttttatgtgataactcctgattttaaactggcacccaattataatttacaacactataagggtcaacattgccagcagagcaaaacatgggtgggggcaactgctggtcaccggtgtgcagcctctggtctaaaatcatctttgtatttcttcttgctttacgcattgtcccagcacagtgctgttgtatagtaaatatccagtaagtgggtgtagaatgaataaaccaatgcagataaacctgtagagaggccgggcacagttgctcatgtctgtaatctcagcactttgggaggcccaggcaggcagatcacttgggcccaggagttcgagaccagcctgggcaacagttgaaacctcatctctacaaaaaatacaaaaagtagccaggtgtggtggcatgcacctgtagacacacctactcaggaggctgaggtgggggtatcacttgaactcgggaggtcaaggctacagtgagctgggaagtcaaaggtgcagtgagctataattgcaccactgcactccagcctgggagacagagtgagaccctgtctcaaaaaaaaaaaaaaaaaaaacctgtagagaaatgacagtgatcataaagatcactaaattatagggctagcctgatccccaaaggctgtgtggtccaacccctaagtgcttcctggaggtgtctgagcactttccccacctccttggca

SEQ ID NO: 10035 - DNA, 1049 bp, Homo sapiens
gggatttgggtcttgtcattacatgatctcactagcaggcagggaaccaaccaaaatgaaaagtgacccaagcttactaatactccacagcagacacgtaacactctgcccattatgttgagaaccaagcgcctcggtgatctcaggctccatctgaagagctgatccaggtagggctcaacagtgtattctaggtcaattttgtgtcgaaagagaatagccaactgaaaacacatggacagtcacccatgtgtttcaacaagattggttctttaggtcagaagcctgtgatcttttgagatgaacttctggcaagcaaaggtaaagcttcccttctctttacaagaacttttgacctgcttcggtccttagttaagacaataaagttatttagctgatgtgaaaacatttctaaaacagcaacaaaatgtagcctaaaccatcaaaatgtgaaaaacaaaaacaaaaaacacttttagtttttccagctggttaggtaactgaaaacatccatgagaaaacctgaattaatgtaatctgactttaaatttaacacagttaaaatctgttgccgtgaaagccaaggttgttcctgaatcagtgggtggaaaaccactcattcagctggtttaaatccaggatttcagaataagagtttgctgggtttttttttttttttttttttttttgagacagagtcttgctctgttgcccaggagtgcagtggcatgatctcggctcacggcaacctctgcctcctgggttcaagtgattcttgtacctcagcctcccaagtagctgggactacaagtgtgcgtcaccacacctggctaatttttgtatatatatatatatattttttttttttttttttttttaaattttggagaaagagtcttgctctgtcgcccatgttggagtgtagtagtgcaatctcagctcactgcaacctgcacctcctgggttcaggtgattctcccacctcagcttcccaaatagccaggattacaggcacccataaccaacgcccagctaatttttgcattttt

SEQ ID NO: 10036 - DNA, 1104 bp, Homo sapiens
tacccaagttgaaacagaggctgttactcccctgctatcccactctcgaaaccagctgtccagcagatgcctagatgagggtcatttctcagatagttggcatgtcttacagttttctcaagtaatgcctacctataggcaagctcagttttgtgtcatttgctttatgcagcatcagcatcacctggggacttgttagaaatgcaaaatcttgggccccatcccagacccattgaatcaaaaactcagggtggaagacccagcaatctgcattttatcaagttcccagatgaataatgcacactaaagtttgagaaacactattatgctacacaaaattgagacaggtggttgcaggtatttgtttttcttaaatagtaggacttacggtattcagtttcccttgaatagaccctagacatcatttgacagagtaaataaaaagtaaagtgagctcttctgtgtctcaggggtttagaggaagaacacaggacagcatataaaattactagtttagattcagatctgtaggcctcaaaattctgctaaattgtctgctttttaaagaaagcaaagttgaacaaagcaaggcatgtgaaaaagtgatgaggtaatggaaaaactgcagctatatggtttggttcccaacacctagctgcttctattgtcatgttgtgatctggctgctattatcaaagctgatttctagaaatagtgttttctagatagtctgctttacagaacactgtgcatgctttgcttacatgctgtcttagtggggaagaggtagaactctcatatttacaaaattattgggctatttgtgctcagctgatactgtcagttcccacagagatgtcaaagtcaggatgcatttaagttagaggtataacattgaagttaggctttgaagttaggcctagatttcaatctcagctcctctactgactagtcaggtgtaaattctctaagctgtctttttgcatttgttaaatgaggctaaagcctacttcagaagtttgctctgaaaaaatctcattttaatttagtactgtagacagagccttcagtggaaccagtacaatgcagatgatccataaatgg

SEQ ID NO: 10037 - DNA, 1085 bp, Homo sapiens
aaagcttttaagctaacctggtggcgtgatgggatgcacctctggtcccagctactccagaagctgagaagggcaaatcgcttgagttcaggagttcgagttggaggttacactgaactatgatagtacctttgcacgccagcctgggtgacagagagcttgtcttaaaaaaagtaaagaaggctacggtgttgtagaggaaagatcccagactttgcaattatagtaagtagcaaagctaccaattaattatcttagcaagttgctattacatgaacctatttcaccattggtaaaaagggggaaaaaatctatttcacagggccataattatagttccttacgtattgcttttttatagtaggccttttgtaaatgtttaattcaaggtgaataaatcacagtggtaaaaaaggtgaagagttaacctcagtgttactttccaaagaaattgctataaggcagtgtatctaggcagggattatgcttaattgagatgcacacagtttaacatctggtgtcaaacctggcttccttctttgtgaccaccctatagatgtttgcttttgggaccactgagtaaaccaggccctgagaatccaagcatgaatccacttctgccctacttttaaggatttacgttccatgcaggaaagcagataaccataatttctgaataaataagacaacaaaatgaaatggatgctggtcaactctgatgcaaattttaagaaggagactatgcctctgtgtctcccagcttcacagaaaaaaaaaaaagaaaaaagaaagatgctcagagtggggtacctacacttggaaaaaacgcaagtataagtctgccattcccatgaatccaagatgaatcctggcacagagtaggtcctcaaattttgcaaaattaattttgaatctttatcaccctggccaatgcactgccataatgcaaatcttactatctacctttctatgtcagtcacatttttaaaactgtgtaacctatgaaaaaaaaaaaaaagctcaccaaatcaaaagagaggaagtgctaagcaaatacaggaaccaaaaaggtttatagaggctgc

SEQ ID NO: 10038 - DNA, 1045 bp, Homo sapiens
gtattttccatcgtgaatagtatcacaatgaacatataagttcatgtgcttttttcatagaatgattcatttccctgtgggcatatatcagtagttctgtttcaagttatttgagaaatctccaaactgttttctatggtggctgaagtaatttacattcccacaaatagggtgtacatgctcccttttctatgcagtcttgccaccatcagttgttttttgactttttaataatagtcattctgactgttgtggaatggtgtctcattgtggttttgatttgcatttctctgatgattaatgatgtcgagcatttattcatatgtttattggccacttatatatcttcttttgagaagtgtctgttcatgtattttgcccattttttaattgggttcctttttgcttgttgaatttattaagttccttatagattctgggtattagacccttgtgagatgcatagtttatgaatattttctcccgtatgtaggttgtctgtttactctgttgatagtttcttttgctgtgtttatttcttagttgtcaattttttttctgttgcaatcttttttgagtacttagttataaattattctccaaggtcaaagtccagaatggtgttgcctacattgtctgttaggattattatagttttaggtttgacatttaagtctttgattcatcttgagttaatttttgtatacggtgaaagtaggggtccagtttcattcttctgcatatagctagctagctatcctagcaccattttttgaatggggagtccttgctccattgcttttgtggtcaattttgtgaaagatcagagggtgtgtggctttatttctcggttctctattttgttccattggtctatgtttatgtgtttgtatcaataccataatgttttggttactgtagccttatattataaagtcaagtaacttgatgtctctggctttattctttttgcttaagattgttttagctatttgtgctcttttttgattccatatacattttagaatgattttttctagttatg

SEQ ID NO: 10039 - DNA, 1056 bp, Homo sapiens
tagagataacattagctctagaaactcttgcacaactttcaagtcctcacctcaatgcctctggctggatttttgttggctggatgacttcacacaaggggtgctcacaccaaatattgaacccagagatagagtatttcatagaaatatttctgctattgtgggatcattctaatgtccacaatcctacctaaagctaagcctagaagatgattcaaactttgctcctctaggcaacacaaggtaagtgaagtgtgaacgttgctttgtgctgcacttggccagcctctggactctagctttattaagagaagatgacagttgccaaaaaagtaacttgttgctaaaaatttaccaaagttggttagttaagattgggttcaagtagcaatgatcaacttgagttactctgagcatgaacaaagtgttttatttatttgaatataaattaaaaatataaagatatggattctcaaatacaagaatatagattgacccccaggaaaaaggatagaccctggaaatggaaaactaccaggggctctgggaccactttttctccatgcttgttttctctggacagacaggcttaaaaagtacacacacacacacacacacacacacacacacacacacacacacacagtggtaaaatatatataacataatatttattattctaaccacggtaagtacaatgcagcggtattaaatatatccacaatattatataaccattctcattgtttcagaggcgcagactgcagagccgcccaggtcctgagcctgggagggcggttgcagctgcacctctgggagctctcgccctgccaatacgcaagaggcagggctcccgcttgtcccctgctcccctggctccctgtagcttgcagcccccgggatgcctccgaaatgggaacgggcgctgacagcggagagaagccacgcagtgggagcaggcacttccgagcctgtgggaggcagaggggtcttcctgggcccccaagaacacagagacgcgtgatcccgagagccgagagccgtggcagggcggct

SEQ ID NO: 10040 - DNA, 1050 bp, Homo sapiens
tgcttctactctcagggagctgagctcaatatattgttgagtaacacttccaaatcatagtgtccatctttacattatcctaagcatgcttgctagtccttgctaattctagtccactctttctcccattaacatcaaaagccatttaaaccctaactgtttcccataaaatcctacttctttttctcgacactttcttggcatactccctcacccacttactgctaaaaagtgattttggaaataggaaaaaattttacctcttccaggaaacagacattcaaaaataacttgccaactctctgctctttttttctaaccctgtgtactcccatataaaattagtcctcacttaacattgtcaataggttcttggaaactgcaatttcaaatgaaacaacatataacaaaattaattttaccataagctaattagtataaagaagagttaagttcctacagcatatttctggtcacaaaaacatcaccaaacttataaataaagaacccaaacacttctaatataaaacaatgaactaaatggaaactgcgtatacatttaataaatattaataaaaacaagataattatttacctaatttttggtgagtctgtgtgatggtggtcacagtagtggtgggttaaattgagaaataaatgtttgcaaagcaaaagttgtaaggagcacctcttgcctctatgaagttaaaattcaatcacaaatatggtggcctcactgagtcctttggcacagcattgtttattgtcattcatttgtatgattatcatagacttcatgaatttttgttttattatgaatgtttcattcattcattcattcattcattcatttttcaactggctttttccagttcaggggagcaagtgactgaagcctgtcctggtagctcagagcacaaggcaggaacccaccccagactggacacctttccatcacagggcgcacacacacacacacacacacacacacacacacacacacacacagagtctcactcatcctgggacaatttagacagagaaaatcca

SEQ ID NO: 10041 - DNA, 1110 bp, Homo sapiens
gaggactggatcctttttttcaatgcagagagttcccttccagcccagcaaatgtctagaaatgttgtctgggagctggggcctggaacgggggcctcacaactctatttggtgccttatcctgttgtggctgagctgatatccaagatgcaagatgaagttcgccttactgtttctttttcattcctcaagcagagggaaggagtctctttagcagctgtgagctatgcagcctggggttagggaagaggtgataccagctctcctttgactgacccagctggtgtctcagtatgtcaagtgtccccccagtccacaatttctgagcctaattcagcactaggactcacttaagagttgcagtccttatggtttacactgcctttcacgtttacttggaaacacagagaactttaggccctctgtggtgaggttttcagtcactgaagttttgactgctgggattggtgattcccctcgggttaggactggtttaaatgctccctctgcctccatgggcaggtgtcagctgagtttggtctagttttcctttgtgtctaacatgacagcaatgagttcaatgcctcataattgctgtgttctttctacccccgtgcccagagatatactgtgcaccacactactgctactgaggttgggagggatggggattggtgattcaagactgttttttactgtctcttcagtgcctctttcagggatatgaagtcaaaaccaggtactatgagtgctcacttgatttttggctctcatgaaggtatttttttctgtgtagttgttaagttggtgccttgtggggtatggggaaatgattagtggagccttctattctgccacttgctttgcttctcctccccattataaactatataaaaaaaatttaatggctcaagaaattacttaagtaatactcagtatagaaaaaaaatatgtgttctctcaactatccacagtttgctgtcaattatggaataaaacatatgtattgactagttgaaatggaccattttttaaaaaggatgattagtttactgtataactctataaactttgatatgtatttaacaaaataatcgtttacaattatga

SEQ ID NO: 10042 - DNA, 1314 bp, Homo sapiens
aaaacttctggtgattatttattgctcactaatgttcctttctttctcaatgttctgttctttctttagcatttcttgtaggaaaggtctgatattgatgaaatccctcagctcttgtctgggaaagtattcttccttcatttttgaagaatatttttgtgagataatattctagggtaaaaggtatttttccttcagcactttaagtgtgtcatgccactgtctcctaggtttccactgaaaaatctgctgtcagatgtattgtatctccattgtatgttatttatttcttttctcttgctgcttttatgtttctttctccttgacctttgggagtttgattttaaatgccttgagatagtctttgggttaaatctgcttggtgttctacaactttcctgtactcagatactgatatctttctctggtatggggaagttctctgttattatttctttaaataaactttctaccccatctccatctctaccttctctttaaggccaataattcttagatttgccctttcaaggctattttctataacctgtagatgtgttttgttgttttttaatttttttattttgtatcttttgaaagcgcatttttaaatagcctgtcttcaagctcactaattcttttttctgctttgttaattctgcgaataaaggtccctgatagattcttcagtatgacaattgcatttttcagctccagaatttctgattctttttaactatttcaatctgtctgttaaatgtatctgatagaattctgcatttcttctctgtgttatcttaagtttctttgagtttcctcaacacaggtattctgaattctctctctgaagggtcacatatctccatttctccaggattggtcccaggtgtcttattaagttgatttggtgaggtcccattcttctcaatgctgtagatgctagtagatgttcttcagtgtctgagcactgaagagttaggtgtttgctctagtcttcactgtctgggcttatttgtagccatccttgttggaaaggctttccagatatttgaaaagatgtaggtatcatgatttaagctgtctctacttcagagagcatcccaagcccagtaatactgtggtttttgaagactcataaaggtaccgcctcaatagtcttggagaagatatgggagaattctctggattaccaggcagagactgttctgttttcttcccttactttctcaaaaaaaaaaaaaaaaaaaaaaagcctctctctctgttctgagccaactaaaattgggggtggagtgacataagcactcctgtggc

SEQ ID NO: 10043 - DNA, 1034 bp, Homo sapiens
caaaacctagattgcagcaccatctatttacagcgtggtttactgaatattttaagcctacaattgagacctaatgctcacgaaaaatatattcttataaaaatattactgctcattgaaaaagcacctattcattcaagagctctgatggagatgtacaaggacattaattttttttcatgcttgctaacatacatccattctgcagctcatagatcaaggagtaatttcaactttacaagtcttattatttatcattctctaaggctatagctgcaatacattgtgatttctctgatggatcagggcaaagtaaattgaaaatctcttggaaggattttccattccatatgccatttaaaacattcatgatccatgggaggagatcaagctatcaacatcaacaggaatttggaagaaggtgattccaatccttgcagataactttgaagtgttcaagatttaaatggaggaagtaactgcagatgtggtggaaataacaagagaactaaaattagaagtagagcctgaagttctgactgaattgctacaatctcatgataaaacctgaatggataagaaattgcttcttatggatgagcaaagaaagtgacctcttaaaatagaaactactcgtggtgaagattttgtgaacattgctgaaatgataacaaaggatttctaatgttatgtaaatctatttgataaagctgtagcgagggttgaaagggttgattccaattttgaatgaagttttactgtgggtaaaatgctaccaaatagcattttgatttcagacaaatcttttctgaaaggaagagttaatcaatgcaacaagcttatttgttgtcttatttttagaaattgccttagctaccttaatcttcaggaagtcccaccctggtcagcagccatcaacactaaaataagaccttgcaccagcaaaaaagattgcaactctttgaaagctcagattatccttagcatttttagcagtaaattattttaaaattactataggtactttttaaaga

SEQ ID NO: 10044 - DNA, 1250 bp, Homo sapiens
actagtaagcaattcagtaatgtggcaagatacaaaatgaacatacataaatcagtggtgattctatacactaacagtgaaagatctgacaaagaaaatcatcctgtttgcatagatacaaaacataaatacttaggagtaaacttaaacaaggtggtaaaagacttatatagtggaaattattaaacataaatgaaggaagtgaagaaaacacaaataaatagaaaaatattccttatttacagattgggagaattaatactgtcaaaatgacaataatggcccaagtgatttacagattcaatgcaattcctatctaaataccaatgacattcttcaaaggaatataaaacaccaaaaaatgtatgtgtaatcacaaaagatccctaagaacaaaatcaatcataagcaacaagaacaaagctgcagatatcacactacctaacttcaaaatgtactatgaagcaatagtaatgaaaacaggatggtactagcataaaaacagaaacatgaagtaatggaacagaatagaacatccagaaataaatccatgcatttaaggtgattgatttttgacaaagttgccaagaacacatgaatgaggagtgaacagtctctttaataaatgctgttgaaaaaactgcatatccacatttggaaaattgaaattagaccttatctcacaccatgtataaaaatcaaccaaaaatggtttaaggacttaaaggtaggacctgagactgcaaaaccactagaaaaaaacacaggagaaaagcttcctgatattagttggggcaatgatttttggatggaattcctaaagcacagataacgaaggccaaaatagacaaatgggattacatcaaactagaatagtttctatacagcaaaggaaacaatcgacaggaagaagaggcaacctatggaatggaagaaaatctttgcaaaccatacatctgaaaagaggttaatatttaaaataataagaaacataatagcaagaaaacaaataatccaaattaaaaatgggcaaaggccctgaatagatctttctctctctctctctctgagtttttttttctttttgctagtttataataatcttaaaaactctatcacacccataaaccacacaggtgagaggatgagagagagagagaatgaatgctacaatatgtggacagagtggggaatccaggtattccctagggtagtgtggaatggaggcagggagtgtgaataggaggctg

SEQ ID NO: 10045 - DNA, 1047 bp, Homo sapiens
cagcaaaaatggaaactcaacataccaaaacttgtaagatgcttcaaaacatttacattgaaaaaaaagaaagatcttaaacaaccaaatgttacacttcacggaactataaaaagaacaaactaagcccatagttaatagaatgaaggaaaaaataaagatcagagcagttaaattaaatagaaactataaaaacattaaagaaaaaccctgaaatttgatcttttgaaaagataaagaagattgacaaacctttatccagacgaggggaaaaaaagaaaaaaagataaaaataaaatcatacataaaaaggagacattacaacttatatcacaaaggatcagaatagactattatgaccaattatatgccaacaaattggaataatctagaataaatgagtaaattcctagatgcataaaacccaccaagatgaagaaattgaaaatctaaacaaaccaataatgagtaaggacgttaaataagtaaaaaaaatattccatcaaagagaagcccaggaccttatggcttcactgctgaattccaccaaacatttaaagaagaactaatgtcaatctttctaaaacccttccaagaaatcgaacaagagggaatacttccaaagttattttacaaagttgttgttaaccctgataacaaagatagggacacttcaacaaatgaaaataataggcaatagcactgatgaacataggtgcatcaataaaatattaatactagcaaactaatctcaacagcatgtcaaaaaggtcattaatcatgatacagtgggctttaacatagggatgcaaagatagttcaacgtacagttctataaatgtgaaatcccacattaacagaataaaaaacaaaatccaatgatcacttgatagatgcagaaaaagcatttgataaagctcaccatgatttcctgattatgaactctcaacaaatgaggtatagaagaaatgtagctcatacaataaagacaatatatgataaacccacagctaacattacacttaatggtgaaaagtgaaaaacatt

SEQ ID NO: 10046 - DNA, 1026 bp, Homo sapiens
catatgcaacattaatctgccttcctgtatttcctctgtaggacttgtggagcaaggaggactgacagaaacaagtaaatcgttctgcctgttgaaggagtcataaaatcctgcctttacccaggaggcttgtgtcatctgccagcatttgtaaaactgtgccccaagtagggtaaacttttagatgcttcacagttcttggcagtcttttctggatggagaatgtctttagtcttttctcaatggaaaaccagaatgctccttttaaaagaaaagctagattttgtcattcttttgtgcaactcctgcaataactcccaatctcattcaaagaaagagatataaaagccttataagagccctctaagttctccatgacttagactccagtcacctccctgaaatccctccagtcacatccctgacctccatctctttagcctctctgcttcaagcacgtagctgtcctttttcttctgcatgcattctgttttatcattagacctatagaaaactctattaccttctttaagtcttcacctaaaagccacctgctcaatgaggtctcctttgaccatcctattaaaaattacaactgttcccctagtctctctgcaatgctcctgtgccccattgtcattctctgcctgtaatttttttttttacagggtctccctctgtcacccaggctagagtgcagtggctggatcataactcactgcagccttgacctttcaggctcaagcaatcttcccacctcagtctccggattagctgggactacaggcatgaatcactatgcccagctaattgttttattttcattttatagagatgcaggcgggggtctttgtttttcaggctggtctcaaactcctggttatagttttataaccttctgtgctaaactctggtaccttaaaatatctagcagagacaaatataaaacccagacaaaaatgtatgctgacaattctgaagacatttctatttttattttacaataattttaatgctatcttgcta

SEQ ID NO: 10047 - DNA, 1044 bp, Homo sapiens
ttcacagccgaattctaccagaagtacaaggaggagctggtaccattccttctgaaattattccaatcaataaaaaaacagagaatcctccctaactcattttatgaggccagcatcatcctgataccaaagcctggcagagacacaacaaaaaaagagaattttagaccaatatccttgatgaacattgatgcaaaaatcctcaataaaatactggcaaactgaatccagcaacagatcaaaaagcttatccaccatgatcaagtgggcttcatccctgggatgcaaggctggttcaacatactcaaatcaataaacgtaatccagtatataaacagaaccaaagacaaaaatcacatgattatctcaatagatgcagaaaaggcctttgacaaaattcaacagcccttcatgctaaaaactatcaataaaataggtattgatagaatgtatctcaaaataataagagctatctatgacaagcccacagccaatatcatactgaaaggacaaaaactggaagcattccctttgaaaactggcacaagacagggatgccctctttcaccactcctattcaacatagtgttggaagttctggccagggcattcaggcaggagaaggaaataaagggtattcaattaggaaaagaggaagtcaaattgtccctgtttgcacattacatgattgtatatttagaaaaccccatcgtctcagccccaaatctccttaatctgataaacaacttcagcaaagtctcaggatacaaaatcaatgtgcaaaaatcacaagcattcttatgcaccaataacagacaaacggagagccaaatcatgagtgaaatcacattcacaattgcttcaaagagaataaaatacctaggaatccaacttacaagggatgtgaaggacctcttcaaggagaactacaaaccactgctcaaggaaataaaagaggatacaaacgaatggaagaacattccatgctaatgggtagggacaatcaatatcgtgaaaatggccgtactgcccaaggtaatttat

SEQ ID NO: 10048 - DNA, 1022 bp, Homo sapiens
gcgccactgcactacagcctggaagacagagcaagactctgtctccaaagaaaaaaaaaaaaaaaaacaaggaaaaaaagaaattgttgtaaagtacacataacacaaaactgtttaaccgtataattcacattcacaacgtacattcacaatgctctacaagcatcacccccatccatttccagaatgtttttgtcatctcaaacagaaactgtacccattaaaacacaattactcgttccctgtatctagccactggtaacttttattttactttatgactctaggaatttgcctattctaggtacttaatataaatggaatcctataatatttatacttttgggtctgggttatttcacatatgttgtattacgtgtcagaatttcattccttaactggaataattttgctttatatatgaaacataagtttaaagtacactgaagagaaataataaatttgtgaatgacagttagtaaatatgagttgcacacagacaattgtcactgtgaagactatagaaaagcaattataatgaatgatgggtaaaaaaagcaaaatatataacgtgtatatatcttcccaaaatatgcatgcacatggacaaggacttgaagggaataaataaacatgaaaattgttttgggtagtgaaagaatgtgtgatttatttcttattttagaattttctgtagtaccattcacatgttttttatttttatgcaagattgaaaaaaaaaatggaagggactggaaccatagttaaagatgagaattatgaaaacagaataaatgctatttttctttattttttttccccagcagtcccaccagctatcaagtttccccttttataaggtagaggaaaaacctccccatgtcccatgattgtttacatgcctaatcctgtcacccacagccatcaacaaagagtgcaaggcagattattctaaagagaataacagttgacaccctgtactgcccaactcattcttagccaaaagggactttactgaggac

SEQ ID NO: 10049 - DNA, 1309 bp, Homo sapiens
tgaatcagaacctcaaagtgttttctgaccactttggaactggaaattagaatgcatgttttccagaggaatgagattacacaatgtaatacatatgaaatgcatacctggcatgaagtaagaacaatatttaacatatgttagtttttttaattgacttcataataatcaacatgtcatatatagatttaacaattaaatccaatgatgtaaaaataattaaaaatgtgaagaacttacaacaaacttagttaatgtaagagaagtaaaccatggattagatatttgaaacaatcattagcaaattagttaatacagatgtttgaaattttttatctttgaaggttaaatagttaactaatatgtcttaagtaataggcaaggtgaaacattttgtcttgtctgaggtcaaagtcctcaaagttaaactacgttctgtagctaggtgaagcaatgtttaaacaaaggcatccttttgcaagagctcagaatttcagaatgtttgaatactcaaggaaattttagtaaatagaactggatctctgacatgagtctatcccctgtttgactctgctgtttttgtagttgtaaaacaaacaaacaaacaaacaaaaaacctggtctttttttttcccacctccaacagagctttctttgctgtttctcacctgatttaactaaaattacccatacacttgtgttttactattgtcttctcctttaaagttttggtaaaaattttgtaagttttaattcaagatctaccatgctgtatcacaccccacaaaaaacttgtgttccatctgtcttgagaatattgtagccttggctgatacatgagaacaacccccacactaatcagctgccacatctttgtccaaatacctctcctatccattccctactccatccccttgcaatgaccttagttcagggcctcctcctcctcatacttaatattgctcttatgaccccatcctggcctcagcttctaacatctacccaaataaaagtgttctctacccatattcttaacatcaacatttcttttttaaattaggaagctgctaaaatcctgggtagacccctccccatactctttaagaaactgttggccgggcacggtggctcacgcctgtaatccccgcactttgggaggccgaggtgggcggatcacgaggtcaggagatcgagactatcctggctaacatggtgaaaccccgtctctactaaaaatacaaaaaattagctgggcaaggtggcgggcacctgcactcccggctacttgggaggctgaggcaggagaatg

SEQ ID NO: 10050 - DNA, 1037 bp, Homo sapiens
aaactatactacaaggctacagtaaccaaaacagcatggcaccaaaacagagatatagaccaatggaacagaacagagccttcagaaataataccacacatctacaaccatctgatctttgacaaacctaaaggaatccctatttaataaatggtattgggaaaactggctagccatatgtagaaagctgaaactggatcccttccttacactttatacaaaaattaattcaagatggatcaaatacttaaatgttggacctaaacccataaaaaccctagaagaaaacctaggcagtaccattcaggacatcggcatgggcaaggacttcatgactaaaaccccaaaagcaatggcaacaaaagccagaatagacaaatgggatcttattaaactaaagagcttctgcatggcaaaagaaactaccatcagagcgaacaggcaacctacagaatggggaaaatttttgcaatctacccatctgacagagggctaatatccagaatctacactgaactcagaaaaatttataagaaaaaaatcaaacaaccccatcaaaaagtgggcaaaggatatgaacagacacttctcaaaagaagacatttatgcagccaacagacacatgaaaaaatgcacatcatcactggtcatcagagaaatgctaatcaaaaccacaacgagataccatctcacaccagttagaatggtgatcattaaaaagtcaggaaacaacaggtgctggacaggatgtggagaaataggaacgcttttacactgttggtgggagtgtaaactagttcagccattgtggaagacagtgcggtgattcctcagggatctagaactagaaataccatttgactcagcgatcccattactgggtatatacccaaaggattataaatcatgctactataaagacacatgcacacatatgtttattgaggcactattcacaatagcaaagacttggaatcaacccaaatgtccatggactggattaagaaaatgtggcacatatacaccatggaatacta

SEQ ID NO: 10051 - DNA, 1073 bp, Homo sapiens
aaagtgctgggattacaggtagaagacaccatgcttggccctgagaggtaattttactggtagacatctgccttggtttttgtttctaagccactgttctaatatctcagacaccgaacttttcctgtaaattggcctcctttcagcccctgcaggtgacccctgccacctcaaagggcccttaatctgtgagtgtcagccttgtccttttcctccccttccccctccaccccttttcccagaagagtcctgtgctttacagaaagggtgggaacatgtggcactcatgcaaggtgccaagtactgaaggagtgttttaaaatactcacgtttcctttcaccctataaaagcagccctggtgtctgaaatggtcagttcctcaggccctttgggcctgcctggctccactagtccctgtttgtgtgcctacctgttttggtggttggataataactatctgatactcgggccaggagtccaccagcacctccatgttgaaggggttcctatgattgatgtgatacacacagccatatatatgaaggagagatggaaaggactaggagaggttgagatccctagagatggggatctggatgtgaagaggaagagaaaaacggaggtcaaaagacagtactgggactaagtcagtaatggtgagatgagcagcatctccaggaccatactgatggacgtgaagttaccagcaagcaggcagaactcacagataggtgtccttgtgataccaaagagctactgtgcactagcttggcacttgtcaatgctcttagcacttacattgtatggatttattcagtgttcacaacaattttaagaggtaggtgctaatattattcccatttcattgatgaaaagaccaaaggtaaaggcacagaaaagtaaagaaacatgcacaaagccatctgactctcccactgccccctcaccttcagggactcaggaatgctcacggccagggattcgtacagggccagcagcatctggcaattattcagcaggatcattttgtgggatgcttcattccttgagcccttcaagaagaaacctaaaa

SEQ ID NO: 10052 - DNA, 1044 bp, Homo sapiens
atgagaaaagactagaaacaaatacagaaatagatacaaaaatatataaacatgttatatgacaaaatagagatttatgtttcagtagtggaatcacttaataaatagtactaatgtaattagccagccataaggaagaaaagtataaaagaatgttaattcatgctattcaaaaatatattccaagtagaatgaatattgatatgtcaaaagtaaaaattaactcactgtaagattaaataagaaaacacttgtatgatcttggagtaggaaaaatcttcctaattattaataaaaaaaacaaaaactcagaggacatagtgaaaaagataatacatttgattacatgaaaattcaaaatttcttcatgtcaaaatctccatcaatcaagtagaaaataattctaaattgggcaacaaatttgtagcatacaccttgtgttagtatccctagtatccaaaacacttacagaattttaagaatgacacaaaaccccagtgtaaaaatggtcaaacaacataaacagttcagaagtaaaccccaaatgactgataaacatatgaaaatataatatgttgaatattaatagggaaatgcaaattaaatctacaataagatgccatctttcacccaccagtttggcataaattgaaaagggacaacattcagtgctggtgagaatgtgaggaaacaattcttccacacattgctaatggaaataaaactgtggaatcctttgagaagataatctggcagtgcctacttaggataaggtaaactctgacttggagatatcccttttggaaatcaattgtattgagaaaagtttccaggatgtaaagacatgtatacaaggatgtttattgaagcattgtttttagtggcaaagaagtatgaacaatttgaacccaacagcaagagaatgactgcctaaatagcattgcattgactctatggaatgccacagttattaaaatgaatatgttaatgctgcattgattcacccgaagggatgtccatatgtgaaaggcaaattaaaaagtg

SEQ ID NO: 10053 - DNA, 1049 bp, Homo sapiens
ctcaagaataaactatcaaaattgactttcaaaaaaacagaaaacctcaacaaactaatagaaaatattggaaattaaatgaaatatctaccctttaaaaagtggacaagtattatggcctcctgctccatccatattgctacaaagaacaatattttattcttttctattgctgcatggtattccataggaatatatgtaccaagtatttttttaatccaatctactattgatgggcacctcggttgatttcatttctttcctattgtgaacagtgcagcaatgaacatacaacaggatgtgtcattttggtagattgagtcattttcttttggctatttacctagtaatggcattgctgggttaaatggtaactctgttttaagttctctaagaaatttccagactactttccacagtgcaataatcctaagcaaattaatgctgtaacagaaaactaaatatcacatgttctcactcataactgggaactaagctttgaccatacatggacataaatgtaggaacaatagacactgtggactactagagggtggagggaaaggggctgggttagaaaactaactattgggtatatgctcactaccagggtgatgagatctgtccgtactccaagactcatcaacgtgtaatattcccatgtaacaaatctgcacatgtaacccctgtatctaaaaggaaagttgaaattaaaaaataaaaagtagccaaaatcagattattttatatttaaattctacataagccaaaaacaaacacataattttaatactagactttggtaacagatgaaaagctcctaatgccaaatctggcaaggaaataacaaaaagagaattattgcccatattcccttatgaatacagatacaaaaattctgaataaaatattcggtagtatatcaaaaggatgtgaacatgaacagtttgttttagaaaggccagaatggctttgatcggaagatcttttagtgtaataaattaaaggaggaaaaatttcatgactatataaattgccaaaaaaaaaga

SEQ ID NO: 10054 - DNA, 1027 bp, Homo sapiens
agattgttctacctctcccatcccccagagtttctgtgaatttacattcccaatgtaatgatattgctaatggtattagttgaatgctaattcaactaatgaatgaatgaatggatgctaatggtattagctgaagactcaatttgagaagcactactgctagcccatttcttcagactcctccaagggagtatctgtttccagtttatgatttcacaatttttcaaaacttcttgtgatttttgaggagctttggagaatatatgatatacatttgtgtaagaatccatgttgtcagtcatatcctgtataggatggtgaaagatcagatcattcccttgaactttttcttcacctcccactgattgcaattatcagaaaaatgaaaattcaaaagaaaattttaacagtggcctacgatggctgcagttgggcacatggataataaaacctaggcctataagctactgctgaccacttgcctgtgtaactggagtttgttaaatgtttcactgacagatactggttataaacctacttattagataaagaacaaagacaggatgaaattagtcaccctccaccaggccttaagatgcctcacctttctttctacccactcaactgcacatttaccttattttatatacagcatcaccgagcacccagcacaatcaagattgcaacaattgcttctctccctgcttctctcacctcttgggccacacatatcccctgttatatatactgtgccccacgtaacctcctgtgggacacattctgggttatactgagtctgtgttgctaggattaaatttttaaacttggctcaaagtaaatttaactgtgatttctctaatttttagtgcctactgtttcaccagacacctagaatctgtagtgtcctagagggtggagggaaaggggctgggttagaaaactacttattgggtactatgctcactaccagtgtgatgggatctgtccatccagggcttgggcaagatactttagtgaataccaacat

SEQ ID NO: 10055 - DNA, 1029 bp, Homo sapiens
gtcttcttttgtcatctgtattatctgtattagcttttgcatgttgagtgaaaaatatagctgttttcacattaccccaagttcccgagtttattttttacgtaagaattttccaccctttgaaattccaaatgacatgtttcttctctttttcagaccatgctttcatttcagtcaatgtaccaaatcagccaggtcttagtttagaaatctgatttgtccaattcatactaagatgtaacagatctaccacagccttctaagatgaattggagttttttttaaagctccatgacctacacaattccttaattgctggaactgcacactttaaaatcacatcaaatataaacattcaattttgtggaggcttactttttatggagagatgaggataggtgttggttaatactggtagactttactcccaaagccaactccattaagatttcctttgtttttttaaatctagattatcagaaagaatgaaaatgctttttttttttttttttgctatagctgcaatgttcacagtaatccaagttccaatggcagggtgacagagcagagccaaaggaagccacattttgttcgtgaagtgtaattcttttttaagatcagggattcagaattgtaatataagtatttaattagaaagttcttatgatagtgcttggcacgtgtcctttccatcatctgaattttctgctttttttatctggctcactcctactcactctccagtcctcaccttagtagtcacttctcccaggaatgcccctgaccccttaagatagcagtgctgcaaacaccaagcgctgaacttataaccatacttgcaggcaacaccttgccctgtgctgtgcttcactaatgacgaggaagtaagaaagagtaggagaaaggaggcacaacaagtgtcatttccatagcagaggccacaaggccagcccacttgattctctggagattcttttctgcataacaatgatgaaaggtagcctaggaaagccatttgtcttaggcttt

SEQ ID NO: 10056 - DNA, 1119 bp, Homo sapiens
gtttcataaatagtttttatgaagtcagggaatatgcttacaaagggattaccaaggccctataacacatgagtttgggggcacagggagatcaagatttagaataaagttaggtgagatctagggccaaaggatagcaggaggatgtgtgtgtgtgtgcatttatgtgtgtgtgtgcgtccgtgtgtgtgttggttggggcaggtgggaagcctttggagatggctgctagtggggtgctgtgatctctaggccttggtaggtccttgtgaagacacacagttctaaaaggttggcacccttataggtttttaaatatttttgttatccacaggggtgaccttggacatcattacaaaaatataaaaatttcacccctgggcatgcaggttacccttctcatggtggcatggcaaggcttgatttataagagtttcttttggactgtccccaattttttcctttaaaaatgggagctccttcagggtgaggaaggaaggaggaaatcatcccttctaacctactttctcttcttcattccaaggactctagaaaggcacagcaggtttggttttgaaatctgtggaattttagtgctgtccattctcccaagtggatgcctttactgaaggtaaaaggaaagactgtttgctgtgtcaagggaagtttcatatgcaaatcccaagactcagatgttatttcagaggagttagtgtccatagtaaagtaaaactggcccgggttcatctgcctacaagggcaactgtatgaggcaaatatgagggaactggcagaacaggaggtggaatcttccttggagaaagagtaaagagaattctaggtggagaggggatcaaggtgtggaccaaacacatatctgtcttcttaattcctatatgaaacgttggaaaagactttagaaaaaacagtaaatatgtcatagcaggaaaacaaagagcagtctgggccaaaatagaaaccgttaaaataaaaacaaaacaaaacaaacacgtttaagtttgaaaacgacagaagttaagaagtggaaagttgcctaggatatgcttttattgcagcctctctaataaacccgtccctactccatctttgtgtccttgt

SEQ ID NO: 10057 - DNA, 1137 bp, Homo sapiens
ctaaaatgtggattcatagggcatcagtcccctgagtgtaaaagaaaaaatatttgcgtatttataaggctgcagaaattatattcttctgagggtcaaataaatatatttgtggttttgaaagtcttcacatattatatcagtagcatatttacatccaggaaatattggagaaagaattttattttattttttttaagatggagtcttgcactgtcgcccaggttgaagtgcagtggcgcgatctcggctcactgcaagctccacctcccaggttcacgccattctcctgcctgagcctccggagtaactgggactacaggcatcccacaacgcccggctaattttttgtatttttagtagaggcggggtttcccagtgttagccaggatggtctcgatctcctgaccttcgtgatctgcccgcctcggtctccgaaagtgctgggattacaggcgtcagtcactgcacccggcctagagaaagaattttaactaatcaaataggaacagagatctcagataagagcagataaaaaaaaaaaaaagaggaaacaatagtgagttaaaaacaatctggccaattttatgtagaaagttaactctaaatggacaatgttaggctctccaggaagtgtaataaaagctttaaagaagggttctttaaatagaagagacacactgcaagggaaattctgaccatctggaactaaaacagccagagattggtctcagggggatgaatggtagaagaataaaaacatttgtctcacttagcacactcatctggatgtgaggaggcagcagaacagggaaatgaatctattggaagatgtcgtcttattggggtacaggagaaaatggagaataactggtactttattttatataatagtaaagaaatttgtgttcaattatgagcattagaaacaaatactagtgattgaataaaaattactaagggaatattatggataattaagttaataagagaacttgatggataagtgaattaataagactccatagtggaggcaatttcctcttttaaaaagcagtatctcttgaatatatacaggatatccttttcaaaagaaaaaaatgtatatggggaaacaattttcactcattttctagg

SEQ ID NO: 10058 - DNA, 1031 bp, Homo sapiens
tcctgctttcgcaccttccataggttttttcgcaatcgtctttctatttaatcattttctgtttcatagattaggaaacctcaactaagttgcccaaggacagcccttgaataattttatcttctgtcagacaccaaagcctaaggtctcttattttgcagaggctgctttgtcaggatttcaatgcatgcatgtcctgcgaatcactgctcctcactcactgatccatcctgctgtccacgcgttcattcactcattcatttcttaggggtcatctacaaggcatggggctagttgcaactaaaaatacaaaagaaaagggactctgctgtaaagcagaggaggtttttttaaatgatttacacagaattccggtgctccgcatggtttcgatctccccccaccccccaaaatactactgatacctattttgttccacacaattcgatggactctgaaaatacagagaggggtgaaatctatccttgcctttcaggagcttattgccgtacgcaagagtaatctctgagctttaattttacataccaaatttttaacaaattgagcatcaactatatatgtatgtgtgtgtatatatatatattctgttgtaattaacatgttaaataaatattaggcacacttaatttcttattttttagatgaagatgaatctaaatgctggttcaagtatgtcctttgttcaccctagtggaccatcttgggtgattcctggagtgctttctcagactgcaaccctaacccgctggtatgtgcttggctctgttccttctttctgcagctgtctgtcaaatgccagtcttttgtggaggcccgtcctaaccccttcctgtttcctctcctttttgtctgctcgtatctgaggcctcttttcctatttatttgttgttctttctccctccatcatcttctgtcgtcaaatcatgtgttgtttttcatatactacacctgagtttataggaaatatgtttactgtttttgtttttttaatttttggtttagtttctgcc

SEQ ID NO: 10059 - DNA, 1170 bp, Homo sapiens
actgcaatttgatatcagtgacagggtagggatgctcagggaatctgttgagccaccaaggaagcctcactttcagctaatgcttacatggggctgtggaagttgtccagcatccctgaggacagagtgtttgccctgaaaaagaacattcccttggcagaaagcatcttgttggctggattttattataaatgtgatgagaatacttttggccaagtaactggtcgttgggtcattttgtggtagtcaaacccacaaagaagaaaagccctcacatggtcgggtgaggtgggaatggatcaagcactaaggccaggtctggtgaagttagggagtaaggccagtgtttatggaaagggattccttcatgaacccctaaaagatgcttctaaactctaacagtaggctgatgtctgtatttagagttgcaaacaacatgttctgggaatacagaggaaggcaccactgcctctaccttgggagtatatcacagagaatgagatttatatttggacttgatggatgagagatgagtaggagtttgacagaagaaaagagtggaactgtctggatgtacaatggcagaagtggcaggaaggactgaggagaattggcttctggggatgtgtcagacataagggcctgggcaccacataatggagcttgcaatggggtatgtgaaagcttagatgagatggtttttttcctgtcctcctgtgggttcatagtgggctcacctcactcactcctgctaacaacctgcccctattgatagatagctgaaatggggtctctaagcctccagcaacagcttaggagccagccttgaagtactggcagctaacacttcccatatagaccccgtagtccatcctatcttaggaagacaatgcactcatggggatggtaacatccacctccagactccagaggctccaaggagcctctctctctcttcaagtaaagaaatattcactgagctgtgtgtagaggtttacatggtttgggaccaacatgtggctgggtgacttcacttccatcctcatacagtggtactcggagatgaatggggggtagagtgatcaagatttagttcaatgtctacctccagtggggcagtgcttggtagttgactcattttggtctcttttgatgttcacagtcacccat

SEQ ID NO: 10060 - DNA, 1024 bp, Homo sapiens
aaaaaaaaaaatctcagtctttctataatgagtttgtctttagctagtagtcctaaactgtgaaattgtttaactaatactgtggttctgacctagcatgctgtggcctgcttttgtctcccttcttagacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggtaagcatcgtgcagtttgaggaaaacattaactggactccttcctctgtcataactggatttcatacatttttgccttttaggtacacttccctaccatctctgtaagctcagaatctatccttttagcctaactcaaatgccacttcatttaaaatacgaattatcttttccagtgaggaaagaaaaaaaaagtctttatcctgaatttattcattcaacaaatacatagtatctgctggggacagtgctaggcactagagatatagtgggtaacgttattgggtttttgtgcttacagattgcacctgatttatgattactagcatgtttaaccttgtaatctttatatatttcctttattactaagatcagatgtacaaacatttatacttcctgggatttccacaaaatatttatatcctatcgaaacccttcagtcttccaatggggaatccctcacctaccccattatctgcaaaagaatcttgctgatgttaaatgttctgtaaatcctgaatacttattcgatgtattcaagagaactacaacttctaacaactccctttctttttacccgttcaagagaattacttatccttctaagccaggacatacacaaaaccaaacataagaataagcactttgttttcaacacaccgtgtctggagttaggctgacagggaactggttaaataaatggtttatccatagattggatgttatgcagccattaaaatgtatgt

SEQ ID NO: 10061 - DNA, 1049 bp, Homo sapiens
gagaattagctaaatcttcctcagttaatgctgacactttacttgatttgtgagagaaagtggcccaaggttctgtatttgaacctgtagccatagcaatttgcttagaagtagggctttgcattgagttcgtgtctctaccagtacttgaggggagggagtgtaggtggaagaaaaactgatttcattgagtgtagttgtatatatgtttgtcctgatagattctgtgtccgaagcctgtccatgttcggcccccaatgccacctcgttatcctgctccctatggtgagaggatgtctccaaaccagctctgcagtgtcccggtatgtcactttaagcctaacaaaaatgtgcagtatgtattttctgatcactatttgtaagatcactgccagtatttagatttgctgacatctcctaaattatacctattttttataatctccttacttaaattgctggatctaattgtccccaggtcagaggacagttgtttcttacatcagctcttttcttacctttaaaaatctaaactcattgtgatcatctggttcctaccatttcagtcccatgttctactgcttctttttcatgtcacatggtcatggtgtttttataatttctagcattactctttttttctattccagagcttgactctgtaatttgagagtttttatatccaagtttatactgcatttctgctgagtttccttattatgatgtaccccctgttttatagcatattcttttttttttttttttttttaccttagaactcttccctcctgggtcacccttttcctcctagtgttcctcctgttctcagccccctccagagagcacagcttcttggaggagcacaggtaagcctgtgattagccctacccataaagaactctcctactttcctaaagttcattagataatagcccctttttttgctgttaatcactacttttatttttgcctttactttttcaaacaaagttattgatggaaaaccgtattcacttttctgtagacaaaagcaaggggacttgctgatt

SEQ ID NO: 10062 - DNA, 1031 bp, Homo sapiens
aacttttttccccaaatcgtcaagtaaggatgataaagaagatgtcacatgtctggcctgaagttttgcccacccaccaaaacctggcacactgacctgtgcaggtctcagcatgaaaagtccctgcatatatgagagaaagagcattgatcaaaggattcctaggttgtaagtttctcaacaagaatgtggcagagctggagaacttagatatttttatgtacaatatagtattcttccactacccccattaacatccagagaggcagggaaatatatgtatatatttttgtgacatggtatgtagctttgctgttgaactggatggcatagaccagattataaagtgtttttagccctcgggttcctcttctataaaatggagattaaaaatactacctgcctaatatcctgtttgttgatctgggtaatagtggtgtgtgttcatgtgttcactttctggtaattcactgagctgtatatttttaatttggccctttgatatagctgtgttaaactttgacaagtttaaaatttttaaaaagagagccctgaaagaataccaaggctataaagttattttaaagattaagtgaactagtggtttccaaacaatccctgttacagtgttaagcacagagttggtgattaataagtgcatttggattcagaggataaaactttgctatctttaaagttttagaaacatttgcattagccactgtcacagccagaagattccagtgtcactaaaagcatctgcaaaaatgtaatatacctttacagttactgttcagtggtaactttaagactttcaggctggatatggtggctcgcacttgtaatcccaacactttgggaggtaaaggcaggaaaatcacttgaggccaggagtttgaaaccaacctgggcaacatagtgagaccctgtctctaccaaaaaatgaagaagaaagaaattaagactttcacctgttataaatctttctaggaaaatagatcttttgagatgtatagttttactttatcctg

SEQ ID NO: 10063 - DNA, 1038 bp, Homo sapiens
tgcctgctgtgccgttcgaggcccctggagcctgacagttgaggctggtgaatgagcctaggtgctctgcctcccgacagacctggatttgagtcttcttagcatttacaggctttgggaccacaagcaagtcttctaacctaagcctcagtgtcctcatttgtaaaatggctgtgactgcctccctttgagggcactgagactgagtgagatcacaagataatgcacctgtgtcttcattgtccttgtagttgcagctggtttgccacagcctaaaggccacagtgtctagcatcttcctcactagcctaagggccatggtggccactcctccacactctggtggggccaacaccctcctagcaccccagaggcctggtaccaaggagatgctgagtaggtataggaggctcacccctgttctgaaggccttgtgtctgaggagctctctggcctagtcctgctggctacagctgtttccccctgacttctgcctccctctgagaatccctaggcactctgttgacctctggctgactcccagagctcttacatcagagagtctaaaggcatgacacagacttgtcctccaccacttggccataagaacatatgggtttttttaaattaaaataaaaaatagaaatggggtctcgctgtgttgcccaggctagtcttgaacttccagcaattctcccacctaggcctcccaaagcgctggtatcataggcgtgagctaccacctctgtgctacttagagctttaaagccaaatacatttgaactgtgacacagtcccctgctccccaaccctcacggcagggcgggaaggggaaggagatgcccagcaaccatgcagtgtcaagcacaagatttctacaacccattggctccgtcccacagggtgaaggttaggtgctttgcccctggtcacacaggttcagagccaggcatgacagacagattccctcgggtcacccccactggcatcctgggcacctgggttggttttgcctcttgagtcagcaggtccaggagg

SEQ ID NO: 10064 - DNA, 1061 bp, Homo sapiens
ttggcttagtggcgtgtagacctatgggagctctacagtcctagcttctattcttgctctgctgtttatcacctctgcgaccttgggcaattgacttcacttctctgaggctcagtttcctcagctgtaaaataaggtcatcaacacccccctcataaagctgggatggaagtaagaagagagaatgcctttaagcctgtaacgtagaagttggcagatagcaagttcttggtgctgcttttgaaagcacaggtgtgaccagcatctaatgtacttttctccttgcaagatgatttgtctcacattgagcctgttcttccccagcttcaagacaaagccactgtgctaaccacggagcgcaagaaggtgagttctctttctgaagcctggagaaagagctggcctggtgggaggcggttgactccttaggagagagagggcggctgaatcttggattcattgctgctcttctttgggggcttttcattttctcagagagggaagactgtgcctgaggagctggtgaagccagaagagctcagcaaataccggcaggtggcatcccacgtggtgagtgtctgggtctccactgtcttggagacagccctcccgttttgtttctggggtgggcgggccagcatggggagtgctgagtgcagagctgtcccaggttcctggcgctgttcctggtgctgtttctcgcctgggctgctgagttgtcagggctcctctttctgcccagctgtgggtttcctagtgatgcagtgagggagttaccgtaccaggcagatagccaagaggtatggataaggaatagaagtaactcttgctcccctgagaacatgggtgactggagatggcagtaggggaggtctgtggctttgtggcctgctgtgatttggccgtgacagggtttggtgtgtctctctgcaaaggggttgcacagtgccagcattcctgggatcctggccctggacctctgcccgtccgacaccaacaagatcctcactggtgagagtctgggcctagcccggcaggccaaagtggggaggggcagcagg

SEQ ID NO: 10065 - DNA, 1026 bp, Homo sapiens
ctcccaggttctcaagaggaaaaaacttctgtacatttcagaaatgcaatagatctgttatcagctctacgcactgcaaaacgcaagttcctttcttatttgatctgacagtgaaaaaattcacagatgttttattggaaggttagaaaataaaaaagaaccctttctcagtccaggtagtctgccccccatcaccttggcgtgtctgcggctgtgctgggcctgggcttgtgcgtggatgaggagacaaggctcagagtggagcagggggaggctcggaggcctttgctttgcagccccacccgcaggctcagcagggtgggcccctgtgctaacactcacccccaccctgcccctcagttcttgtttccatctaccttcgtccctctcaccagtcccaacgcagagggccaggttttctttagttttcttaactacgtcttttcttctggttgggaaaaataatatttactacctcttgtacagtttggaaatacataaaatatgtagaaaaaaattaaatgtggctggacgtggtggcttgtgcctgtaatcccagcactttgggaggccaaggcaggcagttcacctggctgttggtcaggagttcgagaccagcctggtcaacataatgaaaccacgtctctactaaaaatacaaaaactagccaggtgtggtggcgggtgcctgtagtcccaactactcaggaggctgaggcaggagaatcgcttgaacccaggagatggaggttgcagtgagccgagatcacgccattgcactccagcctgggtgacagagtgagactctgtctcaagaaagaaaaaaaattaaatcagctcagaatcccacaaggcagaggtctccccagtaaccaccagctgcagaggctgtgtgcctcagttgcgtgccagctgatgacctcctcagcacaaccagttaaacctttatttatttcagcttttctctatctttataaagcttttccccccttcattgtgaagatagcatgctcattggagacaattt

SEQ ID NO: 10066 - DNA, 1031 bp, Homo sapiens
ccaccttgggggacaaatttgatataaaagtgagacatgtttgtgatcatttactgaatgtccaggacattcctcgagtgacttctgtttgtctttgatggcgggtccttccctttgcccattgctgggaggtttggaggagctgaggtcaccagccttgtttcagagatgaggagactgaagttctgagagatgaggggatgggtccaggtgcagtcagccttggcctgtggcaagaggcaggtccccaaggcaatctggagagagtcggttctggtctggtgtggagggtgggagggcatagctcaacaacttctaccccatccacaccgatgtggagcgctcacctcgatatgtgtcccagcaagccccaacacttcagcatgggttatatgttcctaattctgtaagctcttctgaggccagggccatgttgggttgaccctgtgggatgatctggaaacaaatacttattggtgttatatgtggtgatgatgatagtgatgatcatgtcaatgatgagaatgatgataatggcagtaatgatgctgatggtgatgatgaaatgatgaagatgatggtgatgatgatgtcagtaatgttgatgaagtcgatgatgatgatgatggtggtgataatagctaccatttactaagggcttacacagtgctagggactctatgtaattacattatcttagtttttttccccagagtgagtatgacaccttggccgggcgtagtggctcgtgcctgtaatcccagcactttgggaggccgaggcaggagaatcacttgagcccaggagttaaagaccagcctgggcaacacggtgaaaccctgtctctataaaaaaattaaaaaaaaattatccaggcatggtggtgtgtgcctgtagtcccagccacttgggaggcagagatgggaggattgcttgagcccaggaggttgaggctgcagtgagctgtgatcatgccactgcactccaacctgggtgacagagttaatatatacataccaccttcactgatg

SEQ ID NO: 10067 - DNA, 1034 bp, Homo sapiens
ttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctatgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcacatgtggtgtggtgttgctgggtttgagtgaagacgtggctgcatgtgggtgccttgaactcttctgcagccttcagatcgtgctctctggaggggcctctgtgattcacatcccaaagccccatccgtctggatgtcagccctcccttgcccgctcgccccagggctggccctgggagtatttaccttccctctcccgctcttccgctttctttcttagccgttttcctattggagcctacgtttgcctggtcctggactgagagcaatggcatgcaaggccacaggatgccacgagggggcgtctggtcctcagcctgctcgggaggtgctgcgttcctgccacctgccgggctggcgggatgtcggcgtgtgggcctgtctgtgagccatctaattctaacctgggcttgcaggatgggctcagaggaacagcaggccgctaaactggctgcggcaccaacagtcttctaggccttggcccagcctgcctccctccccagcgtcgcctctgctgctgagctgcctatcccgaggccagggagggcgtcttcagctcagcaggaagggcagcttggagggagtctgaagaccaggcttctaacagtccctcat

SEQ ID NO: 10068 - DNA, 1048 bp, Homo sapiens
cccagcactttgggaggccaaggcaggtggatcatgaggtcaggagttcaagatcagcctggccaacatggtgaaaccccatctctactcaaaaaacaaaagttaaccaggcatggtggcatgcgcctgtaatcgcagctacttgggaggctgaggcaggagaatggcttgaacctgggaggcgtaggttgtggtgagctgagattgcaccactgcactccagcctgggcaacagagagagactctgtcccaaaaaaaaaaaaaaaaaaaaaaaagccaaaaaactggtggtcacagggtcttactctattcatatcttcccacaggatgcagtttgtattacccaagtaagtctcaattagaatgaaataggccttttccccaccagctgtaggtttgtaagctgtaagctacttttaagctggcctccttcaggcattcatgcaaaaatgacatctattgtaatcattagcaggactttggggaataagaaatagaagcctcatgtagcttattcgtagggctctattagggctgcatttaccacctttccactcctgtgtggaccctggcagatgcttggagacatttgttcatctgctgtttatctagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcaggtgtgtgtgtttttctgtctgctcgctttcctcctcttttctctaggacttctttgagccttggattccttcctctgccatattcttctttgttcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggt

SEQ ID NO: 10069 - DNA, 1044 bp, Homo sapiens
ggggtacagtggcatgatcacggcttaccatagcctcaatatcctgggttcaagagatcttctctatgtcagcctcccagtagctgggactccaaccatgcgccaccacgcctggctaattttgtttgtgtttggtagaggtagagacagggtctccctatgttgcccaggctggtctcaaactcctaggctcaagcggtcctcccgccttggccttctgaagtgctgtaatcacaggcatgagccactgagcctagcctaaagttgggacctaataaatggtgtttttgggataattgatagtcatttgggaaaagacaagtttgggttcatactgcctgccaaatgtacacttggctagaatctaaatggttgaaaaacttaatgtaaaaaaatgaagccataactatgactcaaagtacagaagccaaaaagaaagattgataaattccaactatataaaaataaaacacttcatagcaaaagcaaaacaaaacactattaggtaagtcagaagaaatgacaaaccagataaaaatattctgtagttcatcttatagacaaaaggcccagtcttcctaatttataacatatttatagaaagatcactaaattttctgtccccaaactagcaaaggacatgaatggacaggcaacagtcctgagaaatgcacattaacaccaaacagcagtactctactagatgaccaaaatccagaagtttgaccacacattatgttggtcgggctgtgagaaaataaacatgcttgtgcatcctctatagaagggaattgggcaatatcaaagacagcagttagcgatttacttagtagtcccagttctgagcctctacctgacctttatatgtataaagtgacataaaaatacaagcttatttcttgtggcattgtatgttatagcaaaatactgaataaatataatgagaagggatttgttaatctgcataatttaataattatagataaatgatttacacaattaaatactgtgttctgataagggcttcaagcatatattgttcaa

SEQ ID NO: 10070 - DNA, 1064 bp, Homo sapiens
ttcacttctccccccaaaagtataacttgtcttttacttgggtggagggattgactataaaacattgagattgatttgcacagtggcatatggaaatgagtctcattattttattgctgggcataacatttaaaactgaaaggaagccaggatctatagtcccagctactcaagaggctgaggtgggaggttcacttgagcctaggagtttgagttcagcctgggcagcataatgagaccccatctctttaaaaaaaaaaacaacaacaaaaaactgaaagggagcaatagagcttatctgatttctttacctcatagatgaagaaacagggccagagggacctgcccatgcctgtccatgattgacaaagtctgggctagaatccaggcctcttcactccttgtcctaagtctgcccctacattatgtttgtctcactcagtagggaagttttaaaactcttaagagaaaattggctcttctcagtggtagccctgataatggggggaagttaagctaaggaacaagagtggaaaccaggaaaaaaaagtaaaagcttttacttggaaaggattagaagttgagaagaaaaatgggggagaatgcatggggaagaacatggagaagactccccacccataggaatagtcgaacaccagaagagtggcagtaaaaatactaccaggattagataatggccagttaacaaattctaagagtctcgtaaaggctatcatgttccctgggctttgatgtcctttttaaaataatgatgaccttaaagtttgccttggggctaactagacctgtacttttgccagtcctggtttggcagacccagagtgctgagcattctaattttgctgtctttcctgcagtcccagagccctttgggggggccatcatcattggacaggagtcaatcacctatcacaatggtgacaaatacctggctattgcccctcctatcatcaaggtgagcgcagtcctacctttttttcctttcatcttttctttccttgtcctcaccttgctcctccctttctcttatttatcaaaaggag

SEQ ID NO: 10071 - DNA, 1566 bp, Homo sapiens
cactgatccagcagtagtttgagaattaaacatctcaacctgagtctttagctgtcactttgcattatttcttccacttataaaatggggccaggcacagtggctcatgcctgtaacttcaacactttgggaggccgagaggggcagatcgcttgagctcagggaccagcctgaggaacatggcaaaacactcgtctctaccagagatacaaaactagctgggcatggtgatgtgctcctgtagtcccagctacttgggggtgctgaggcaggaggagtcccagctacttgggggcacttaggtgggaggatcacttgagcccgggagatagaggctgcagtgagccatgtttgtgccactgcactccagcctgggcaatagagcaagaccctgtctcaaaaaaaatagtaataaaaataaaataagatgagactatttctcccattatgaggataactctcttttggtaactttgaaaatgctgtaacaatattgcctagaaaacagtcatttgacttgtgtaggcccatgacaagatgggaaaaattaactctgaggcaggttttctacttcctcacttttcctggtcacccgtttgatatagtggttattgcatctgaataatagtctgaaagaactgaatcaggcaccccaagaatgtcaatttcttacattctcaccctaaggactcttaattccatctgtagtgaccaagttatggcttaggaagtttcatgttgggaagatggtacatggtcctcatttatagcaaccttttagttagaaatgaatcatatttatattctatgatgacagctgttccctgagagtgaaaggtacattttgtccagaggcagcaatagaacagtagccttctttgtccatcttttctcggcgtaagacccagttctggggcctgaaggctaattggcccacttgaaggaatctctgatttctgcctgcattccaacattggcaccaaaatgtagccatggagatttaagaattcagtgctatggcttgcttctcttggtgtacaagttatcctctgcaacctgtgtcttcaactttttgtagttctcaactatgtcagttatctcattattttaggacattatcctacttgaaatatagtcattctcacgtcattcctgtcctcgttatccattgaaaactgagctttctcttcaatttggatcgaattcaaagattcagaagccctaatggtatgtaattgagtgcactgagggcttcagttttcccttagagaaaatgggacaaataccagcctgcgtaggtgtttagacaggccaggaaggcttaggccatatagattctgaggacccaagctgaaaatagtgtcatttcggtgtgtacaaggatcagggaggacgtagatgtctcctctaggttttataaggccactttacagaagtagttatataaaaggtaaacatttgtgcgtaggctgtgttgccagtttgggcattaggagaaattctaattcctcattttccctttggctattaattctgtttaatatgctcagactgaccataccacca

SEQ ID NO: 10072 - DNA, 1022 bp, Homo sapiens
aacactgttaaacatacacacttgtgaacagaagtagaaaatttttaatagaattgctggctcaaaaaatatgcacattgtttattttaatagatgtcaaatagcccctggacaacagtgtgtcagtttgttcatctgacaacatctgttaaattccgaactgctggaatataggtgtcatccagttttacacttgcaacatctgccttgtctcttttaccgcggttgtttgggacggctagctactcttggtttgtgtctgcctgagttctccttttggtccagttagtttaccatctctcctcacccttggcctttctccttcatcctttatcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggtgagttggtgattgtgtcctcacctaccagccccaagcagcactcttccagggatagggagtggggacaaatggagcccagggaatctgggaaagacctggccgaaagtctggacgttagccttcatgtctttttggggaagaaactaatcagatgctttcattaataagtgttgtaacatctggaatctggtgggtgaggcagtgggctcatgtaggaaaaaatacagacagatatttttaagaacatgggttttggagccctacaagcttggattggaatcccagttctgctgctaactatctgtatgaccttcttgtgtatggaagttagtcaactttccaagccttatttttctcattttctaaaaaagggacactgatagtatttatcttacagacctgttgtaaagattaggtcagataatccatacaaaattattagcactacacctgataaattagttctcaacagataaatttacctgttaatcatcttcccaaaaaagagtagtc

SEQ ID NO: 10073 - DNA, 1437 bp, Homo sapiens
gctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcaggtaaggactattgttcctttcagatttgagccagggtaaataagtgtattaagcattttattctccctgagaaagtgagcactgaatccttgttctttcccttatagacattctgttatcatagcattgactcctgggaagtagtaccatgtcctttatacccctttttaaggtgcttaattaaatgcgggagcaggtgttatgaatgctacagatgtctagcattgttctgtgttatgccaaaattaccaaagtgttgtagagtacagtaaaaataataagggatgtgagcaatcaaggatggtattttctctgtacagccgagattcgggccctccaccctctacagtgagtgaagccgaatttgaagatatcatgaagcgaaacagagcaatttccagcagtgccatttccaaagcagtatctggagccagtgcaggtaactcagtgcttacctttgctgccttctccttaacctttacttttttttcctgattttgtcatttctactggcaaaagttcaacaagataaagttggagtactgtagatatcaagagcggcatactttgaagagcaatatgtaacctgatttcttggccttggggaagctccggcagtattacttagtctgtatctaggcctgccctcatgaaaaccaacttaatgcctagaatataaataattaataccatctcgatgtggtgtttgctgtagagtgaaattcctgccttgtggaaatctccatctcagtggttgatctttagatctagtgtctgtgtagtagacccaataccagatatagaccctgggtcttctttaggaatgatgttttgactggataatgtgtttttttgtttgtttgttttgagagggagtcttgccctgtcgcccaggctggagtgcagtggtgcaatcttggctcactacagcctccacctcctggtttcaagcgattctcctgcctcagcctcccaagtagctgggattacaggcacttgccaccacgcccggctaatttttgtatttttttgtagagacagggtttcatcatattggccaggatggtcttgaactcctgaccacaagtgatccgcctgtctcggcctcccaaagtgctaggattacaggtgtgagccaccacgtccagcctagataatggtttgctatgaaatctgattacatttaggagtctaagcagagctggtaggtagcctatcctaaa

SEQ ID NO: 10074 - DNA, 1023 bp, Homo sapiens
tagagtgttttaatatttgaaattatttatatgctttaggaagtagaatccttcccccttctctatcagaacaacccaagattattctcttagtgtgcattttcttccactgtacttcagataaactgaaaaactgaaagattgtttccaaaggttcttataatacaaggactggtctaagagtaaattttttagtgagtcgtcttcagatcacttcagaattagcagttattgccgtgatattggagggagaaagttaagggagccgcctgtctttagttgccttggagaaactgtttcttcagggtactagacaagtttcccaacttaggtgcctcctttattccctttttaaaagaatagcaatatgaaactgccgtagcatccttaaaacactgaactacttgctgtctctgtcattttggcagcattatctttagcattgtttgaatgttttgtctaattcttgtaataaaaataaaatgcttgtctaatccttaaaaagatttctctgaggctaggcacggtggctcacgcctgtaatcctagcactttgggaggccgaggtgggcagatcacgagatgaagggtttgagaccagcctgaccaacatggtgaaaccccatctctactaaaaatacaaaaattagctgggcatggtggtgtgtgcctgtaatcccagctactcaggaggctgaggcaggagaatcacttgaacccaagaggcagaggttgcagtgagctgagatggcgccactgcactccagcctgggcaatggagcaagactgtgtctcaaaaaaaaaaaaaaaaaaaaagatttctctgaggtaattacattgtagaatcctgaaccctttttttttttttttttttttttttgatatggggtctcactctgttgcccaggctggctcactgcaacctcaacctcccgggctcgagtgatccttctgcctctcgagtagctgggactatagatgtgtgccaccatgcccaactaatttttgtatttattgtagaga

SEQ ID NO: 10075 - DNA, 1066 bp, Homo sapiens
agatgagtcatagctattccacgaaccaagggtctcacggccaactaagtttggggaacactgcacactctgtctccctcttggcgatactgatattcatgggcacgttaaaggctctgagaagtcctgcggtaaaggaatcagtgtttcccaaatttctttaatcaaagatccttttttccagtaccgcagtggaaaaacctgagagaccctggagctcttcagaacacagggtgggagacaagtctggcagtggtgactctgggtggattttttttctgggacctcgggctggatggccctagattctggagatctggagggagcgggaaagagaggctgctacctgctccatctttgttatacctgacgcagggaggccccatccataccctcgtgtgaggctctgctgggaagggacatctgtggtgggaagggggttttctgtcaagggattaggttcccctggggcctgtcctgcctcctccatacccaccacttactgcccctgtgagctggctctacgctttggctttgaaccctgtacacagagtcccctgtgagacatttccaaggtctactctggacagagaaatctgtctacagcagggatgcccaacgccaccatctcatctgggcctatggtggcagctcagcctctcttcatctttctcacttttgtgcctgagtctgaggttgagaaccaaggtcaaggtcaaattctaaatggaggaaaaagcaggtcccgcaagaacatgtttgcttgatcctggggggtggggtgtgcccccgctggcacccttccccacactgccccaccttggctttggggagcggcacagcctcagtcttccccaggcccaccccagcgctcttcctggggccccttccctagaaacattcccatgcctgaaacatggctgccttccagaatagtcactgtctctattccccctgtactcccagtcctgcttcttggggtcccagtagcctgatgagctggtggcgccccttgtccttggctcccagggtttccaggccatgccctccaccggccaaggcttct

SEQ ID NO: 10076 - DNA, 1743 bp, Homo sapiens
tctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggac

SEQ ID NO: 10077 - DNA, 1049 bp, Homo sapiens
tggcacctcctggaggtgcttttttgacactcttgccccaggcaagtattccccttgcactttgtatttctctcccacacttaggtatccttcttgtcacagtcttctctgtccagggctggactgtcttactcttctttcatgtccaatatctggaacattcattcactgagtacttcttcccaccctgctgatccccagcctgatttcctgggtggtcagcgttgggtttgagatgtcgtctgaagttgtaagcagaaataatgtagctgctgaaggaataatgcctgggggtggagatctggtgagcttttagtgagcattaggcaatggaaggttctaaaaggccagcagaattctttgaaaagttcatttaaagccctttgtcccaaggctgtaggctgcagagttcttccaggtccacctcctccactttgtgacatttcagcttgcgaggaattaaattgtcgttaaaacacatttcagttctaggcatgagttcaaggtagcctggcgttcctctcgcccctggccatgagaactttgaaagggctttggcagcactggttggcctggcatgaggagctcatagcttgaggctcatgccccacctgtccataatgttcttattttcccatcatgagcatggacttgggtttgttacatgtccgataccattatggtcagtactatgcagatgacgaagcagccctgtcccccgtctgactcccatggctgcttcaagggcagtgtggttatttgctgggcagtggcatggggcttgtgcatttctactgtcactacagagggtttaaaaaaaagacatgggcaggttaagtggaagggaacagtctcacaccactacctttattgcttcttggtacttgggttttcaggaaattcctatcagcagacatcaaaaacagagaatgaagggacgcagttggcatgtgcctgtggtcccagctacttgggaggctgaggtgggagcatcgcttgagcccaggaggtgaaggctgcagtgagtatgatcacgccactgcactcca

SEQ ID NO: 10078 - DNA, 1078 bp, Homo sapiens
ggccgggaatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggtttgtaaaatgcaccaatcagtgctctgtaaaaacgcaccaattggcgctctgtagctagctagaggtttgtaaaatgagccaatcagcaggacgtgggcagggacaactaagacaataaaagctggccaccccagccagctgctgcaacccgctccagttcccttacaggctgtggaagcattgttcttttgctcgtcacactaaaccttgctgctgctcattctttgggtctgcaaagagtgttattcctttaagagctataacagcgggaaggtccacggctccattcttgaagtcagtgagaccatacccgccggaaggaaccaacgcccgacacagccccacccatctctcctgtttctcacctatactgaaattcttgggcaaaagctgtctgtggacacacccaggggaaaggccagcccaggcaggtgtttcttagtggttcccctcagccaatgcttcccattccttgatgcatccttctaactagagcagatactcggtgatcttaaactgtggacacctgggagcaccctcaaaaggcagctgggcctagggagatggcctgtgcttctgtgtcaggagttggttccttcaggtgggctcgtggtctcgctgacgtca

SEQ ID NO: 10079 - DNA, 1028 bp, Homo sapiens
agagaggcctggagaagtggagtctggggagtggggatggaggccaacaacacgcacacacaaacaaagggtcccgcctccctgccgtgcattccatctgcagccccgagcctcaggtctctgggcggggacagaaccccgagctgggtaggctaggagggaggagagcaaggatgcaggccgcctggggagggagggggtcagtggccaggggagggagtcacatcctgtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgtacataagggattgggaatggcatacacttagcgaggacccccagagctgttctcgaatcgccggggaggccactgagccgcaggccagcgaggtcttcagctattccgcggagcggaccgctgtttacgctctggggcggtaggcccttcgcggggtcctgtcccttcttcccttggtctcactgcggggtcggcgcgcgccccagccccaggcctgctgcttccctttctagaccacagccctcagagctaaggccccggcgcctctctgctgggttggagtcctggggactcagtcctagggactcgaaagtcggggcgttcccttcaccgcgtttcccccttggcggccagaatggcgtcccctccccttgcatccccctctgatcccgtgccctgcagcgtgatgccctccactgtccctatccactaccctggcgtcccagagtgtgccgcgggtcaccaggttcccataacgtcgcagcagagcttagacgctgcggggcgaagacccgccccaccctctgacgcgaccagcctagtgggcgaggccagagcttgcgcgggtcaaccag

SEQ ID NO: 10080 - DNA, 1055 bp, Homo sapiens
ggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgt

SEQ ID NO: 10081 - DNA, 2670 bp, Homo sapiens
cccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagat

SEQ ID NO: 10082 - DNA, 1052 bp, Homo sapiens
gctcccggcctttttttttttttttgtgagacagagtctcactctgttgcccaggttgaagtgcagtggtgtgatctcggcttactgcagtctccgcctcctgggttgaagcaattctcctgcctcagcctcccgagtagctggggattgcaggtgcgtgccaccatgcctggctaatttttgtatttttagtagagatggggtttcaccatgttggtcaggctggtctcaaactcctgacctcaggcaatccgcctgccttggcctcccaaaatgctgggattacaggcgtgagccaccgcccctggctcccccaacatttttaatgtcataaaagtgatatcctaaaagaccaagactattaatgtccagattttaattctagttcttttaagacccagctaggtcaactgcagtggctcatactacttggcaggctgaggtgagagggtcacttgagtccagcaggttgaggctgcagtgagccatgatcgtgcccctgcacttgggtgactgagcaagaccctgtctcaaaacaaatagcttgaacagttcaggagggtgtgaaaaaattcccagccccagttttggtgtggttgaggttttaaggctcctcagatgaggtctcttatgcatttggaaaggaacctgggacctagggttaaaggacagatcctctgctttgctacagtgtaatcttggacaggtcattctacttggtctcatctgtaaagagaggggagggtcagggtaacagttgataactcatgggttataaggattgagtgaaattggaatactcatggcaatatttatgctatgaacaatagaaccaactaaacattcagtttaatattcaatgtttagtagatttatggcacaatcctgcattagaagattgtttggccattaaaatgtttgcaaagaattctgtttttgaggtagggtcttgctatgttgcttagtccggtgtccaactcctgatctcaggtggtccttctacctcagcctcttgagtagctgggactgctagtgcaaaaaattgttttgtt

SEQ ID NO: 10083 - DNA, 1049 bp, Homo sapiens
agatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggtaagttacctcccctactatgtctgagccctccctggcctttgctctcctgtgtctgtatccccagtccttcctccgctagaggtgtttggttgctcttccatctttgtgctctgttttgttcttccccctgctcctccctaacttctcttgacctttcttctctgctcggcacccaggctgtgtggtccacccttttggctcttccataaatagcttcgatgtccatggctgtgatcttgacctcttcttggatctgggtgacttggaagagccccaggtgagtgagtgtcccagggaggcagctgggaaaagtccatgagaatggccatgtgactgtgggcaagtcctttagctctccatgtcttagttcctcatctacaatgcagataataggacctacctgaaagagtttattgtaattggagagatgtgaatatggatgagtattagataggatgaaaatgaactgacagggccaggcgcagtggctcgcgcctgtaatcccagcactttgggaggctgaggtgggtggatcacctgaggtcaggagttcaagaccagcctggccaacatatagtgaaacccccatctctactaaaaaaaaaatacaaaaattagctgggtgtgtggtgtacacctgtagtcccagctacttgggaggccgaggcaggagaatcacttgaacccgggaggcagaggttgcagtgagccgagattgtgccactacactccagcctgggtgacagagg

SEQ ID NO: 10084 - DNA, 1035 bp, Homo sapiens
catggtgaaactcttgtctctgaaaaaaaaaaaaaaaaaaaaaaaaagttagctaggcgtgatggtgcatgcctgtaatctcagctactctggaggctgaggtgggaagattgcttgatcctgggcggcggaggttgcagtgagtggagatcatgcagcctgggcgacagagagagcccatttcaaaaaaaaaaaagttgaaagtgcttggcctgatagtcatactagggtccagaaatagttataccagctgttacttacagtgtgtttactctctagcaggcactgtatttagtgatttacatttgcttttgttttaaatcaaatgtaattggttttactaataaaaccaattggggaatgtggttttggatctgtagccataagggtgttaatacatcttctgggaatcagatggctgtcccattcacgcataggaagctctagaccccacctgcgacatgcacacacaaccagccctgggacaggcaggtagatctgaaggataaagaagtacagaagaggccaagccccacgttccacattcctggtttgttccttttttttttttcttccccccgcctccccgcaacaccgagatggagtcttgctctgttgcccaggctggagtgcagtggtgtgatcttggctcactgcaacctccacctcccgggttcaagcgattctcctgcctcagcctcccgagtagctgggattacaggcgtgcaccaccacaccaggctaattttttttttttttttcccgagatggagtctcactctgtcgcccaggctggagtgcaatggcacgatctcggctcactgcaacctccacctcccggattgaagcaattctcctgcctcagccccccgagtagctggggttacaagcatgcgccaccacacccggctaattttttgtatctttagtagagatggggtttcaccatgttggccaggctggtctggaactcctgacttcgtgttccacctgcttcggcctctcaaagtgctgggattacaggtgtgagccacc

SEQ ID NO: 10085 - DNA, 1038 bp, Homo sapiens
tttagggatgcccttgcctgtaggaacgttgttgttatgctatagcccattggtatgactatggcactcttttattcctcctccaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcgggg

SEQ ID NO: 10086 - DNA, 2492 bp, Homo sapiens
gttggtggaaagagggaaaacagcccagagactgagggcctagggaacttgcaccagatgacagctggcttttgctcctcactacccgtctcttctctcctcacccagcacatggcgactgctgatgggctgagacagcgctctgggggcatggaacgcccctttgtcctggccagggccttcttcgctggctcccagcgctttggtaaggtttagagaatggagctgtggcagaagggtgtgaaggccagatctcaggagccatggacctggacctgcctctctgaggaatgggagccacacactgcatctgtttcctctcagctatgcgctttgaaggaagtcagggtgtgggaggtccactccttgttcaaatgttcttgtgaactgcatcttcagcagggttctggggacccagagcggatgtgggaggtcagccatgtaaaaagctgaactcctttaccatgtgcaagctccccacttcttgtcttcctcaggagccgtgtggacaggggacaacactgccgagtgggaccatttgaagatctctattcctatgtgtctcagcttggggctggtgggactttccttctgtgggggtaagacagggaggaatttggggtcttggtttggtgggaaaggggcaaagtagagggcacaggaccaaggtgttgtaagcaaagagagttgagagtccaagttagggccttgggaagtttctcaagcagtatctctccttcaccctcttttccaacctgcttcctctctctcctctaccagcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggtgaggcattcacttgggctgtgaagagtgggctgaggtggctgggggtattagggactgggcttcatctctgggtctctttcttcactcactacagccttgtaaaggatggaaaatcattaaggtcaagagtgaaggggagcttaatggagatgaataatagtaaacatttaaagaaaattgacagcagtcataagctctttcagaaaaataaaacagggtaatgggattaggtggtcataaaatccctttttgaggccgggcacagtggctcacacctgtaatcccagcactttgggaggccgaggtgggcagatcacctgaggtcaggagtttgagaccagcctggccaacatggcaaaaccccatctctactaaaaatacaaaaattagctgggcatcatggcgcctgtaatcccagctactcgggaggctgaggcatgagaatcacttgaacccaggaggtagaggttgcagtgagccgagattgctctgctgcattctagcctgggtgacagagggagactccatctcaaaaaaatgaaaaaaaaaaaaaaaaaaaagttttgagaagaaggctgtgtgagatgaggcctgaatgagtgggacagaccatgttatgtaggaagaatcttccaagcagagggaattgcaagtacaaaaattctaaaggagaaattagtttgttatgtactaggaatagaaaaaaacagtatgtcttgggtaaagaagcagaaggagagctaggagatgagattaagaagaaagtgtgatctgctcctggagggccttgcaagccagggttgcaacccagggttgtaagccagggcggtgaaacatgcaaggaggctactggcaggctgctgtgcagcatggtttcagtagagggcagagaagaagcagggagatggcttaggaagttaaatgtctaagactggattgtataactgagacctgaaccccaacccgactgtctgactgcaaactcctgggtcttaacccctgtgctgttcttttcttttctttttttttttgagacaaagtctcactctcgtcccccaggctggagtgcgatggtgtgatcttggctcactgaatgcactccgcctcccgggttcaagtgattctccagcctcagcctcctgagtagctgggatcacaggtgcctgccaccatgcccggctaatttttgtatttttagtagagacggggtttcaccatgttgttcaggctgatctcgaactcctgacctcaggtgatcttcccgcctcggcctcccaaagtgttgggattacaggtgtgagccaccacacccggcctatgctgttcttttcttattgccagttcctggaggagcatttctgacttgtgccaaaattgaaaagttttcctttattgtctttcttccttcctaggcccctgtgggtgcagtaccctcaggatgtgactaccttcaatatagatgatc

SEQ ID NO: 10087 - DNA, 1854 bp, Homo sapiens
ctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaaccagtccagtgcttctgtcatgctgagagcgtgcaaagtctgacagcgcctggctctggacgttcccgcccctggcctgaagccccgccccctgcgataatttggagtgcgcactctaccaatgagacagctgcccggcggcgctcaggtcgaaccaatcataaggccggaaggggcgggaactaggatacgtggctgagcgcgcgcgatggggcgggaggtttggggtcaaggagcaaactctgcacaagatggcggcggtagcggcagtggcggcgcgtaggaggcggtgaggagcccggaatctgggggcgcgcccgggacgcccccagatcccccaagtcccattccactccttcctgtgtgtctcttgacactctgccacccccggcctcgtgaggaacctttgttcctctggaggcggcctcagacgcctccggtctccccgtggtagatccgagcgacgctgggggccttgcctgtggggctccgggctcccgcccggcggtttagtaaagccacagctgtgcgtctttcttggtcttggccgctctcagccgccgccctcctttggctgcttgcggcggtcaacgtcgccgcccccttcctgcagtgcgcggggtcgtcggggcgggggaaaagatgcggcctggcctcggggaatgcagcctgcggccccgcggcccctcggctgagctggaagcaccgggccagcagttaagcctgtactacccttctggctctaccctgtagagctccgaatcctcctctgcccttgtcttcacgtgagcaccagctctggcttagttcagtgtccacggtcgctgggcacggcccagggtccagtaagctcacggcgtggatggtgttgctcaaacacaacatgtaatcgaatggcttggtccacgctctcgggtttatattactggggaaaaaaaaagattcgaaacatatcaccagtgccacaaatgtttactaggacctaacggatatactggggtggggtaggcgtgtactctccaaagcgatgaagaaagcgtggatcataaactcagttccctcggagcctgtgatctgaaacaataaatgcgtgcaacttgccctgcagcttattcctgactttggcctatgaacacctctcttggggtggtcaaggccgccgtgaattccttagggccctccaacaggtcatatctgaaagatgctttaggaatcctatctccattggcatctttccgaaccaattttacagactgtgcaaatagggccccagagggtatttaactcactgtacgtcttttttttttttttttgagagacagagtctcgctctgttgcccaggctggagtgcagtggcgagatctcggctcactgcaagctccgcctcctgggttcacgccattctcctgcctcagcctcccgagtagctgggactacaggcacccgccaccacgcctggctatttttttgtatttttagtagagacggggtttcactatgttggtgaggatgatctcgatctcttgacctcgtgatccacccgcctcggcctcccaaagtgctgggattacaggcgtgagccaccgcgcccggcctcaactcactgtacttctattta

SEQ ID NO: 10088 - DNA, 1036 bp, Homo sapiens
ccagcacatccactgggtgtggagatttggtgtagaggcctgtacataggctggaagtcccacagcccacatccagcactcgcagaggactggcagcctgtgcctcctgcagcaatggcagtaggagcccctggacttcgtcgtatccaaagaaccagtcgaaggtggggacagtgcccaaacgaggctgggcatgcagccgatcccagagacagcggtccgccaggcaactatcagccagtgagcctgtgggcacggttggagggtgtcacttggtctatgtcgccactgcaaaaacgtcgtatatacacactggcgtcttttttttttttgagacagggtctcactctgtgacccagggttgagtacagtagcacaatgatggctcactgaagcctccacctcagcctcctgagtagctaggactataggcgccatcgtgcccggttaattttttttgtagacagggtctcgctatgttgccctaggttggtctcgaactcctgggccaagcgatctgcccgcctcggcctggcaaagtgttagcattacagccgtgagccaccacgcacggcccaccgtagggtttgagaatcacaatttcagggactacactcctgactcacgaggaacccaccttaccctccccactctgcccccaccttgccctctccactctgcccccacctccctacccgcaaaggggcggcacgtccccatcatcaggctcggcaagtggagcattcgacgcagcgcggccatctggagattcgggtaagttcgaccagagaagcttatgtgaagcgtccaccctactccagccggagaggcctgaggtccaggggaagatctgcaaattccgcgtagcgaaaggcggcgtacagcttccccgaactctgcagtcccggaaaaaagaacgcggacacagactatggtaggaacggcctttattggctgcagcgggaagtggaggagggtatacagcgtccgcagacctgaaatcaaatgagaaagtgtgagcaccccgatggaggag

SEQ ID NO: 10089 - DNA, 1301 bp, Homo sapiens
tccacccgcccacccttcctcgggactaccagttgcttctacctttagcatttcctgcttccgccgctctcccggggtcacgataacgaggagcgcgtagcccacgccagcccctgcgcccagcattgcgactgagatcagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatgggtaatagttacttatctttaacatttattttacaaacaacctattccttttctcgtcatggtacacacttggtattgtttgggtttttttttggttttgttgttgttgttagtgtgtgggcgtggttttgtttgtttttggagacaaggtctcgctctgtcgcccagggctggagtgcagtggcgcgatcatggctcactgaagcctcgacttccagggcccaagcgatcctcctgcctcaacctcccggatagctgggattacaggcgtgcaccaccacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttt

SEQ ID NO: 10090 - DNA, 1050 bp, Homo sapiens
gtcttggggcgctaccaacagaaccaagataagggagctagaatggcagaaagatgatctggagcgaggatgactgtgccagagctggctggggagactgagcactgtcagtgcttgattaataatgtaagagaggacaggctgggccctggggacagcctcaccggcccataggccagagtcacagatggcccagttggcaacatgatggttcacttttggaaaagaaacgtgacacagcctttctgggaacagggtagccagtctgattcaggagagccaacaggatacccaagaactggacgtgagaggctctagccaccagaagggggcagcaccttcttgggatgacagattgaaaggcccgttaggctacccaagagggttgtggctgagtatttgggggcgttgcgggggctaagagggaggtggaatagagacagtacattttcaacaaaaaaatttttttaaagaaatgggggctacctttggcaggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtaagtgttggtggcctgtctgagaaggtgtggaggaagatggcaggatcagaatgggtagggggctgggtgtggtggctcaggcctataatcccagcagtttgggaggccgaggcaggcagatcgcttgagcccaggagttcaagactggcctgggcaacatggcgaaacccatctctacaaaaaaagtttaaaaattagctgggcatggtggctcacggctgtagtcccagctactctagaggctgaggtgggaggatcgcttaaacctgggaggttgagtctgcagtgagccaagattgcaccactattctccctcctgggcaacagagcaagaccgtctcaaaaaaaaaaaaaaaaaaaaaaaaaaaagaatgtctgggtagggattcctcaggagaaaacaccctt

SEQ ID NO: 10091 - DNA, 1071 bp, Homo sapiens
cgaccagcgtcggccacgctgtacttcctggggtccccttgtttagtgattcttcgttatggccgcccgtgtgccttcgactcaatcgggaggacaccgaaatccagatttcggggttgcagggcgcgggccccggcttggttagggcaggggcagccattttgagaccagaagagggcggaagggaccatattgagaacgccggttgcctgggggccgccattttaagagaagccctgtacggtaaactccgtgacgtgggggctgccatgttggtacggccatcttggaatgggagtggctgtgggcgcagccatcttaggtataaaatcggctccagtcgcggtaactgaagccaagctccgcccctaccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccaggtgagactgagagcaagaacctggcccatccctctccattgtctgagcaggtcaccgagggaagcgggcaggacgcgctggcagagtctgacggggccctgctgtgggtggagcaaagggtgcctcatatctctggggtgcttggggtcggccacaaaggtggtaggaaatggggtcgacagataggtgagggtgggccttgtgcttcagataacctcacatggtcaggcaagggttagggatgggatgcaaggagcctaaggggctcacaacaattactgacctaaggaagggcccaggagagggaaaagggaggagttgtgagaag

SEQ ID NO: 10092 - DNA, 1055 bp, Homo sapiens
atgacatccagtgttctgaaggagtagtagtattgatgtagatactgctctaattcctaccctctgtatgtgacacggattcagatacccgggtttacagttttgtaccctgaaggccacccttaattttggtagccatctattctttaggacatttaagttgctgttagagctaattaatcattttttaaagtggttaatcatagctcatgcctggtctctagttactgcttaaaccccattttcccacctagcgctgtagccacgcagttataatctgatgggtaggaacattgagtgtgcagaaaaattgaagagaggcgctttgttttgtttcgttttgttttgagacggagtttcgctcttgttgcccaggctggagtgcagtggcacaatctcggctcaccgcaacctctgcctcccgggttcaagtgattctcctacctcagcctcccaagtagctgggattacaggtacccgccaccacaccggctaatttttgtatttttagtagagacagttttcaccgggttggccaggctggtctcgaactcctgacctcagatgatccgcccgcctcggcctcccaaagtgctgggattacaggcatgagccaccacgcccggccggccaaaaagaggctttcttaaaaatcaaggttacatttattaaacactctaattttttttttttttatttaaccatgtctgagctgttgtggaaaatttcacttactcccctggaacttgcccaacaccgtgatacagtgggggtgagggaggcaaggtgcttggtccctgccatgccacatttgccatttaagcatgtacagtacaatctattcattgggtatttgggtgcctgatatgtgccattatcaggatacagggattaaaacggacctgacctgattgatccttcctggaattttcaccgtgccaagaaggaactgaggctcctccgcaacagaatgggggtagggtcccactccaggagggcaaacttctcccgtttcttcatctctaggatgagggaattaattagaagatctccag

SEQ ID NO: 10093 - DNA, 1049 bp, Homo sapiens
gagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattcaccctatctcctgtggctgcactgactggggcggagggtgtcactgggttatttattcattttttaatgcctctttctcaggtcgcatgggctccaaccaaggaggactctcctcttgcatggtggctgccgttccctccctattctaccatgccttcacttgggagccagccatgcagtcagttgacatgggtgggtagttattagtctatttagtgcttgcttaggccaagagtcgagccattgaagtataggaaaataaattataactcacgacctctgtat

SEQ ID NO: 10094 - DNA, 1049 bp, Homo sapiens
aaggctgcacagaggtctctctccttcgagttgggtggtctgttgatttttcccgtccacagcttggtaaagttatttctttaagttcctcattagtgtttactaccatattgcttactctatgggaagtccggttgtaggtaactaatttgttgactgttctaggtgaagatgaattctcttacggtttcgatggacgaggactcaaggcagaaaatggacaatttgaggaatttggccagacttttggggagaatgatgttattggctgctttgctgtaagtgctcctgaaagttgtgggttataacaaggagcggatagagggcactgggaattcacttgtgcttcccatcaactgctggcttttatgcatgtgatgtgtgtggctcgcttagttactttgtgcagcagtctgtgtgaaaaaagaataaattgtaaagtttaatcaacccaaagcctcgtcagccaataagtgctcttgtcccttgtcattgtagaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtatgccaaacagtatacgaacactgaggttgtatgctttgcagaggtgggtgcgtatgctctccagggtctcagagcgttaccaaacaggaatgggaggatgttcttaaattggttttgataaacatgaccctcatttatttttcattatatttctggttctgttttttgcaggtgattctgatggtgggactacccggatctggaaagacccagtgggcactgaaatatgcaaaagaaaaccctgagaaaagatacaatgtcctgggagctgagactgtgctcaa

SEQ ID NO: 10095 - DNA, 1587 bp, Homo sapiens
ggcgctacggtctggccgtcggctgcggcgccatcggtaagacgtgggctggcttcccactgtgacaacgtggggtggcgggacacgaccttccctatacaggcagggagagtcagggactccctatccgagagtggcgggcgggctttaccccacagaaatgtgaaacactggccgggcgcggcggctcaaatgctgggaggccggaggcgggcggatcactaggtcaggacatccagaccatcctggctaacaccgtcaaaccctgtgtctactaaaaatacaaaaaattagctgggcgtggtagcaagcgcctgtagtcccagctactcgggaggctgaggcaggagaatcaattgaacctgggaggcggaggttgcagtgagccgagatgacgccactgcactccagcctaagcgaccgagcgagactcccctctcaaaaaaaaaaattgggaaacagtgatgtctccgagcgccgtgccctgtcatagcctaggctgagggctgcccttcactctgcgaccttgagcaaggtccttaaagctctccatcttcccattaaaatggaaacggacatctattaaggttgttgggaggaataacaagattactgggtataacaggagctcagtactgcactccagcctggccggcagagtgagactcagtctcaaaaaaaaaagcgctcagtaaatactactttcatcccacaaatttcttattcagagggcactggaaaggtcggtacttagatgcccagtgaaaacccctcaccccaatctctgccctgcctgcaggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaaacaaaaaaaaacgccaatcttagaatggagtaacaaccagggtcacacaaggaggtcaagattcattaacaacaaataaaggagcagtcatccctagggcagctgcctaacagtacctctaagtttcagtccatgtctgcttagccttcactccttcctcctatctagttgtactttaacatcaaaaactcactactaagatgaagacagtaatataatattttggtacaaaaacagctgcaggaagaggtggaggggggcctgtcattatgtttcccccccaccccccaacgaaaggaaaactaagactcccaa

SEQ ID NO: 10096 - DNA, 1032 bp, Homo sapiens
tgtaatcccaactatttggcatgctgaggcaggagaatctcttgaacctgggaggcggaagttgggtgagccgagatcacgccgttgcactccagcctgggcaacagagtgagactcttatctaaaaaaaaaaaaaggaagagtcccgggtgcggtggctcacacctgtaatcccagcactttgggaggcagaagtgggtggatcacctaaggtcgggagttcgagaccaggctgatcaacatggtgaaacccatctctgccaaaaatacaaaattagggcgtggtggtgcatgcctgtaatgctagctacttgggaggctgaggcactaaaatcacttgaacccaggaggtggaggttgcaatgagccaaggttgtgccattgcacttcatcctgagcaacaagagcgaaactccatctcaagtaaattaattaaattcttcctcttttctgagcatcgctataggctttaattataggttttaatgtattggttgtcttattattagttagggcaatgattattgtgagtgctcaagttgttccaaatatgtctggtgggagcctagagggtttaaaaggctgagagaaaataaaggtatgttagcatgccaatggaaatgatgcaacggataaatttaaaaatgataatataggagaaagatgggagaattcttgaaatgatgtccttgagaaggtgaaaggaagtgggctccggggcataaatcaaggcttggctctaagaggagctggcgataggtgggaagacagaggctattgtagcaatgctcggggtggagcggcatttatcttcagaccacttcagtcttctcagctcattaagaagaaaagccagtagaggagaggaggtgtaggaggttttaggaatccactcctgcccacttgatcttatccctttagcagggtccaaccctgattgatctttattccccacggtatctagcagagtgcttttactctacgttgttgatcatgtgaaactgagtgaacacctacatttgtataaagccg

SEQ ID NO: 10097 - DNA, 1035 bp, Homo sapiens
ccacgcccggctaattttttttgtatttttagtagagacagggtttcaccatgttagccaggatggtctcgatctcctgaccttgtgatccgcccgcctcggcctcccaaagttctgggattacaggcatgagccaccgcacccggccgattctgcccatattttaatctccgtcccagacctgtctcctaaactccatatatccatattcctgttcaacaactccacttactggcctgggagcggtggctcatgcctgtattcctaacactttgggaggttgaggcgggtggatcatttgaggttcaggagtttgagacctgcttggccaaaatggtgaaaccgcatctcaactaaaaatacaaaaaaaaaaaaaatagctgggcatggtgacacatgcctgtaatcccaactactcaggagccagaggtgggagaatcactttaaccttagaggcggaggttgcagtgagccgagatcgtgccattgcattccagcctgggcagcaagagcaaaactctgaaaaaacaaaaacaaaaacacaagctgggcgtggtgatgcacatcttggtcccagctactgttcccagtagctgaagtctgaggcaggaggatctcctgagccctgggggcggaggttgcagtgagcagagattgggccactgcactccagcctgggtgacagcaacaccctgtctcaaaaaaaaaaaagtattaaaaagttaaatgtattttaaagaaattaagaggaagacttggtaatagtgctcacatatttaccatcttcagtgttcttcattcctccttgaatagatctaagttttccactggtatctcttccctttatcctgaagaagcacttcctttggttttttttttgtagtggagatctgctgacaacaatttctttcagttttctttcatctgaaaactgaaatctttttcactaactaaatcaaaactaaacttttttcaccttcttttttttttttttttttttttttttttttttttttcagacagagtctcactctg

SEQ ID NO: 10098 - DNA, 1045 bp, Homo sapiens
ggagggatgtaggcagaggcccaacaatgggctggcctctctgttcctctggtgcctcctgctactacaagagtttttatctgctcctcctctgtggtgcttagcattcagtcagtcagttatgggaatatagcagtggacaaaagagacaaaatccttgcccttgtggaacgtgtatcctaatagggagatagatgtgaaaaagtcataataaatagtatgttaaaaaaaaaaaaggtcgtaaatgccaaaaaaaaaaaaaaagatagtcaacacaggataaactaatcaggagtgccaggtttggagggaggtaggccctattaagaaggtggcatcacacttgggagaaggtgaggaaattagctacatagaccctggcaaaggcccgcaggtgacaatatgtttgatgagttaaaggacagcagagactactgcagctgggatcaatgaggaagagagttgtacaaggtgtggtcagaggggaactgtgagacctcttgggaccattggtaggctttagcttttactctgagtgacatagggagccattgcaggggttagtttttctgtgtttgagacagagccttgctgtgtcgcccaggctggagtgcagtggcatgatcttggctcactgcaacctccacctcctaggttcaagtgattctcatgcctcagtctcccgagtacctgggaccacaggtgtgcaccgccatgcccggctactttttgtatttttagtagagacagagttttgccacattggccaggctggtcttggactcctggcctccagtaacctgtccaccttggcctcccaaagtgccgggattacaggtgtgagccatcacaactggccaaatacatttaactttatttatttatgcatgtatttatttatttatttttatttttgagatggagtctcactctgtcgctaggctggagtgcagtggcagaatctcggcccactgcaacctctgcctcctaggtccaagtgattctcctgcctcagcctcctgagtagctgggactgcaagtgcgt

SEQ ID NO: 10099 - DNA, 1025 bp, Homo sapiens
ttttctcccccaggcggtggtgctgtggttctgggggcagagtcccatgcctccaaggatgtcgccatcgacatgatggactctcggaccagccagcagctgcagctcattgacgagcaggtacccaggctctgaactaggtagaatcagcttctccattatcctctgtggttcccgagagagtgtttggagtgtgccatgggcagaatggcaagctgggagggttgtaaaaatgcaggtctgaccctgaagaagctgttggtgctcatgtgctctctccctctcctgaaggattcctacatccagagtcgggcagacaccatgcagaacattgagtcgacaattgttgagttgggctccatctttcagcagttggcacacatggttaaggaacaggaggaaaccattcagaggtgagatacactctctcgccccaaacagaggagctttctcttccccgtggattggcatcttaaagtccccagggactgcttgatgccttttggaagatagagtgaattctgcccacccatgggacccagttcacctgcttccatccacccaacaagtttttattgagcacctgttcatgtgaggcactgttccaggtgcgggagatacagtggcaagtagaacagtaaagtctgtctggagctgctttgtagcatgtgtaagtgtatggaatttgatagggcagatgaggacagctgtggaaaagaactgacaaggctggcacagtgactcacacctgtaatcccataggcagcactttgggaggccgagcaatgcagatcgcttgagttcaggaattcaagaccagtttgggcaacaaagcaagaccctgtctctacaaaaaaatacaaaaactagctgggcatggtggcatgggcctgtagtcccagctactcgagaggctgaggtgggaggatggcttgagcctgggaggcagaggttgcagtgagccaagatcgtgccactgcactccagcctgggtgacagagccagattctgtgtcaaaaaaataa

SEQ ID NO: 10100 - DNA, 1043 bp, Homo sapiens
gtagggaatctggttgatatgagtttggggcctagagaatacttttatacttttttttttctttaaacattagtcaactgtagtagtaaggaggagagaaagattagaacaaggagtttaagcacttaaaaaatcccaactctatcctttctctgcagcaccctcatcacatgtgtggattctgggattctcagagtctggcatgacaaggacaaggacacatcctctgacccagtgaggctcccctgccctgatggttgggggaggtgggctggggtaggtgcctaatgatcacgctggggaagggaggattaaggactctggaacggactcttatctcctattctttacagctcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgagtgacaagagtgtgaaggagctgttcctgaagtcgagggaggctgaggccactgacgatgcattagagactagatggacttagggggcgaaggagggctgaaaacaggggcacatcgagccccccatagccctgtcctccatctgcccaccccaccaggtgcggaatgactggctggacttgcgggttcccatctgggaccaggacatacagtttctcccaggatcacagaagcttgtcacctgcacagggtaccaccaggtaaggtgtcacctcacacctgccttctcctgggataaagcagcctcctggagaaatggcccccacggtttgacacaactgctcttctcaccattctgagttcagaggagcaagcgcttccccgtctgttccaaccctgtccctgagcccatgaccttcctctactgtattctagggtggagtttcctgaactatgcctgttttcctcccacctggaagagaggaaaggagagtggatccccttcactgtgggaattatagggtgcaggtgtcagagga

SEQ ID NO: 10101 - DNA, 1193 bp, Homo sapiens
aagtcaggaactggagagcagggagcccaacctccttttttggactccaaaacctgtgctttgacaccgcgccgcggcttctcccaagaaaggtcccggagaggggcgccgccacctgcagcactgtcccgccgccccctggaaagccgaaaaacccctaggatgggagactaacgccacaatcggggaaaaggaggccacgcgggcattgaaatcacgactggtgtgtggaccaatcccaggatcctaaaaaagcgaaaggggcgggtttatgcaaaacaaactgagcagggagcaggcggcggaagaagtagaggacgtttaaatagggctgtttccaaaatatagccactactataaagaaagaataatgaaaactgtgtttcggaattataatgtattgggagataatttaacatttagtgcctggatagttaccataactggttggaagatgggaaggataaggccgccgaggcgaccgaagtaaaggtatcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttagggtacaagctaaatagttatgttcttgttgtttgagttggattaggtgtttttatcgctagtgtgttgaatgacgcgtgtttgagtgtcttgttgagagaaggttttgttttataactgagcacggagcgtagtatctccatgtggtcttcagcaatcttcatacttcagcctctggggtagttggaactattgagcgcttgccaccacccccggctaatgttttccatttttatttcttatttattttttttgagacgtcgtcttgctctgtcgcccaggctagagtgcaatggcatgatctcagctcactgcaacatccgcctcccgggttcatgcgattctcctgcatcagcctcccgagtggctgggactacaggcgcccgccaccacgcccagcgaatttttatacttttaatagagacggggtttcaccatgttggccagggtggtctccatc

SEQ ID NO: 10102 - DNA, 4280 bp, Homo sapiens
aatcgacacgacggcgatcgaggcttcaggaggctgtagctccatggaggcggatcctgcacacaggtttggggtgtgtgggcaaggggcagctcagaacagggttagagggtaggcagtcgtgaccgtcagtccaggatcgccgtgaggcagtgatctcaccgctcctgccacatgcactgggtgagaaaaccaagccgcaatgcggtcggtgagccagcacgctcccgtaggacgcatgcgcgcctttttcgcgccgcaagttcaggtggcgctttgtctacgccctccttccctggaactctctacccacaactccccggggtcgcatgcggtcaacgtatgcgcgtgcgctcgccgtagccccgcccccaaatcccgtgggcctctgcggcatggtatttaatcgtctccccggggagattcgttctcatttttctactgctcgtggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtggagaaaacagaaaattctgagtagcactgtactgtacgcaacaaatgtcagggccctattgatttgtctgaggtgttagtgaagggtgttattttttcagatgttcagcccacaagagcttactggtgaaggaatgggacaagacccatctttatgcaaagccagcgttacagtaatgttccaggtaggtgtacatggtttatgctcttacagaggagaccttgtagataaccactccatgatgaacacaaaatgacaagcatatggctgaactttcaagtgatgtcatcttactactgagaagtgagagagaggtcttaaggggtctttgaatgactatttttaggtacataaaatgctttcctctgttgtctacagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaataccttaaaataactaatttgctttcctttccaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaaggtgagtaatttcacggtattcaatgcactcagtatatagggtaggaaaaagtgcctttttaggcctgtgtttgtgatgacttacatggaatctcgttcggctgatgacttgctgttgagactctgaaatctgattttctgagaatgatgggtgggaacaacataatgcgggatatgagaagcactactgacttggtcttcctcctttcagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtg

SEQ ID NO: 10103 - DNA, 1050 bp, Homo sapiens
tttatcctctgtagttcacatccttctcttttttggtttatgcccttgttttggtagactacttcccctaatagtttactgagaaatggtacattttaaaaagatccctaggcaggcatggtgacatgcgcctgtaatcccagctactggtgaggctgaggcacgagaattgcttggacccaggaggcagaggttgcagtgagccgagatcacgccactgtactccagcctgggtgacagagtgagacttggtcagaaaaaaaaaaaaaaagacccaagaaacaaaaaacaaacaaaaaaagatcttgcatgcctgaaaatatctttattttatcctcacatttgattaatcatttggctgggtatagaattctaggttagaaataatattttttttttcagaattttgaaggcattggtttattgtcatctagcttttgttattgtggtagagaagtctgaagctgttctgattttttattgtttgtatgtgatctattttttcttttcagaactgtatagaatcttctcttcatcctcagtgttctgaaatttattaccttgcacgggtctattttcatgtattgtgccaggtacttggaaactcactttctttagttcttggaaattttccagtttgtattctctggcactcctattattaggctattggatccctagactgctttgctgattttcttatcttctctctcttgttttttatttatgtatctttttatttattaagacagagtcttgtttcgtcacccaggctagagcacagtggtgcgatgttggctcgctgtaacctctgcctcctgggttcaagtgattcttctgcctcagcctccagagtggctgggaataaaggcatgtgccaccacacctgggtaatttttgtatttttattagagatgtggtttccccatatcggccaggctggtctggaactcctgactgcaagtgatctgcctgtttctgcctcccaaagtgctaagattacaggcgtgagccactgtgcctggcccatttatgtatctttttaaattt

SEQ ID NO: 10104 - DNA, 1470 bp, Homo sapiens
cggcctctcggaggccccggctgcggactggggcttccagcgggaggctgggccgcagggctcgggagccttcccggggtgggaaggcgcgttggaccgagggcggggctacgcgcccggggcccgggctggaccagctgcgcttacctccccggcaggctcagtgagaaccgtgcgcccggcggccccactctcctcccaggccgctgccacgccctccaggaaagctcttgtaaagggattagcacttttttcctttgctcctcttgccccgagggtctctgcttacccctaaaccaagtccgtgggagcccggggcacaggcggtcccggcagtcagccttcgattcccgccccatccccatccccctttgtccgcggtggatgcggcgtccgttctcaacccgcagggcctggggccgggcctcggcctcttttccccgtggcagccgcaggccctgtgtggcagggatggggccccgcgatctcccaggcaggtccgagagggatgtgtagattcattctcctgtggagaacaggtggccccgagatcaggcccttttttgctctttgtattttattttgaaactgtatttaatgcttttatatgaaagggggaggggcggggacagagctgacccagtcacccttatgtgcaaatgtcttatttattatgcgtgtatcagagataagctgtgaggtggtggagggaggacctgaaggaaggaggagcgagggcagaggcggggacgggaggaccccaactagctgtgctgatgttaatcccgctgggagactccgggccctactgtctgctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcctaaggttcaagtgcctcaggcccagtccccttgacgcttcctgtttgggagttggattttataccacggattttatagcatttttatataattgaggattgtcagaattggaaagggccctggagatcactagtactaccctcctcaccttcacagataggtaaattggagcccaggaaccgagatgatcacacagccaggtagggacagtacaagaactagaatgaaaatcctagctcctgactcagtgttctttgcacgatgccacactgcttcccaattcgctggtcagttattaaaatttgtcaggcctgccgaaggattgacatgctgggcaatgcaggccaccacggtggatctgtgactcctgaaggtggcaaagccctgcacac

SEQ ID NO: 10105 - DNA, 1013 bp, Homo sapiens
cagaatctgtggtgttagcaccagctgggtggccacattttagggttcttgttgcagaactctcaatctaaactagctcaaggtcaggtgtgatggctcacgcctgtaatcccagtagtttgggaggctgacgtgggtggatcacctgaagtcaggagttccagaccagcctggacaacaagacaaaacctcatctctattaaaaatataaaaattggctgggcgtagtggctgacacctgtaaccccagcactttgggacaccgaggtgggcagatcacaaggtcaggagtttgggaccatcctggctaacacggtgaaaccccgtctctactaaaaatacaaaaattagctgggtgtggcggcaggcgcctgtagtcccaactactcgggaggctgaggcaggagaatcgcttgaacccgggaagtggaggttgcagtgagccgagatcgtgccactgcactccagcctaggcgactgtctcaagaaataaataaataaatatactagcttgaacaaaatgggggatttattggctcatggaactgaaggaagggctgaatgcccaattgtgggaagggcagggatacaggccgactttaggaataaccggacccaggacataaatgctaccaggacgttcttttcacccccagtctctgcctctgtttgtgtacatcagccatactccctttcctgcagcctgtctttttccacatggcaggagatgggccactaattcccacagactagcttctagctctgtacatgtcaaacctgtttctcctcctctgtccacgtgtgtgttcaatgctaggcactgtttacatcctcgtatcaccaaatgactttctgccctgcacgttggtgtaataaaatgaggtgagtcagattggcgggcatagaattattcctggaagctgttcctacttttttgttaaagtatcctgtattgtctgatatttttgcttttataatcagaatttaaaatgccatttctattttttaagaaa

SEQ ID NO: 10106 - DNA, 1033 bp, Homo sapiens
tccttccagcatttaggggtgcggagcggctggcacaggcctctcacacaacctgactgatggagagatggacggggcgggtgcccctggaggaagtgggcccggagtccaaccttttaacatgggctgagatttatggagccgccgccagcacttgctgggactgtcactctgctaatgtgattggaacacagtggaggtggtggggagggggctgtggtagggacgatgctggggctggaatggagcccagcctggtccccggaggtgctctgccctcccctatacccctgctcctcccaccatcctttgagttcatccagtcctaatcgcctacctgcccaagttagaccccatctgactctgcccagacacacccatcttcccgtggggtccctggacatccctcctacaggagttcaggcctctacccgcgcccctcccatgaccagccacccattgttcgaacacgcacaagggccatcctgcctgccctggccactctgcccagaaccctgatgcactgccctgctccatgtcttcgtcccgcagccctgattccctgcttgcgttttgtgtttgttcttcattgcctgcctccccaccggaatggactcccccgagggcagggttatgggagattctgagctcctagaagagcttcctgctttgaagtaaataattaacatctgtggtgcagtgagtggcaccctctgtgtgccctgggagccagggacacagctctcagtctggcacccacatcccatcccctcaccctggggactgccagtctgccagtccctcaatggagaggggcagcaggcaacaccctggccaacaccccaatcagcatcctagccaacagcccaaccaacatgccagccaacaccccaacaacatgccagccaacaccccaaccagcatgccagccaacaccccaaacaatacaccagcaaacaccccaaccaacaccccaaccaacaccccagccaacacgccagccaacaccccaacaaataccccaaccaacatg

SEQ ID NO: 10107 - DNA, 1042 bp, Homo sapiens
gtcactccccatgaggttttaaatctgccttggtaggtgaaactgttcaccgagcaagagctgtgcacatacagggtggatgaggggtccctgcggcctgagcagagggaccccacctgctctcagtctgcagggaggaaccaccaatgggctgtcccgtcccctacgttcagcccccagccaagctggtcccagaggctgccctttctcccagccttataaacacggggctggctgtggcctaaagtggcacaggggcacccgggtccagcaagcacttagggagccgatgaacacacaggaagccctgtttcgtgagagctggtgcgacgcaggctggcctgcagggaggcctggagcctgggagcccagggcaggcttgcttaggggggtgacacgggcgcagaagctgaaaggaagggccaaggctgtacccgggctgggtggggaagctgggagcaaaggaggggctgtcctgtggcagtgtcagcccgatgggtgcagaccagctccgaccctggtaccttgggtctagggagtgtagatgagtttagaaggcagagtggaggtcatcccagggggtgggacaggccttgcaccagccagaacccttccttcagcccagggttcgcactaccccatcccacaccaaggggtccccaggatgggcctcacacccctgccgggttctctgctgtcccctatgagtgctgctggtgggcacagccccgggtggtgcctgtcccctgtgacctgtcggccatgtttctccatcacaaccagccctggctgctgccatccggactcagggctggccaccctggccgcagcctttggggcatgaggtttgggccaggcccccggctgttgcctacagatggagacccaggctccgtctctccgtccgtctgtcttctctctagtacagcctcctgttcccgcagctgctcccccttcctccccaccctcctcccctcaggcagcctggttgggctgtgggtgtaaatttccactaggagagggggcctgttcattctggcac

SEQ ID NO: 10108 - DNA, 1039 bp, Homo sapiens
atttgtttgggaaagtaactaacagaagcaagtagaagggggcaggggggtgggggtggcatggtggtggcagaggcccaggaatttgagtccagcctgggcaacatagcaagactccgtctctacaaaaaaaaaaaaaaaaaaaaaagccagcgtggtggcacacgcctgtggtcccgctacttgggaggctgaggtgggaggatggcttgaaggatggcttgagcccaggaagttgaggctgcagtgagctgtgatcgtgccattgcactccagcttgggtgacagagtgagaccctatctcaaaaaaaaaaaaaaagtctcatttactcctctaaaaattaaaattggaccttgatagtatcatatcaaaagtgccctagctgcctaacttggagccagagaggcatgcagattcggaccccatccacagataacccaatgcagcaaatggggggtggtgctcagaaccctgaatggtgaacaagaccggtgatcacagtgcagagccggggaggagctgcctggggactgcggggtcagaggcaggggacttggaaagcccacgaagctgttgggcgcaggaggcaccccaaggtcctgggaggccggcctggggtctgggcgggccaagcccattcctcttgcctagcagagggccctcacctccaggctgcgggctgggggcggaggctcagcgtgaaggaagggcagacggctgcaaagtcggcgcgcggagcatccatctgccctgacagccagcaattacaccgcgtgatcgccagattactccaaatgcatttattacaggggttagaagcgggggacttatttactggcaaatccatactcattacaagactcagcctagcctagactgaaaacagctcaactgaaacaaataattaccaaagtccttccagcgcgaggctctcaggtggttgggagtgggggggacgccaagccctttccatcaagacaagggaggaggaggccgcggttgaggatgcctgggtcggggaaggtcgacgccggcccg

SEQ ID NO: 10109 - DNA, 1032 bp, Homo sapiens
accacataagatacaaataacctgttaacatccggaaagggaattactgttggtggctcttaagacattcctctgccgtgtttatagggggtacgggctctttcagataactttcatctttggcctccctgttcacacttacctcctggctccagccagcagaatcccacaagcacctctctctctggctagcctatttcgacgccacacaccactccaccctccgtcacctctctccccacttctctcactcttggatgacaagccctgagcgctgggccgtgtggcttcctccccatggctcttggcctctccttatgagctggaaggcaccaggcagggtcctcggaaccccctggcggctcactttgggtacccaggtgggctgctggcggtgtggggtgtggaggtgcgttgtgttggggaaaaacagcctaaggctagttttggggttttgtgggggtgtcttctcacctgcgtactcagaacttttgaaaatgggactagcccgaggacaggtgggctcagaacattgcaagcctgcgttccacacaagaaaggtgagagaggcctggagccgcctggctccagggagatgaactggtggcggccccgcatccgccatggctttgattgtcggtttgtggtgcgtttgttttttcccgtctacagaggaagcccgatgagttcctccaggtgggtggctccagatgcagggattctgcgggggcagcaggcaaggcagcaggtgtcgcctgggatctggatttcttgcagcgcctctgtggggccctcccccagttctctcccccttgtcatccactcaaggcaagtcttggagaagggaaactgagttactgacacaggttggggcagccaccggatctctcagagtggctacatttctccatctggctcacagctggcaacacgtggatccaaggcagggtggagcgaggtgcttccaagaggtaaagctgctgagatgagcccctctctgtgccagctgctggcggggcaggagcaggacga

SEQ ID NO: 10110 - DNA, 1025 bp, Homo sapiens
ggcaggacaggaggtgaggatggaggaggagggtggggcagagagcacctgtggggcccacgtcaccccactcagggccaccggccactgagaattaactttgcttctttggaatataaggaaaaacccgttaactgtatccagacatgaaatcagatctcaggcagaagtaatgagttcttgttttatgttaaatttagcagagactgctattgttctcatggaaattttgttccttcctgtccccctccctttgggatgtgagagaggcagatgaggctccagagctgtgagtgtaatgggtacatctaggggatggggggcgtctggggtggtggcataagctcatgtccccaaacacccggacagtcccacttttaccccggagccacttggttgctggagcctcttccaggataacccatagctcctgctgacacatacttctccatgtagagacccctcggagtctacgttcagctctggttcagctctgggtccccttgtggtgactcaggtgtcagtagacctctggggcctgtgggtggggacagagggcccttcttcctgcagcggaatcattttggttgggatggtgccggagggaacagtctccatcctgccgggtcaccgcctccgagccagggcaccccaagaacagagctgaccctcgggggcaaggcccggggaggggtgggctgagcctcgggggcaaggtccggggagggggtgggctgagcctcgggggcaaggcccggggagggggtgggccgctgagaccacgtgtgccccggacacctggcccctggcccgatggggtgccaagccgagagtcagcagcaagagatgaccgtaaaagttaaatctttctatttatttcaagaaagaacaaggcaagtggacttggacattttctatgaaaatagacaaacagaaaataggaccaagtagttaatcacattcatctcaacattgaagtttcaaggcacctacaagaaggaggccaaagggcggttcgcagtgca

SEQ ID NO: 10111 - DNA, 1015 bp, Homo sapiens
gtcttcatccagctcctccccacgggcccgctcccgcgtcgacaggaaaatgtagcccccgatatactcgtgtacaattcggcagctggcagacacgcagctgaaggccacattgatgtgttcatcaaactcgatggccacctgaagggcagacagaggggcaaatggtgggtgggataagggagcagcccctgccccaccctggctggatccagctccggcctgcacctgtcccccatccatataccctgggtctgggcccacctgccggatgtcccagttgacattccactggcgcatgttgctgaaacgccaggtcttgaccacgtcgcccacggccaagtcgatgcggatcagtcggttgttggcgatgcccaggatctcgtctttcctgctgcccttgaacctggcccccagggagagagagtgagccagggctccaccctgcatggccagagcccgcccagacaatgtggcgccgtgctggagagccagcccttcccgactgcagctcaccagctgtgtaaccctgagcaagccatttgggttccctgggcctcaagttcctcatctggtaaatgggggttaattgataaaatccccacaacagcatttagcagcatcgggcaaacaggccaagcctttaaatggtaactttttttggtttttgttaccatcctcatcaactgctgtctccctcccttctttgcagtcttgggaaacaactaatcaaaggggcccactccccataacagcatccaccgctagccctgtcttgcggaccggcgaacccaggcccagacagtgaactgtccacagcagagctggagcaagaactggttcttctgctctcctgacctgaaatctcttttttttttttttttttttttgagacggagtgtcgctttgttgccaggctggagtacagtggctcgatctcggctcactgcaacctccgcctcccgggttcaagtgattctcctgtctcagcctcccgagtacatgggattacagg

SEQ ID NO: 10112 - DNA, 1040 bp, Homo sapiens
ccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggtgtgttcccaccccgcgccgacaccccaaaatcggtctcgcgccggtccgcctggcagctccactgtgagctcgcctgtcactggagtcaaagggcgctttgcttccccgcgcgctcccctcccctctgcactcccgcccccaatatatactctttcttgcctgacctaagtcacttctgccttctccgttgcctcggaccctgccccccatcatgccactccccaggtcaagcctagtgtcctccagacgcctcaaggggtagcctgagccttgggcaagaggcaagggggctatcctgggctggcagcggcaggaggtctcaccgcctggtgcccgctgggttagactgtggttacaaggtgctggtctggtaggacggctgcggctgggctgttctgtgggctagcctggagctccatcttggcgtgcgtgcaggctagcccgctttctgggctctgcttctccacccccatgactccctggttgttcagacggtgactcaggccccggggggcagggtggaggagtgggtttgcccggtgctgcctgcctaccctagcccagccctggaatgcagctgactacaaacaggataggggcttcctggggagggtgtggcagggtggtgggcatcccctccctcaccaaagcatggg

SEQ ID NO: 10113 - DNA, 1037 bp, Homo sapiens
agacataaataacctcgagtgagttcaggttgtaaaagtgcttcagggttcattaaacctgcatacacaacaccaaggaggggcggaggaagcagggaaacagatgagatcgtgctgcccaggtgtgatcatgctgggctggggcatgcagtgtcaccccgggacaaagcctggaaacagtggggagtgatggcatgacaaagacggaaagaagccacagaaaaggtagttggagaaagttaaaaatttcccagtaaaaatgttcctgagagcaagcgccctgggtgcaagaggggagagtagctgggaaaggatggaatgaacttggccttccctgcctgtaagatgtggatggtctatggggatcgggtcctcagtggcaggaacataaagtcttgcaggaaataggggtcaatgcaaagaaggtgtgtgtggccaaagcaggctgccacgattgggctgtgaggtgacggcatggttaacaagctactgcctgcctggcagtggactgccaagaagtctcagctctactcacagcaaccctccaagggacaagtgcgggctgtgaagaaccttggatgccaggccaagctggagtccaagctgtgcttagtggaggatggggatgaggcccaggagctgaggctggggtgcaaactgtgaaaggggaagagaccagacagctgccagcattgtttttttgtttgtttttgagacagagtctcgctgtgtcgcccaggctggtgtgcagtggcgtgatctcggctcactgcaacctctgcctcccgggctcaagtgattctcctgcctcagcctcccgagtagctaggattacaggcatgtgccaccatgcttggctaatatttgtatttttagtagagacggggtttcgccatgttgatcaggctggtctcgaactcctgacctcaggtgatccacccacctcggcctcaaagtgctaggattacaggcgtgagccaccgcgcccggccagcattgttttttaatggtttatgaaacacttcttaagagaaatt

SEQ ID NO: 10114 - DNA, 1019 bp, Homo sapiens
gagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggtctgcttctttattttctttttaatgcctgccccgcccggtttttcttttcacataaacttcctctaccaccagcagcagcagcagcaccaaaggtgccttaactttcgttcagcaccaggtccgggggggtgagactgtgggtggttaattagggaagcccaccacctgcctcctgtgtgtggctttggtggtgggagctcagtgtgtgggtggctccacagtctcccctttggtgactagttaacatcgctgagaaccaattttgcccctccttgttcactgctcatttttctagtctctgtcctttgaaggctttttcctggggctcagacgtccacgtttgatgagctccagtggtgatttgtgcctggaagctgccacctaaggccctgggcctggggaggcatcaacactaaaggtcaagc

SEQ ID NO: 10115 - DNA, 3644 bp, Homo sapiens
attccgcatgttgaagaaagctgctctggctctgcagttcccattatcttggaaaatcagctgtgtaacatttccctggcgtcactggcaacttttgtgaaaccctcatctctctttttcatgcacagcctcattggtcaaggcccgagggccaagtacattgtccttgaacacacattccattcttctacacgcctgctccccatatgaacagtgagcctgaaaacaaattcttagcactttatggttactggtttattaagatatgtggtttgtcatttaatatttgaataaatatttcatataattgaataagagctgcaggtattgggagacccttactagtacaggtctggttgtacagaaagagtatgtacaaatttctataaggtgttgaattttgttattaaatgtcttatttaaggaattttaaatgtattaatgaaaatgatctttgctcaattggtatttttccttgtcccatgttaattgggtctcattttgggctatgtttaacatttaatgaagaaaaaactcaattcttgccctcaagtaatttgatgggagtcgggtattggtgacgtaacatggtttatggttctgggtaccaatggtaagcaagccttggtggggaggaagaggtgaaacacctcctaataattgcttggatgttagccttagtgaacagtctttattgctaacccctcttccaacaaactgtttgcttccttaagtgataaccattttgaagtgaaaaaaacctatagatgtaaaaggactcctgccgataggtggttgggggtttttgcttcaatgtgttcactgatcagtcgtccctttcaaagtctccgagttcttcatgcttgttgttgagatttgagatgtttattggtaacattgtcttttttccatccttttttttctttcctaacctggtttcttccagtgcaactgcagatagaagacctgactcgtaaactgcgcacaggagacctgggcatcccccctaaccctgaggacaggttgggaaacagttttaaccagctgacagtaacgcttttacctttttctcaatacgttttactggtggcaacatattgtgtcagttcaataaaatcatagtatgacgactgtaccctgaccactttggggattaaggtttaattagaaatatgtatggtcagtcaacagttagaaaattggaataaaacttaaaaatgttgggagaataaaaagttacaggaaaatggacaactggtttccaattggtaagcatgtagatcttaacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgctcatggttttgagatggtttcaaaatcagatgagatttctaaccaacttctttcactgccagttaactttcagccttggccattgccttgggggtgttgggaggggccagaatattctcacctattttgggaaggcatgcaaccaaccctaaattactttttttttttccttaaagggagcgtgggcctcaaacagctgtggtcatgtcatttcagtttgcagtttctctcacctcagaaaaataaattgtgtgggggagatgaacttttttaaactggaattttattagctgattgaacagctaaaattggtcatttaattagaagggcagtaagtctctccctctcactgaattttctcttagtacatacagaatagttgaaaagactttgctttaaaaagtagtgtttttggtttttgttacccagttaatagcttattaaatcaggaagatgatgtaatggctttagaagtcactcactcatgcatctttcttccgccctttgccaggaaacattaacttccttgtttctccatattgactctttaatttgacttactacatttgctatattttacctatagatagattttggttgtagggttgtgttgtgtttcgtttctttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatctagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgaccttttattccatcgtgtgtgtaacgtggtgtgacatggttccctttaggctgaagacagtgggagcagccgagttcagtccttgctctccaactaggcaaggttctctcaactaaaccaagggtataggagtcttgattactttcagtatgtttttttaataacctgatccacatggtctcttcccttcttgcagctgctactaaattttcattcagaatatcaagctatggtcctttttgtaatcttaactcaaaattctaggagtgtaacctctcttttttattaccgcaaaatccagctgtggtaaactgaccattttatcattacatttttttacttgtagcaacagcattttactccttaaaaaaatgagagagagaaaatctgctttctggacttgtaaactctggtggagaatcataggttttccccttgctgtttgcaggttcagaccctagacaagtatgaccaaatctgcatttgcagcctctcgcagaagctgctttagcactttaacgtttttctctacccagactccccaacctcgaacagccagaaaacaggttgtctcctgggccttggacacagccagccaggccattgaaggaaaagcaaagacgaagcgaaccatctctctccattgtgggggccaagtagctgcagtagccttcagtcccagttgcattgggttaaagagctcatacatactatgtgttaggggtacagaagcttttcctcatagggcatgagctctccaagagttaaccttttgccta

SEQ ID NO: 10116 - DNA, 2540 bp, Homo sapiens
cttggtagggtgtaactaggtttagttgtggtccggcctctcgtacaaaagtgactggtgaggggagtggaggtgggtggagcccccagtcccatcaggactgctttacaaatctatgattcttcagtgtatttttgtctcccctggggatttcagagcactcatggttgatgtagtatctatctaacactctctgcagccatatgcattaagattaccacgtttatatatctgacagtttttctagacaaaagaaggtgaaatgttaacttgcctgaccaaggaccacatacccttgtagtggccataagctttaaatctctgatctctgaggtttgttttctgtttttttaatgtttaagttttaggttaagctctcagcttcacagtctgctgagtttctgtgtagtaccttaaatacccttagctgtctgttgataactacttgtatttacatcggatggattttgtctctgccttttagacttcccaagtaagaagcggaagaggagccgctggaaccaagacacaatggaacagaagacagtgattccaggaatgcctacagttattccccctggacttactcgagaacaagaaagagcttatataggtaaatatacgttctgcatccaaatgcactttgagattgttacgatttattctgagcaagatctgcattttttgaaagtttgagattgtagttatcttttttgagatgagatactttcacgactttggtatcatctgtcagtttttgcccagtgagttctgcatttgcagctccttgttttggtctgttcgtaactgcagtgttctccatgagtatcaggaaggtagggtttcacttaggagtaagaacagtccccagtccagcagccacccttttcagctgctgttcattgccagttgatgaggtgagtgtcatctgcctctctggacaggccccagtggagaacaccgcaggtactgtaaaccaagtacttttcacagcgtggcctttcaccataattttatatttctccccctaaaatgtggtcttttactttttataggtactttctgaaaaaaaaaaaatgacaaaaagtggttctgaaagtgtgtttacaatttacccctttttattttcttgaatttaagagtttaaccttcccttcaacatcttttctggtttggtctatggagagctgtcttaaaatgaaggctcttgtatttacttttaaagaactctgctgggaaagggatattgcatggatatggaatgaagtgctaggataaaaaggttttatttgctgggaggttttgagaattaatgactatccacagtggaattgaaattaacctcaaaattgcttttttggaaaaaaaagtttttaatgcaagttttatctttatatacctgtgcagctgtctcaaaaaagttcactttataaacatttcctactaaccaaataaacatcccctttggaggaaattcgggcaaagacctcctaaacctacgaggctgtggccttcacaaccaaaaagcttcaaggccagcatgttactacttttgagggtcttaatttcctgttttttagactgctgagaattttgaggcgttggaattgtctgtctcctttcacagtactactaatacttgttctttcccctactgttcctgtctactcccacccattccattgtgtctcatattagactagtctgggtctttacatccttgtgaaatgcccctagtggagtgatatcccaagaacacaagcatacttagaagatgggaagagcacaaattctttatatctccatttctgtttttgtggagggctagttagttcactgggccctaaggactatttatagctataatcaaaatagaatcaaaggagaggtgtagttctccacagaagagaatgaccctttttatttagatcaggccccacatctccatagtcagctaggaagactcaccttctcccctcagtgaaggtgactttcacctcgagttgttgagcttaatactcaactgcaaagtcagaactttttaggcataaaggagcttggggaaccatgtgtcttactacttttctgtctcccacggtacatactgctttgtccaggatgccctcaatatctttttttttttttttttgagagactgagtcttgctgtgtcgccaggctggagtgtagtggtgcgatctcggctcactgcaacctgcgtctcccgggttcaagtgattctcccacctcagcctcccaagtagctgggactacaggcgcacgccaccatgcccagctaattttttttgtagttttagtagagacggggtttcaccatgttggccaggatggtctcgatctcttgtcctcatgatctgcctgccttggcctcccaaagtactgggattacaggtgtgagccactgtgcccggccagtattttctttcgataataatgggttttcatttcttcagggttttagtgtgtgggtgtggtatagccctgtggatgtatttaaagttagaaggaatctttggttag

SEQ ID NO: 10117 - DNA, 1065 bp, Homo sapiens
ctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggccctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtcagccctgttgcttgtttctgagggatagctattgtcccaccagaccccagattcctgggcccacaagccactgctcagcttctccctgatcagtgctgacccagccagtcctaggggagagaagtgcaccaagggttcccagtgtttatccaaaggaggaagagcatctccgattttggtcactggtttcatttttttccttgctctaaaccacctcttctctgaggttgttcatcctcagggctgggtggggtgcaagcccttgagtcccaagtgtgtcgaggctcctggtcctgggtgtgctggtggatgagtgggcacatgcccccacctggggtggtggagccgcttcagtagatgtagggcatgatgcggtaaggcacacgccggcagtactcctgccaggccaggccgtacttctgcaggcactgccgctcatcccgggcctcacggtgcaccagcagcgcggtgaagtagaggaggtagaagtagggca

SEQ ID NO: 10118 - DNA, 1051 bp, Homo sapiens
aaggtatcggaagctcaattgcatttgaggcctttccatttgggcttctgatacttttaggttttgtaaggttagtgggagccactgaaggtgttatgaaggacagcagctaatgtccacatgcacattcagacacatgcacagacacagcagacttcctgctgtacatactttgaaaccaaagtggaaattcaggttctgaacttgtgtgaggcccttgaggtgcagccccagggaaagaggggctgggtttccagctgcgctactcttgccccgcagacatagatgagtgcagccaggacccgagcctgtgccttccccatggggcctgcaagaaccttcagggctcctatgtgtgtgtctgcgatgagggcttcactcccacccaggaccagcacggttgtgagggtgagtgtcctcccagctcctccctcggactggacaactcccctgagctgcagctgggattcagagatgtgtcctggccccaccctcctaaatttggggaaccggaagaaatctcttttggctgggggagtctggtggggccagacgatgaagggtccagaacaccacgttgagaacagagccaactctcaggaggaggctaaggggagccagggaatgtggggggaaagacctgtggtgggtgggcagggtggacagggccaaggggggtctgtgcacaaccctgagctgccgtctgcccctcagaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcaggtcaggagccgggcaggccccttcccagatcttcagtttcttcatctggaagccaaatgtgggaaatggcgccccctggcagttgggaaataggcggcgggctgcagccctaagcccacgcgcgcgctcagtcctgcctcttccctccccacggccgccctgcccctgc

SEQ ID NO: 10119 - DNA, 1035 bp, Homo sapiens
aaggctgagacaagacagagccgatcctggaacccaggtctgacctacaggcccacgatcaagcggcatacagcccaggcctcggctcggggcccagagtctcatccccttgctcagacctggcctgcaagaagcctcttccctggccccatggcagcccctgtgcctttagcaggctccagggagaaaagaaagacaggaagcccacctggcatttggtacccaagggaagctggacccagatgggggaaggaatcagcctgtgtggggtggagccaaacaagtgtcagccacactgtgcttctcagagccccttctgggagcctgtaggtgaagaagagaatgagaaggccgagcaggcaggatccaggacccattctcaccacatccaggatagctcggggcctttctgttctccatgacggtaactgccctactgtgccaggcattccctccaagcattgatgaagaggggctactattaccccattttgcagataaggaaactgaggctctgagaggtgaagtaacctacctcaaacccccagctgaggatttgaacccagagaggcttcagctccaatgctctcgtagtgagctcagaagctttcacttgaagaaagggcttctcacgtatagactgcttaggaagccagagggtcaggcagaaggcagggctccagcattgcagggaggagggctcactcagctcaacactgcccagctctgagtgaggccagagagttatggcctcccttgcctgtgggtccctgtgccaacctagggaccatcctcagagcccccacacctgctgctcacagccagaatgtaggacccgcttagctgctctcagaagagtcctgttcagcaagccgtttaaactcactcctcccatcccacccagcccatcgcctcttccattccctgagctacacttgatagttgtaacaacagctaacctttgttggttctcttctatgtgccaagcagttctgtgaggggagtagtagtattggcctgcattttacaacagag

SEQ ID NO: 10120 - DNA, 1066 bp, Homo sapiens
gccatcagagcagacctcagccagggccacagaggtcccaaccgtctctgccctcttctgctgcccctgcctcatgggctcccagccacaggttccccatgggccagctttacgcctcctgatccttccgattggggcagactaggagaggaaagacgggcctgggctgggtgcggtggctcatgcctgtaatcccagcactttgagaggctgcggcgggtggatcacctgaggccaggtgtttgagatcagcctggccagcatggcgaaaccctgtgtctaataaaaatacaaaaattagccgggcgtggtggcgggcgcctgtaatcccagctacttgggaggctgaggcaggagaattacttgaacctgggaggcagaagttgcagtgagccgagatcacgccactgcactccagcctgggcgacagagcaaggctctgtctcaaaaaaagaaaaaaaagaaagggcctgggacagtggtactgttaataggtggagtcaggaggcctgtctcaaacttgagatgtggcaataacttgctttgtcacctcggcaagtcatttccaaatcaggaaggggtcagtttcaggaaacagaaacttctccagctgtttttggcagaaggggatttaagggaatcagggtacttaaagtacatgggaaggctggagaagtcgcctccaggaagctcccactggagctgggatcagaacgtactgtcctgcctgccatcccctgtaagcacccaggaagctgggcttgggccctgggacatggggtgggactgccactcctgcctcctgacacccacaaagccagaagcgtggtgctgctgcagaaggactgaacatctccaaggctgggcccgcagagcaaacttccttggccctgtgtcctccatccatatccttcaaaggacacctcattagtggactccatttctctcttccacggaactccagtggcaagggaatccagaaacgttttctttttgcctggagatgctaatccttagcctaagaataaggaaactggtccatgtaaggactgaccatcctttcacc

SEQ ID NO: 10121 - DNA, 2065 bp, Homo sapiens
gctcgggcaccccgaagcacgacgcagagtaggaagagtttaaagacctcgaggcctctgggcacttgagtttggcatgttaatttttatcagcgacttctggggcctagcaccattcccggaagaagggagttgtcgggcagggtccttaatgggggttgcaattcttgtcttggttgggaaagagcctagctgggaacaggggtcgtttgtgtagtaactgtattaagcagttctggtgggtttgttgtaactgttcggtgtccttggggtcccatctagcattgtggggtcttggctctttctgaagaggagtcttggctcaggtgtttgggtcctccatatccgaagttctaaatcaccagttttatccaaaggctgagagcaagtactgtgagtagcaaatgagtcagtagccggtggatcttttaattctgggttcacattttggtcaaggttctgcttttcacgagttttgcatttctatcctgtaaaatgagggaaggggttgttgaactaggtgatcagaggccatggctgccattctgaggttgtgtcccatctggttctttgacagtgacttgggtgggaaaactagtgacttgccttgggaagggcactagtgaccactcgggacgtggactgagatcttctgaaaaaacaaggggcagttccctagaatccttttcttgacgtatacgtggcatgtctcctaggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctggtgagctcattctggcacttcttcctgtcacctgccccctttctcatgatgggaacttctgtggctcctggtcaacccagatgtgtgggtttggagggggagggggttgtaacaaaagactcctcactgccagcccaagggtttctcaaagtcacctgtggctttgctgttgctgggagttgcctgacgcgtgtttctgtccagggcccccgagtctgcgccccttaagagcaaaatgatttatgccagctccaaggacgccatcaagaagaagctgacaggtaagggccagcattggtgctgagtgcccttctgctctggccttggctgcagggcagggtgaatggcacgcagagggggtctgcccccttgtcttcgctgcctgcttgttccttccatctgctttgattggctccttcccagccacagaaactacccccaccccagtgcttcctgctcacagatgctcccctttcttctttatagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctc

SEQ ID NO: 10122 - DNA, 1041 bp, Homo sapiens
aagcaaggactgtacctgaagcttcttcctctcaccatgtccccacaggggagggcgcgggtgccgacgagttcctgcctctgctgagcctcgtcttggcccactgtgaccttcctgagctgctgctggaggccgagtacatgtcggagctgctggagcccagcctgcttactggagagggtgagggacccccacccacctccctgtctgggtgggccctgaataagcagggaaggggagaggggatggggtgccccacacccagcctgagccgtgttcttccaccctgtgtcccaggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccaggtaacaggccctccaccgtgtcctcagagccagacgccatccccgcctttcaccttcctgtccttggtgaagagtccagactctgtagacagatcctgggttctaatcctggctctgccactgggttgtggggacttgggcgagttacttaactacttcgtgcctcagttttctcatcagtaaaatggggtaataggacctacctcctggggttgaggtgaagattaaatgagttaatgcaggagagtgcttggggcacaaattactcactatcaaatcttcatctcaggcttgtgagcgccccactgggctgtccttgcacctgcggctgtggcccacaagccgacccctggagcacatagagcttttgccgcttggttctcccactggatctccacctacccaccctgtccctgcacagcccagaaagctgatgtctcagctttggagccagatgcatgccagccggggctgagtacttgtttttgcttctcctcctgcatagcacctcctccgagtagcctatcaggatcccagcagtggctgcacctccaagaccctggccgtgcccccagaagcctcgattgccacc

SEQ ID NO: 10123 - DNA, 1056 bp, Homo sapiens
ttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccacagctggctccgttactctcctgagctgggggtggggggatcggggccggcttctccccttgcacgccgtggggagatggccgcggacgaagggcaccgtctgcaaagcactgaaccatcagggccttccctgcaggccgaaggcctgcgcgaatgtcggccagttactatggagaccggcccgcggtatcccagcatgcctcgggaccaaactgtccaactgtgagcatccccgacggtcgcctcctgatgacgcac

SEQ ID NO: 10124 - DNA, 1082 bp, Homo sapiens
cggggccgtggctcctcctccctcgtagggggcgagccggcgcgccgggggctgggggcggtggcgggcggcgggcggcgggcggcgggcggcgggcggggcggcgctcggggctcggctggcctcggctcgcctcggctgcgctcggcaggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgag

SEQ ID NO: 10125 - DNA, 1125 bp, Homo sapiens
acgccctgtgtgggcatcctcatgtccatcgtgtgttacctgagcctgcctcacctggtgagcctgctgttgggctcgaggccccacctcaaagcatcttggatagagtcctgagcctgaggccctgagagaggccaggggaggtggaggagacctggtctcagccctgacccccagagaagacactgaggggccccagcctccaggccaatggtatggggagggatccagacacctcaggcaagccaggcaggcccaacactttcctgtccttctgcagaagtttgcccgctactacctggccaataaatcatcccaggcccaagctcaggagctggagaccaaagctgagctcctccagtctggtaagccctgagaccctcctggggaggtgggagatgcagaggaagctagagccacctcccctgggaagctgttccatctgttcccagccagagcccacccctagtagccttgtgcaaacaggaagatcatgaagggaagttggtaggattaaagtcatccctgctgttgtttgggcctcagtttccacctctataaaatggggaggcgacagaggttccatgcatgcaaactttggatccgaagacctctgaattggaatactagtttcacaacatcccagctgtgtggcctgagacaaaccacttagccactgcacccctctgaacctcaatgtgtcatttgtaaagcaatggtaatgagataatccatctaaggtgcttcgctcatcacccgacccatgcacgcgcttcctggtagctatgcatatttccatcatgaattcccttcgcctgcagcctcagcttaggctggaggaagatcacctttttttgttttggggtgagggggttgttgttattttgagtcaggatctcactctgtcacctaggctgcactgcagtgctatcacaactcaactgcagcctcgacctcctgggctcaagtgagccacctcagtctcccgagtagctgggactataggtgcaggctgccatgcccggctaatttttttatttttgtagaaatggggattcaccatgttgcccaggctggtctcgaactcctgggctcaagcaatatgcccgcctcggccttccaaaa

SEQ ID NO: 10126 - DNA, 1051 bp, Homo sapiens
cctcaggaagcccgaggtcggcggtgtgatccgggcgatcgtgcgggcaggcctggccatgcccgggcccccactaggcccagtgctgggtcaggtgcggccgtggcgggaacccgacgtgggggttgtctaggatggtggaagctaggacgcggatggagggcgctggccctggaaccacccgggcctcggttcagagctcggctctgcttctcacacgctttatgtccttgtgctggttacaaagtgtcttccacctgggcttcctcatcccttcttcaatgtgctgtaatgaggataacgtgggaagatgcgtacgatcttctggctcacggaggggtagttgaatctgggtacagatgggaacccagagaagtgaagacgaaggagggaacggacggcgcctcctgggcgataggaagccgtcccctcctctcaccactaaccccctctgcttccctcacagagaggcgtttccatcaaccagttttgcaaggagttcaatgagaggacaaaggacatcaaggaaggcattcctctgcctaccaagattttagtgaaggtggagtctggactctgatccctggtttccttctccctctgttcttcctcggccctgggactggtcatctggggttgtttctctgctcctgacttgacttcctattactgggctccactttccccatttaggactagatcatattttttctgaaccagccccatcttgccatgttgcagttcctccctttgcccctccatctcactggggcttccagagcagaatgagggcaggaatagaggggacagggatgtttgctgcagatttatttttttctttctttttttctgagatggagttttgttcttgtcgcccaggctggagtgcagtggcacgatctccgctcactgcaatctcctcctcccgggttcaagcaattctcctgcctcagcctcccgagtagctaggattacaggcgcccgccaccacgcccggctaattttttgtatttttagtagagatggggtttcaccatgttggtcaggctgg

SEQ ID NO: 10127 - DNA, 1046 bp, Homo sapiens
ttgttgtttttaattagtgaggagctacaagaacacatttataaaaattaagaggaaacagccccactgcatttgagaaggttaccatttccttcgaagttcctgctgttgccccttcctggtgggggagacactgtcctgtttcagtcattccgttgctttgctttatagttttattaatgtgtttgtgttggctttgcatgttttcaaatatatgaatgaaatcatgcagagtttattcttttacagtttgccttttcacttgattatgttcctgagatgtatccggattattgtgtgtagctgtatggcattccttttccctgctgcctagtgatccattgaaaatacaataattgatttttctatgtggttccactggtcatttttctgcccctgtgccctttgggaatcatctcctaaactctagtctcggcccttgctcttccatgtaaccttgagaatcagcttgtcaaattccccccaaaaaccccttgagatgtagaatggaacccagctgaatctatagatcagtctggataaaatcagcacctgtgtaaaattgaattttcccattcatgagcagggtttatttctgcactcaatgttttcaataaagttgtgtaccttttcccataaagatcatgcctttttaaattggattaattcttaagtatctgatatcgtatgctattatacatgcactatcaaaatagactgtgagcctgggcaacatagtgagaccctgtctctgcaaaatacaaaattaatgggggctgggcactgtaatcccacactttgggaggctgaggcgggaggatcacttgaggcctggcgtttgagacaagcctggacaacatagtgagaccctgtgtcttaaaaaaaaaaaaaaagccttgtgtggtagtgcgtctgtagtgtgggggatgggggtgggctgaggtgggacgatggcttgagctcagcaggtcgaggctgcagtgagctgtgaccgtgcttctgcactccagcctgggtgacaagagctagactctgtctcaaaaaaa

SEQ ID NO: 10128 - DNA, 1779 bp, Homo sapiens
ttttattgcaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccatctttgcatagtttctggcccctcactttgttgctggggctgtttctgggaccctctgtagggcctggaaactgcaggatgcctgagggtctcaggggctggggctctacctcccctggcctgggtgagttgggggtggggcaccagcacgccaaggcagtgtcctactgatccaggctatgagaatccaaacattctttcccaggtttggcattttatagttagaagcatttctgcaacagcagtttcatggaacctctcttagctaacctggtccatggggcagcagttacgctctaagaatccatgtggtaagatcatggtgcggcaaatggaggcagggtccaacccaggtctttgtgcttttgcctttacccttgcacagctggaggaaatgagtaggaaagaaatcaaggtaaagaaatgcgctggggctgtttgggcatctgtggagggtggtgctgacagggctaggcctgcacctctctggcctcctcaagagctgcttgttaaatgtttccgtgtaaatagaatgaatagagaccgccatttccacatggcaggcctaaacacatgtgttcgtctcagttttctcttaggatctctctaagatgatagtaaagaaaatcaaaaataatacaaagggaaagaaaacaggagggaagacagtagaacacagagcctgaccacattttcttttttctctctgttgccggggctggagtgcagtggcacgatctcggttcactgtaacctccacctcccgggttcaagtgattcggcctcccgagttgctgggattacagacacccgccactatgcccggctgatttttttttttttcttttttgagacggagttttgctcttgttgctcaggcaggagtgcaatggcgtgatctcggctcactgcaacctccgcctcctgggttcaagcgattctcctgcctcagcctcccgagtagctgggattacaggtgcccgccaccattcctggctaatttttgtatttttagtagagacgggggtttcaccatgttggccaggcaggtctcaaactcgtgaccttgtgatccgcccgccttggcctcccgaagtgctggaattacaggtgtgagccattgcgcctggccatgcccagctaatttttttgtatttttagtatagacagggtttcaccatgttggccagg

SEQ ID NO: 10129 - DNA, 1052 bp, Homo sapiens
caggaagctgaggctggaggatcccttgagcccaggagtgagagactgcagttagccactgcactccagcctgggcaagagtggctcctctctctcttaaaaaaaaaaaaaaaaattaaaaagcaaagccacagcaatttgctcttttatgtgaattgagaagcaaatgttatgaacctgtaataagttgtaccctatatgcatgtcagcaagacttgagatctcttgagaccaccatgcagctagtctgtgtttatgtgtgaagcaaatgatcttaaaatttatagtttgccattaatttttacttttaatgcagctggatctagcatggggtgggacatgcttccgaagtaagctggtataaatctatcagataacctgtctcttatgtttcaaagttaaatattaaattcatatattgtggtcttcaaaaggtattgctaggacattttaaaatgaattttgactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaacacatttagaatagtgcaattcgccatat

SEQ ID NO: 10130 - DNA, 1045 bp, Homo sapiens
ccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaccgcctctgggtgtctttgctttcctgaccacagcctctctgcccaagcctgtgtcctctccttccgttctggtctccttcatctcacgtttccccagcctccaagctcttgaagagccgtgtcacactgagagcttccctgacctggtctcatttccctctgacagtgacctccagtgtgctgggttgaccaatgccaagcctctttttaaaccaaagtagttcaccatgggttgggatgatgtcaacaagcagtattcatgttaaaaagcaatgagggactccttccctggtgcacaattttcttcacttgtgatctctaaactgttttcaaattggaagactgggaagcattgctacagccccagccagtctcagccactgctcagcccagtggtggaaagctgagcacacagcgggtgcttactgcccccacttgccgtctgctctccagtagatcaagggacctcagacagggatctgagaagtggcaggttccaataaactgatcaacagaatgaagtcactctgggaagccatgaggtgactttacagcccaagcatgtaaatatacacacagaggataatatatattcttttttttttttttttttgagacagagtctcactctgtcagccaagctggactgcagtggcgcaatcacagcccattgcaacctccacctcctgggttcaagcaatc

SEQ ID NO: 10131 - DNA, 1024 bp, Homo sapiens
tgagtgctgtgagagtggccccgttgaagcctggggaataaggagagaggagatatggaaattctagaagcagcaacatccagggcagtccatggaggatgagtagaatttggacaagtggagatatggaggaaaagatgtttccaggtagagaaaaccaaacagaaaaccagtggtaggcagtgcctgtttgggagcaagggggtgagtgagtccagcagcagcacagaatgtgtgcagggccccatggaagaagaggtgggagagaagccccgggaagtcctgaccaccacatgcgtgtgcttccaagtgttgattgtgctcagggttgtgaagctacccaggcagtgctagcctttgatgctctccatcctgacagccacagccacctgcaaaatggcctgaaggcagtgtctgggtttgtgttcccctagaagcagaccctgaaacagtgattctagggaggtgtccccgggaatgatcagtaggggggtggagccatgagaagggacagaagtcatgccagttacccccatgggcatcaggagcccaaccctcatggggcattctgcgggggtgtagatggaacacagaacacagcactctcacagccacggcacaaggatgctgtgtgtttatccatcagctccctgtctgtcactggttgagggctgcttctgggcttgttaactctgtggctcttccaatttgccttccacacagttcaagagagcacacttccctcaccaccccagacacagaaatcctcaagcagaaaagctggaagtggggaaaccaggtgggactcaacttgctatcactgaagtgaagagtaatgagttgagaaatacaaaatgatggcaaataactcaagtcaatgtgcagtgtggtgccagaaaccacaggcaccaaggaacccaaactaaagagagtgcaagggcttcctcgttgaaatgctgtttgagctgggtcttgaaggaggagtggggttcatcagcagtgagggaacagcagtttagaaggg

SEQ ID NO: 10132 - DNA, 1029 bp, Homo sapiens
acagtttgtagaaggaaagaatgccactttctagtcattattgcctgtggggccccatatgtgctgcctgcattaccctgggctgcacactgctgtctgaagcactgaagcccatcacccctttcttcaccccgcaaacccgtccctctctggcccgaagtcgttggagcctttcctgaccaccgcattgctctgagctgctgctgccttcctgcttcactttctgtgcttctgatgtattcccgtccccaggcttcccaggtggcttcccctcttcccctgggggctgatttccactgagcagccaaccgcagcctctggccacaaggagagcggagcacaggtagggcaagaagacagaaggccccggtggtgagtggagggcttggtggtccctggacacccctcactggccacattctccttgcaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcaggtgaggtcagaggagggtcgaggtggggggatgctggaggaggctttgtcagctcgtcatgaagagccctttaactttatgggaagactgacttttctttctaagtgggagacccagagcactctatcaattccctggtccccacatccagcctcaagaataggctccaggccattcagaactttccccagctcttccccccaagcatagagacgcttcactggcccctggactggctgagctgactaaaacagcttccctctctggcctcagcccccgggtcatgtcccttcatccttcggcactctcgctcttgccactcctttctccgcctacctctcccttacctgtcatgcccttgttgtgtcttctttgatttccactgtcatttcccacacctgttcccagtctattattccc

SEQ ID NO: 10133 - DNA, 1122 bp, Homo sapiens
aggtatgggcagaggtagcaacaaaccagttttccttgaaggtgaagaggggcagagtgagttccaaatatgtgtcttagcttgaggtgtggggcaacctcttggcttattcagaaaggcaaaggattggccgaggagaagataggatggagtttacattcttcccttagagaaattgatgtgaccccgggttggggaagggagatagcaagggagtgaagaatctgaatatttgaataaatctgccataactggaggattctagaagagaaaataaaatttcagtccccctcttcagcccagttcctaacttcctccgagggaattgatcaggaacacagtctgagaggtgggtcggggttttgctgttccttccttctgccctgggcccatctttctcttgccttcctggaggccctgagctgatttgtgacttctttttcgttttatctctctgccagtccacccatttatacttagaagcaaataagatttgaactttgccaaagtccccatttcttctaatctattattcatctcactgtcatttgttcaactctgccttcccgtgacttctctagctctgccgttctcctcccgcatatctgcggttcgctgtgctgtttctttcattacctgtggtacctactccatcttcatcttcctctcccatcgcctgagctcctgaggggaagtgatatttgagtttagtgtggggtagggcctgagcagacctagaagctaaccctgggtcacactcacccctgaaactttgtgtcttctcaacactcatggctcctctaaccaattccagctgcttctcatctttggacaagggtggccctcaaagtgtggtccccagaccattagcttcagtgtcacccgggaacaggttagaaatgcacattcccaggtaccaccccagaagtactgaatcgtaaactgggggatgggggggtgacctgtgatttaacagtcctccaggttgttgtgattcatggaagtttgagaatccccagacctgagctgttgagctcaaccctgaaagtattccagcccaggagcaggtcttctccaatcccgtgttcattctttccttgagcttctctctagtcctaagaa

SEQ ID NO: 10134 - DNA, 1029 bp, Homo sapiens
tgtctcaaacaaggcttccaaaccccctaggtcctgagtagcttcgctctgcagatgacaaaaccgagactcagaggttaagttgcttgcccaaggtcacacagacgtactgtagacccccatcatcatctacgcagctgttaaaggacatagtcatgtaacccgtgtggcacaagcgccttctccttcctcctgcccttcgctaacgttagcttttcctgcgacctcttctccgctagccagcgcgtatctgcgtctagccgggatgcctgagccccagtgcgaactgttgtgcttgcagcttcgggagacacgtgctactcgggtgaatgaatcgaacgtccccacccccgccgacagccaataactgcgagccacagcccggccacttccgcctattgcgggcgtcggctagggtccggcggcccacgtgaggctccggagacaagggagtaggcggtggtgcgccaggggcgggctctcccagcctcgccacttatccaggcgctcgccggggacgggaggggcggggctgacgtggggcgccaaggcttaaacgtgacggacaggcgggcacagggaggagtccagagcctaggggcgaggagtgacggagaacactgcccaataacgggaggggttgggctgtctgggccaataggaagtccgtaaggcggggccgggactgcagcaagttcggttgcacggagaccgcagctgttctctgtcagtggaggcagcagcggtagaggcggcggcgaggactggcgacggcgaggaggtgagtgtccgccgcgctccgcacggtcctcttcccgcggcgggtcggagcgggtggacgtgcgccggcaccgctgcgagggacgcttatgtaagggtcgcgcgcgcaaaggcggcgcgggctccgcgagtgacggctggaggagacagcgacgggctgtgcgcggtgcgcgacgcgacgcagcggacggcgcccctccccctcgcgcgggggctcggccggctggacccgcccccggacccgccccc

SEQ ID NO: 10135 - DNA, 1010 bp, Homo sapiens
ttcctgatttggctggagaggagaggatgcaggggttaagtggtgacttcctggagggggtgggccaggaatctctttgatcagaattcaggtaggggcctgagggaggcatcccgggggctaccttagctcagctaggagggaggagcagcaagtcttatgaactgggccacatggagcccaagcccccaccttcccaggggacaggagctggaaagcacaggagcccagggacaggctgggctgggggccagccccaacttcctgtgctgaaagtgcactgggccatcctccccagcccacctgcccttccagccacctgcttcccccagcccaggcagctcctgcctcccagcagccctttccctccttggcctgggaggaggctcagaggggcggcctcagccagagaaggaagctggcagggccttggggatgcttccctgggtgggaggggtctctgagtacagctaaccgagaaggctgagtctgcagggctggcagctgtgagcactatagggttaggggctggggcctgatagaaagagaaggggcgggagagaacacattgcggggaggtgcagaagctaggagttgcagtctcaggctggagtgcacagacatggagagaggaggagttggggggaggtgccctcacctgtgagcctggagctgaggcactggctggtgacgctctggggagcccaggtcctgggagtgcgagtcggtgtctgagagtgtggccaagacaaagtggccgtccagcaaagagtccttgatggtgaagatggcgggcctgggcaggggagggggcccaagctaggtcatcccattcagctcctgccatcccagagcccttccctgtcccaaggctgggaactacctgcctggagcatcaaaatgaatgctaagattcaagtttgctgactctgcaaagctcaggagcccctgggaggaaagaggtagcaggtgaggccccgggctgggctgagctgggcagggaggacagg

SEQ ID NO: 10136 - DNA, 1071 bp, Homo sapiens
ttcatgtacgggcccctggacgtcgtcacgctcactggagagaaggtcaggacccagaggccctgtcgcctggtcccatggccccatctcctgtcctcggaacagctcctggtccctggtggttgtgcccctagacccacccatccccgacgacagccccgcctctgcccacctccacgcagggcccccatttacctcccgccccttctcccctccaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggtgagcgcggctggccgggcctctgcgggagggctccgccaggcctcgccccgcgccactcacgccccgccccgtgggccgcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggtaggagttgccactgccaccaccacccatttcaccggggtgaccggcccctcacccctggccagcggagctgaccgctgcccccgccccacaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtgcggcggctgggggaggctccgggtcctgaccccgcccccgctcccccttaccctccacccccggatcggcggaggcccatctgttcccaactggatcggcccgggccctgcctgactgcagcggcccgctacggtcctgctcccctagtttgaggggccccgtgtacttaggggcaactagggagatgc

SEQ ID NO: 10137 - DNA, 1034 bp, Homo sapiens
cttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcagcggttagggacagtccatctgctgccctccactgcagcccccactgtagtctggcctgggtgaggacaaggcctctcctgatggtgcccctgctcccacccaggtcgcactgattggagatggtgttggtggcatcctgggctttgatgcactctgccacagtgctaacgcgggcaccgggagtcggggcagcagccgccgtgggagcatggtcagtatagccaaacccggcctcctcaggagcggaaaggccctctctggctctaggtctctgccccctggaatgccacccctctgccagcaggcaggccccctgctgccctgccagttcatgtcttctctggaattctgctctgcccaacccccaagcctcgctcctcacttctaagtaagtagaattcgaatggtccccaggcctaagaatgtttctgtctcctgttccatccagaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacaggtgacgtccctgccccatcacccctaccctgggcacatgatggactacagaggcagcagcactgagcacccctcctcccccacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctcccc

SEQ ID NO: 10138 - DNA, 1050 bp, Homo sapiens
ttcatggcatgagaccagcattacccacaatggcagtggcagcagatggaggagatggagcagaaggcagcagagggcgtcccaggtagtacgggcaagccaccttgtgcatgacttgtgtcttaggtgtgactgtgtgtcctgggatcagttctgggtggtcagaaaagtttgaagccagatgactccactgtcaaaaaacctctgtagagttttctaaaggtgaaagtatccagatgaagcagggctccttgaaggaatggctgcttctggagttggagcaggggagatacaagatgagcctggagctgcttgtagcaccagaggggaaggaggtggtcacaacccaagaggctgggacatcttacatgggcttctgagcccgagcctcagacaaaccacacgaccttggattacagcccctggagtcaaataaatatacctgagtccgtagtgacctaaataaacaattcaagagatgaatctttcttacagaattccaggaaatagatgtagatactgctgttagccaagaatacggtatccagctaagactatgcttcgtagatgaagaaataaagcctttcccagacaagcaaaggctgggggaatttatcactactagatcagtcctgcaagaaatgctcaaaggagtcttaacataaaaacaagttggtatttgccataatacacacaaaagtacaaaactcacaggccctataaaacaatcatacaaaggaggaagagaaaggtatcaaatggcaatacaacaaaattccaccaaaccacaaatggaataagaaaagaatgtataaaataactagataataactaacaatatgatagagcagcatacagcttaattacctccacctggtgagggtggggtaggcttagagacttgcttccaaataataaagaaacaaacaatagtagcttcccagggaaaccctggcagataccgtcctgacccggtagtgaaggttccactcactagccacgtgtgcatctcaggtgccccagatgtggtgtgagaggcaggctcacctc

SEQ ID NO: 10139 - DNA, 1047 bp, Homo sapiens
agcctccacattcagttctctagaaactccccaaaccctgtcctcttgggcattttatggagatgtcattggataggcatgattgaaatgtggacaaccgtgttgaaatgtgattggacaaaaaaggtgtgatctaaacctagcaagacctgaccaggttcttcgggcttctctgtacagcattccttatcccagggtatggtgcaggaccccctctggaataagagtcttatgacccacagtcagattagagtctagctttgggcaggtgaaaggacggcagaaggtcagagagagagattctgtttactgtagtaagggctatgggagttatgagccagggaccctggacaaaaacacacatatatgtcatcacagttggactttatcaaaatgagtaactctgaacgatatcatggagaaaatgaaaaggcaagccacagactgggaggaaatactacaaatgtatatttaataaaggactcatatttaggatatataaagaactcataactcagccagaaaccaaacagcctgcttcattattattattttgagatggagtttcgctcttgttgcgcaggctggagttcaatggtgcgatctcggctcaccacaacctctgccttctgggttcaaacgactctcctgcctcagcctcccaagtagctgggattacaggagcccaccaccatgcctggctaatttttttttttttttaagtagagacggggtttctttgtgttggtcaggctggtctcgaactcctgacctcaggtgatccacccgccttggcctcccaaagtgctaggattacaggcatgagccaccgcgcccggcctcagcctgctttataaatggatggaagatttggacacttaagagaaacacatggccagtaagaatcttttcatgtgttttgtataattagtcattaaagaaatgtgaatcaaagcctcattgcgataccctacacacccacagtgatggctaaaacttgaaagaactgacggtcccaaatggcgagcacatggagcaatgggaatg

SEQ ID NO: 10140 - DNA, 1061 bp, Homo sapiens
atccaaatttgaaatatatatgaaacttaccattttattgtcccctgaggctgtgtaccctgagactttgcccttttcaccgtgttcctctcaacttctagggccctgctttatagaacttgctgctagaacaccttggccctgctcagtctctgactgtagccctgtgggggccatgcctgttctttcccatcacccttccttggtttgttttgtgcattcctactgagtctccctacctcccatcttcctgtccccatatgctggtcaaattcttagatttcaaggccttgctccaagaccttgcagtcttatttctaagcagtcaggattattttccctttcttattgtcccaaggcagttttaatgttgctgtaacatttaccagtataccatgtcttagagttacatgtacatatctaaagcataggtcctgttcctctacccacccacccctgactccatgccctgcacaatgcttcatgcccagaggttctcatgaaccctaagtgttgaagtgtggctctgagccctggcaatacttctttgattggcaatgctcgtctttgtcagcctgcactctcttcctagatagatcagatattccccattttcattgagcgtaagttccttgaggactagaatcataagctgctagcttttcctgccctgctgcatgagatatcttatccatgagaggcctgggcatgtccagggctgccctgtacatctgtgcagatggagcccagcactaggatgcctggcagaggggtgctctgctgcgtctggctggggaccaggggcaggggtttctttgtctaatcccacagcccagaaacagagaggctagttgtgctctgtctccccagaagaggtatcctcttctagttgacagtggcactgtccgtctgtgctagtgttgtgctagctgccagtgctgaggatgtgtttagatgagtggatggtgccttcactgcgctggctttttcctttagtttgctccctggcacctggctatgttttagtagagacagggtttctccatgttggctaggctggt

SEQ ID NO: 10141 - DNA, 1043 bp, Homo sapiens
ggtcctgtaataaagagggatccgaacaagctcagaaagaaaatgaatttcaagtaagtaattcagtctttctgcatctgtgtgagatgtgaactagtgttagccacccttcgctactccagggcttggcagtgcctcttatctacccttggaaaatcctgatctatctttctacgaggaggggctcttggtatatctatcagaagccaccttacggagactgagtgagcggtgggtattcctcattcctcctgagagtgtagactgtggaagtttggtgtctttatggcaatcgaaacagcattcggatgttggcagatggcagccaggggagcattcgtgtgtggtacctgatgaggaggccctggctgccgctgctgtgatgcctctctcaccccctttctggtcgttcccacacttcccatcaggaagcgggtcactgcccagtggttttggtggccacccattttccatgggctaacagcaatgttttttcctatggatgatacccaagttggaaaagcttcttcctagacttagagaatgtgaccccactctctgaaacacacatgtgcagatggcttgaggccaagagcactgaccgatggagcctcagaggcaggggtctggggtgttggtctgcatgccccagcgtaagcaccttttgagcatctctgccattatgtgcaggctcacagagaagggtgcatgtgcacacatgcccaacatacgtgggtctaagatgtagatacacacatcgccacatcacttttaccaattgtatattgattattaaaatggtcaagaaataggctgaatgcggtggctcacacctgtaatcccagcattttgggaggctgaggcaggtggatcatgaggtcaggagtttgagaccagcctggccaacaaggtgaaaccccgtctctactgaaaatagaaaaattagccaggcatagtggtgggcacctgtaattccagctacttgggaggctgaggcaggagaattacttgaacctgggaggcggaggttgcagtagaccgag

SEQ ID NO: 10142 - DNA, 1855 bp, Homo sapiens
tctgctttaaaaaaattcccttatacttttgagtatggtttaattctgtgttcctaaggcagtcaaaacttccttctcagaagtaaaacatttttctagtgttgtgcgttcccatttggtctaacctaatatttctttagctgatactctcccaagatagttgccaaattactaccaatagtccttccatacctgctttggtgccttcttttgataaccaaataaaccacagactactatgtctaatttttacatattcagagtgtctttgtcttgctggtattaaatgtttgggatttatagcatgaagccaatgcggatttctggtccatggaacgatggtttgaccgcagcccacccctctttgggaaggaatgtctttatgttgggtggagtgaagggcgttgggggtaatgtaccactttagctgtatgtgcatgtgttctctgctgcaggcttgtccatgcgatcgtgcctggagcactctggtttccaggtgacagacacgattcacggtatagtatgagacctctgaagttggagcattctctacagctttaatttctttcttttagttcttggattcaagaattgcttttaaaaaagaaagttgtaatgcttgttaagtagcaccagctacagtttgtgctgtgcttaaagaggtacagtgattaagatttcagaatgttgtgtaataaatatatcacttattttttttgtccaaagcaaatcagattcctttcttctgtttcctcagtagaaaatgacaaacatttaggaattttagaaatttatgggcctcaacttgataacttaattgaagtaatcaagttcttccttcatatcacttccagcattaaggagacaccatatatattttgatattttggtcagaattagaaacaaaccttcttctttgtccttaccagtcagtatactttcatatgtcttagctgggtacctgagaccttagggagctctgcagtgctgacttgatgtagtgaaggcacacttcccgtaaaagtgttgcttgcaagtcaacctttgggatacttagagggagggtattttatttagtcttggaagtctgaggagtgttgggtcagcaggttgccctagatcagacatagattttgagaaggtcctgaaataggcctttttaaaacctgggcttccactcacctgtctttctgctggcttgtgttgcctaaagtgttttagaagttctagtttcctacggatattcatcaagtcatccaattttgaaattattaatgtccaaaaagatcaaggtgttttaggctggtccttgggataattgaagacactctagagactaccataaaatgttagaaatcacttatctgtttaaattcttgtaattcatatgtgcttattaaataatcacataagctatactttaaatcattgcattgagatctcacattttaatgtgttctgtaaaatgttttcagaaagtgctaaaagtggccgggcatagtggctcacacctgtaatcccagcactttgggaggctgaggcgagttggatcactgaggtcaggagttcgagaaagaatgctgtaagaaaccataaaagcaagaaatacgggatgatttcattttttttcatagaaatcaggaagaagtaaggttagggtccatgataactctgagaagaaaacatattgccaagaaaatatactgcaaaatgttaattgaaagagtcacataactctttcaattctatagaattgaacacattctatagagtcatggttctcatgctttttcctgccccacctctcctgagatggaacatagcttcatcatcaacagggacttggcaggccagg

SEQ ID NO: 10143 - DNA, 1031 bp, Homo sapiens
ttttcagagtattttgcatttttccttaattatatgacagatttagtttagtatgtcccttctttccatttctcttccttgtttttagcttttgaacattttacctctgtgagaatcagaggtggtaacattttacacgttctttgatcagcaaatgatttacaggtgacttggtttaaaataactagatgattctcaactttctcatttttcttcatcttggcattataagatgtctgatttcctttatttccatagtgacactgaaatgactgctctttggtacagttctctaagggttaagtgccagaaagccaaggtaaaactttctgattgggttcagctccacagcttctgtcccacaaacatctgtctcttctagcccctatttctatctaagatgagacggaaacaaacttcctgactgtatcctggagtttttgtttagtatttgtgttagttttagggtgcttatgaaaattcctgtgtttggcaaggtcaagaatgggtccttttgaaaatatgaacaagataagacacacacaactatacaatattatttgtaggaaattattaaacataaaaatattggtctgatcttaatgcatgtgagtataatttagcgtctgttttacatagactgtctttaattttaatggaaatgagattattttcattagctacatagattatgaaaaccaaactcaactgtaaaactaccctgaactaaaggaggataatttaatagaagttttgagaagtaatagttcagcctttgcattgtggaaagagatagaattgctagaagagagcgtaaatgtataaaattagctataaatgtaacttgatttttttcctttctgatactgggaaggaacatgagctctgcaacgtccagtagcagccttttcagagaagcaagtttggctgattacaaataaccagtttgcttatttatcatgaattgtggaagacacaaatgtcagtacgtattgttcattcaatgtaacctgtgccagttggcggaagtc

SEQ ID NO: 10144 - DNA, 1023 bp, Homo sapiens
aaatacaaaaattagctgggcatggtggcgcacgcctgtcatcccagctacatgggaggctgaggcaagagaatcacttgaacccgggaggcagaggttgcagtgagccaagatcacaccactgcactccagcctgggccacagagtgagactccatctcaaaaaaaaaaaaaaaaaacaactctaccccatcagttttcctacattaccagtatagcaatttcaccactagagttaacactgcttgtactcgttttgttctctgaatgcagtcatcaaagatgactttgacatgggtggttagaacatcaaggtgtgtttcgaagcctgttggaatacttagtttggggttttttctgactgtgtacataaagaatgtttttgtgtatggcatggttttgtttacatcatcatacttctgaaattcattgcctggcactcttccagcttgattttgcatgttttaaaaagattcttgtcattctaactctaaattaggtgtgctgtattctagagctttgattttgtgtctcccaaagttgacgactagtgtaagtctgaatcagacagcttttgtttgaatcgtctgctcacctcacagttaatgagataacagtgaaataaaaataattaaaataacagattgaaaaaagagaagttactgagataacagtgaaataaaaatattaaaataacagattgaaaaaagagaacttgcgtatccaggtgatcagtattacttgaatagtagtaatcaagactattgattgttgttctcttctcttagatctttgctctgataaccatggctgtttttagggtattagctctttctcaagatctgttaagatggatcagtggcgcaaggattgtggcagataacccattcattcttttgatttctttcagatttaggcctattaaaggaaggcaggaagaactaaaggaagtaattgaacgttttaagaaagatgaacacttggagaaagccttcaaatgtttgacttcaggcgaatgggcacg

SEQ ID NO: 10145 - DNA, 1040 bp, Homo sapiens
atttatataaatttaccacttcatcattttcttttttttcactctgtcacccaggctgcagtgtaatggcatggtcatggctcactgtgtccgcaatttcctgggctgcagccatcctcccacttcagcctcctgagtgtaactacaggtgcataccaccatccttggctaattttttaatttttatttttagtagcaatgaggtcttgccgtgttgcccaggctggtctcgaactcctggcctcaagcagtcctcttgccttggtctcccagagggctaggattataggcataagccaccacctggcccatttgcttgttgttaatgcagctttttataggatacaacaaaaaacctaattctaaatttatcatgccaagtttatgcatctgtaccaatgaaagcttatagccacagaacatctgtttttcagaaagtgctgtttctttggctcttgtcttaaaggaacataagtaatatgaaagaccctaggggtcaaggaaattgaagaaaactgaggaagggatataaaatggaatgtagtcacggattttagtccctttaagcttttacttttgtgagatggctcaatgatggagagctttaatgcagatgaaccttgaagcttttaaagatctaagtcttgacgaggttattgaaattcaaatcttcaatgcattgtgatagtaggctataatttttgaacacttggccgggcacaatggctcatgcctgtaatcgtagcactttgggaggccgaggtgggaggatcgcttgtggccaggagttcaagactagcctggccaacatggtgaaactctgtctctactaaaaaatacaaaaattaggcgggcatggtggtgcacacctgtaattccagctacttaggaggctgaggcatgagaatagcttgaacctgggaggtggaggttgcagtgagccaagatcgtggacactgcactccagcctgggtgagggagcgatactctgtctcaaaaaaaaaaaaaaaaaaacttggtacttgatgctctcccgaagt

SEQ ID NO: 10146 - DNA, 1047 bp, Homo sapiens
gggaggctaaggcagacgaatcacttgaacatgggaggtggaggttgcagtgaactgagattgtgccactgcactccagcccgggcaacaagagtgaaacttcatctcaaaaaaacaaaaaagaacccactccatgtgtgttcacggatttcacagtgtttctggctaaacccctcctctcttcctgccacacactgtcgtccattgtactgtagctcaacatgtgaaaaacagatgtgttggccaacagcagtcctggggcagttgggcaacgaggtggaggaaagtgaagttggttctctccatcctctcacagtgtctccctgattggaggggcagttgccccttcactgaccagggcaggcagtgtccccaaagggaagtgggtcagggtgtcctggggaggctgtcacctgctgtcagtcagcaccgtggtatggggacatccttaagatcatttaagtttgagacatgcggcctacactgacagtgattccaggaggtaaatatgtatgtgtttaaaaaaataaacaagggaggccaggcacaaaggctcattcctgtaatcccagcactttgggaggccaaggcaggtggatcacctgaggtcaggagttcgacaccagcctggccaacatggtgaaaccccatctctactgaaaatacaaaaattagccaggtgtggtggtgcatacctgtaatcccggctactcaggaggcagaggtaggaggattgcttgaacctgggaggtggaggttgcagtgagccaagatcatgccactgcactccagcttgagtgacagagtgagactccatctcaaaaaaatatgtatatgaaataaaaataaaataaatcaataaacaagggaaatgctgggataaaacctagttacttagtgtacctggacagccattctgagcatgatacctgagtcagtttcctggggctgctggaataaatgaccacaaactggatgtcttaagacaaaagaagtttcttctgccacagctctggaggccagagtccgagatcaaggtgtcagcag

SEQ ID NO: 10147 - DNA, 1041 bp, Homo sapiens
gttagttaagaaagcggccgaacatttagcagtcaggcgctgacgtttatttagctcgcgctgtgagtcagacactgagctaaacgttccaccctggttatctacttcagccctacttagtaagtggatcctattattcttcggaatttacagactaggaggcacagtcactttccagggtcacacaactattaagtggggagctatgcaccctgcttcatggggcgctgcagcccactccttgcatgtttggtgactgcaggttaagatagtggcagttccactgttgggcctcagggtcagtgctactccgggtaccagtcggagaacattttgtggtgatctgatgccatttctctctgttgccctacccatgtgatgtcaaaccctgtgtatgttgcagttttttggaagcggttgacttgggctagtgctacttgaacactcacagaactttggccccctaactctggctgcaaaccagacttatctaggagactttgaaaagtagattccgggccagatgcggtggctgacgcctgtaatcccagcactttgggaggccgaggcgggcggatcacgaggtcaggagatccagaccatcctagctaacatggtgaaaccccgtctctactaaaaatacaaaaaattagccggatgtggtggtgggcgcctgtagtctcagctacttgggaggctgaggcaggagagcgtgaacccgggaagcagagcttgcagtgagccgagatcgcaccactgcactccagcctgggcgacaaagcgagactccatctcaagaaaagaaaagtggattgcaggccaggtgcggtggccctcacttgtaatcccaacacttggagcggccaaagctggaggatcgcttgagcccaggagtttgaggctatagtgagctgtgatcataccactgcactccaggcagggcaacagagaccctgtctcaaaaaaaaaaaaaaaaaaaaggaagaaagaaaagtagattccagggccttgctccagacgtactgaatctctgggggtgag

SEQ ID NO: 10148 - DNA, 1049 bp, Homo sapiens
gtctcgaactcccgaactcaggtgatccgcgcgcctcggcctcccaaagtgctgggatgacaggcgtgagccaccgcgccagctgatgacttcccatttcttccttggttctttcggagccactttgggaaattcggttctatctgcagtggtaaaatacaggtcggctctccacgcgcgcggccaatggacgctcccagcgcggacagacaggccctttgctggagctgggcagggcgaaaggaccccagggcggggcttcagtcgaggccggccccgcccaccgctgcagccgcgcatgcgccatgtacaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtgggtggtgaggccgggcccgcaccccgccctgtctggtcgtctcccagcggcttcgccgccggctgcggcccagggcggctgctggagcctggcgtcccttgggcgtgcgcattggggagcgcctggtggccgtggacgcagggacaagtgtgggcctgatgctctggtcctcttctcctggcccgctccggcggggcacgtgcccagctgctcttccagacccgccttccctgtcagggctgccccaaacatctgctcagcctggtggttcccctcctccgaggccgcctcgtcctctgggaggacagacctttgccatctgggagctgcctttttttctggttccttaatcataggacatacggcagtattcatggatgtgctgatagatgtacccgaccacaccccttttccctccagagcccctggggagcccctcgtgctgcgacagtgggggagctgtgagttgcctcctggctgacttccagtgcccggcccagaggacgcgtc

SEQ ID NO: 10149 - DNA, 1035 bp, Homo sapiens
ctgaaaggctattagtgtcacacttagtataatatataattaaccacaaaactttgggcttgtttcattcaagaatgtgtatttaaaacaaagcaagcttaggaatcacagcaatgtgcataacgacgtcaggaggagagactctcccctgacgctctctgccatgctctgctctcctccccactccacccccatgacatccacagacaattaaaatgagtcagcattttcaggtttaaggaaaaggtgaaaatacatttttttccttaaaaaaagaggacacactaacctctttatgatcaattgtaacaacaaaatgatcttaatgggtacggagagcttgtgtctatatatattttaaattccccaaaaactgcactggctttcatggtccacacccctagtctggcactgcagctccgatgactcctgctgtgcctctgagccatctctaggggttgtggtgctctctactcaccaacaggagactttagcaggagtaagtcctgactgtagcagaatccaacctctgtgttcctgatacattgcctgtttcaacagccacgagaggaagcgtgcaaacacagcgtgcagttagtcttagaacatcacatgagggcacaagtagacacacatcttcacacctacagcagtgcctacggagggacctgaggggagctgcctgagtgggcgggatggagccagagagatccaagtgtcacccagtggtggctctccccagctcccaaagagccccgggagactctggaacactactccgaaataccaagcaccaaatggtacagtaacaatttcaaaatgtacatctgcataaatgacccctacttagagtgatccctttatctcttactaaactctgcattcatagaccaatggggctttctccctgccctaagtgctccatctctaacactggtatgaaggaaacaccaagcggcactgctgatgctgcccagccccactgagcgcagaggccaacgacgtcgggtacaagaccagtctaagaggagggag

SEQ ID NO: 10150 - DNA, 1032 bp, Homo sapiens
cccctaagattattttaaagcaaaccccagacatcgtgttatttcatctgtgaatactggggaatatagtcttaccatgtgcccccctgtgttataatcaaagtatcccacttgcctcaccaataaataatatagtcataataatgaaaacagagaacatggatttgatcccaacaacttgacttaacctcagctgggagactgggagaggggaagggaggtgccaggtgctcaaattctcatcagccacaagacatggcccaaaatggaggaagcaggacgccacgctgagcgcatatcatttgggagtaagaaagcaaatagaaggaatagccaaatccattccccatggtctagggagcagggagaaagagaggaagggcaagggcaagggctgctggttttattctttttttatttttatttatttttgagacggagtttcgctcttgttgcccagactggagtgcaatggtgtgatttcagctcactgcaacctctgcgtcttgggttcaagcgattctcctgcctcagcctccctagtcgctgggattacaggtgcccaccaccacgcccagctaattttttttgtatttttcgtagagatgaggtttcactacattggccaggctggtcttgacctcctgacctcaggcagtccactcgcctcaccctcccaaagtgctgggattataggcgtaagccactgcacccggcttgtttttactttaaatgatgtgcatgtatgactttgattataacaaaaaacttaaaaatgaaaatagggtgttggagaattggtgattcaactccctcaagacttacagtttctgtaatacccccattcctaaattatattgcttttgtttaatgagcacattttggtctatttgaagatgagaaccgtgtagtgttaaggcagagtcgtgctttgtcgaccgcccttcatcaggagtgaaaaattgtgctctgttggcttcttttgaggtcgattggcaagacctatttaaagtattcacgaccagtggctgg

SEQ ID NO: 10151 - DNA, 1035 bp, Homo sapiens
cagtgtaaaatttgcaaagcaagaagtatagctgtgctcaaaaataggtcgaagccgggcgccgtggctcatgcctataatcccggcactttgggaggccaaggcagacggatttcttgaggttaggaatttgagaccagcctggccagcatggtgaagccccatctctactaaaattcaaaaaataaaaacaaaaacaaaaacaaaactggtggctgggcgtggttgctcacgcctgtaatcccagcactttgggaggccgatgcaggtggatcacttgaggtcaggagtccgagactatcctgaccaacctggtgaaaccccgtctctaataaaaatacaaaaataagccaggcatggtggcaggcgcctgtaatcccagctacttgggaggctgaggcaggataatcgctcaaacccgggaggtgaaggttgcagtgagctgagatcgcgccattgcactccagcctgggagacacagcgggactctatcaaaaaaacaaaacaaaacaaaacaaaagtgatatctctgtgagccagaaatgaagagaaatgcaaagtgctgagtgggcctgcaactgcaaagctgctgggcctgggtcacccacgcttgtaaaagaagcacgcagccaggggcgcaccagtggtcccagctacttggggaggccgaggtgggaggaatcacttgagcccaggagtgcaagaccagctggagcaacatggtgtgaacctgtctcaaaaaaataaaaataaagaaaaattttaaaaacccatgcagccaaagagggatgtccagacagccttatgtccaggacctgagcaaaccagtccctgacttagagtgcagatgggacctggggcatttgcaccaccacgcagggctgtaggactcaatacaacacgtgtgacggagatgtagctgtccacccagcgcccccaccctcctcggtactaagtggacatgtgggtgtccagctctactacatttcccagcttcccttggagttgggagctgccatgtggccaggttctcgc

SEQ ID NO: 10152 - DNA, 1023 bp, Homo sapiens
gtacatctgggcagccgtggggctcaagtgccatctggacggtggactgcacaccatccttgccacataaacacagcaatacctgcaaccctttgctctcatttcagatgcacaggtgacagccttagacccctgccctaaaaacacccccaggagcccttaccatgcctgaaggggcatggtggaaggatacctcctggtctagccaaccccgccccaagcacaatgccacaatgccagcacaagcacacgtaagcgcacacacacacgcacaagcagccccaaggcgagctgcccacttggcctgcagactggcacacggctcagcgtcaggggccctcctgccctggcctcacacagctcccctgctgcagcctgtgcctggaggccccacagcagcagcgtactcacagcatccccagtgcctttctgttcttccctttcttgtcctttggctcacgacgggccatgtgactaaccactcggcatcgtggcttgtgctgtgtttcctgaacatccggttcatcatctgaatttgtgagtttgtggagatgtagcgtatcgcacgttcctaggaacttaggctttgttgctattgtgacttaaagctaaacctgttttctgcttgtaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaaccca

SEQ ID NO: 10153 - DNA, 1068 bp, Homo sapiens
caaacagtccctacggttggcacgttggtgtgtgcgaggggttcggaggccccagtacatctgatcacctcgcctttttgtgagtttaggtgttcagttttaatcttgttatgcaaaggaacatgtgactctttggaagtaggaagaagaaaagaatgttacaggttgaaaaagatgatattttaaaggttcagtagactcgaatggtcctcgttgggagtgcgcatttcttggatgcacgcgctcttccatgtcaccctgagcccagcctcgtgtacatcagaactccacatgcaggtggaaggggtgggtacgtggcatccagccagccatttggtggtccctgccattgggctggacagacagacattcattctgtaaatgaggagcccacatctccacccgtggtgagagggctacccgtgatcatttctcccaatcaggcctaagctcccaagcttcttgttcatgctatgattctgctagtgatctccttagagatcctcaggactattacggggcaatggaaagtcagaagggaagagactattggagagccaggtaagatggagcaggtgcttaaacttattctgagtgcctcatgttgatctctttgatttgctggaagatgcatttaaattattattgaccaatcagaacctggtttgaatgagaaatgagcttatttgggttcttgtgtgttgaaactgtcgggtgcaccaccagaatgacagagattggagcccgctgtggctttgtgggctaactcgatttgtaaccttcatggaaatgcagagggcctgggttgaatcatcctctgtaggatgcagttgggatgtgagtccccttcgtgtgtgtgtgtctgtgtgtgtgtgtgtgtgtgtgtgtctgtgtgtgtgtgtgtgtctgtgtgtgtgtgtgtgtctgtgtgtgtgtgtgtgtgtgtgtgtgtgtgtgtgtgttgggggggcgtggccttgggcctagcagcagggctgaagtctataggtggtgtaagagtgtgtgcacgtgtgacaggcagggtggggggggtgttgaaataggtca

SEQ ID NO: 10154 - DNA, 1033 bp, Homo sapiens
atgtcaaggatgacggcagtgggccacaggagccttgaggcagtattggggcagcagcatcccccgggggagtatttcggatgcctcaggtctgggtttctgccttctctgtggtcctcgggttctcatccattcctgccacttctgcttaggtggaatggctgtgaaggaagggggcaggcgagccaccaggtagccagatcttctaagcacagcaggtttgagttcgtctgatgtgtggaaagagccctgcatctttgacaatgtgactggcacaggcacgtggttggatttttctgcagaaaccacacctgtgtgtcaccagctgtggggaagtccttgggtctctgtggggaggttgaggctggggggtgcctgcaggggaggttgaggctgggcaggggaggtgtcctgctggccccgagtgtggggaaaggcccctccacgtggggagccccagatagagggttcttcctggatgttgaagctcaacaagggccagtgtgtgaggtagaaaagagaaggaggtgcaggtgcaggccccggggatgtgagggtcctgtgcccggccctgctggctgaggagccccttctcagaagctgaccccactcatctcctgcagaggtgggagggtccggaagccctacgctgggttcttccccgacctccaggatatctgtgatgagcagcccagacccctgcactcgactcttagacctgcctgtggagggatccaacctgggttagctgattgatttgtttttgtttgtctgttttgattgaagtaaaatgtacgtaacctaaaacttaccattttaaagtgtacaataaggtggcagttagtacgtttacgatattgggcaaccatcaccactatctgcttccaaaacattttgtcaccccattagcagtcactcccactcccattgcccctcgcacccacccacctgcttctgtctgtgggctctgcctgcctcggtgctgcgcgtagatggaatcagccgctacgtgatctttcatgtctggcctctt

SEQ ID NO: 10155 - DNA, 1045 bp, Homo sapiens
tttcacaaaaaaaaatcatcatttccatggatggttccagttagagagttttgtcagagagctctcattttaggaaatcagatatcataaaaaggtatgactttagagaaatgaggaaggtacttcccagccccagctcgttgcaaaataaacaccaaagaaatttcagtactcaggaaactaatttaatatgaatcttggtaattacgcgaggtaattttcattaaaatgttcacactgatgtcaccggtgagatttcatttgagtaacttgcgtggtctacagagtaaaaatgtatttgaaaatgtcccagctcttttattccttaatcctccaagggtggcctccccatgtgaattcttcccccctctaagtccatactcttctgacagagtcttaggaatgtatataaataacaacctttgtctgtgcccattttctgacattattcaccaaaattcaccttctggggtttcaatttttataatccatgaacagcatgaaaatttcagttgggggttttggtgttaggttaattctgtatctgttctgttcttttatagactttttttttcctaatgagtttatcttagcaactgccaggactcccccaaatgccatcacttgctatgaagagtatgcatacctcccccagttacaagggtcagaaaaagagaattggctgcattgtcggggcggggaagctgggcgtgaggcagtcggctgtgggaggcagcgtttccgtgactgggggccctgtgatgtctcctccacatgggtagggagagccgtggcctctcctggggtgccccaggaagctgggggctctgcggctgctttctgctggctgtgtctgtttgagattttggctctcacaccaatacagtcttccaacacgtaatctctgtaaatgaaagataatcgctctctgagactgtgggctcatcagccctttgcaaggtcttttaatccacccgcccagccccctccaatgacaggcagttcccggatcacccggaagccctctgggccagtcgtatctttg

SEQ ID NO: 10156 - DNA, 1071 bp, Homo sapiens
gggtgtgtgagaaggcagagcctggggagcttcaggcagaggggaggcattcacataattggtggtgaggtccctgcactgacccagcggcgactgagcacccagtgcggcagtaagtgaccacagtgtcagttctcatcccatcttccaacaacaccaccatggactccccgtcgagccccctgtctgggggaggacaatcaaggagatgatggggacatgccaagatgacacggtggtcaccgagcccagggtgcccaacccaaggaagtatctgctggttatcaggtttctagcccaggacacagagcagacagagtgctgtggacggtcaggagctccatacccgagcctggcttggtggagaggccataggcagcaaggtgggacagacagcctgccatgaaccaactggtctgcacaactttgccgtgaaatatgaaagcctcctacagcacaggctgagattggaagcattaatcactctggtatgggatgtgtggagttctgttggtcccagtgggtttaataacgtgccgatcggtgcatcccaagcattctgtggcctgtggaccgatacattgtcctccctctgaaacctgctggtctggaggcctctaggacagattgtcgggatctatggtgtatgagtttgctccagctgccgtcataaagcaccacagacagggaggcttacacaagtcatttatcgtctcaccgttttggaggctggaaggctgagatcaaggggtctctggactggttcctccggagacctctctccttggcttgtagactttgccttctccctgtatcctcatggggtcatccctctgtatgtctgtgtcctgatctcttcttgtaaggacgccagttggattggatttaggacctgccccatctggcctcactttaatttagttgcctctttaaagcccatctccctatacagtcgcacacatgctgatatcctgggggtgaagcctgcgtcacatgaattttgcaggtgacacagttcagcctctagcactcagcgcccacctggatgtggcttctaactgcaggacgccc

SEQ ID NO: 10157 - DNA, 1061 bp, Homo sapiens
cctcctgccccgaggagctgggctctacagggcatcgtggggtcccttcctcttagcaatcaatgccatgttccactgtggccccagactccagcaccaagcaaagcagcccccacgacccttaggacaatgaggggtgaaaattgccacccatcagttttcaagtggtcagtgtggaggaaaacagggacccgcaggtggccagaacgtggaggagatacaccagggagccggaagtaatgtggtccagggacccatctctcattccacgtagctcacggacctgtgtgcccctgactctggtctgtggggggcccctctgtatgggggccccctattccctccatctgagggtctctcttccctccatccagccacttggtcgtttgcacccactgtgtccaccaagcgcttctagggaagggtcttgtccttttttctccccgtcccgccgagcctccacctccaagcctgcatcctacttgtctttcctcttcatgcgtgtggggtttttttcccctcctttccactgtgcaccccgtctcctctgtaaacttgaaggtagggaactctgtcttcactcatgagtaccttccaacacgagctctcaggagtaaagacagagttccctaccttcaatgtggatctgcaaaaagatctgaaaagcgaatgccttctccgtagctcgttggcagtagtacttgacctgaactgatttgaggctatttatagtttttatttatcctacttagcatgattattcatccgtgccctgaaggactcctcccgcaattggcaatgggacactgcccagacccactggcggtgtgacgtaacaggccacacacgcatcatcctactgctgcagaagcaggcagcgtgcacatgccaaggcacctctggctctggtgttcagggatgtcgtcgtggggctgtatttgttgaatgaacaagagttcttaatccaagaataatgctgggtttacctttcaagtagttcaaaggcttctttcaagacggtgttgttatggaggatgggatgcgtcttgccttaaatatta

SEQ ID NO: 10158 - DNA, 1028 bp, Homo sapiens
agctgagtagaaatggcttgggagcctgatccatggagacagtagcacagagttaccttatgaatgttctgaaatattctcatgatgacaagcctctgggctaatttttgtgtttttttgtagagatgggggtctccctatgtgacccaggctggtcttaaactcctgggctcaagcagtcctctcacctcagcctcctgaagtgtttggattacaggcgtgagccactgagcccagcctcttattttcaattttaaaatttaaggcagaattatggaatcagttctctcctggttgttgccaaatggcaattttatgaaccagctttgcttcttgtagtagctgatatttctctataaagcagaacttcctcttcccctgcctcccttttgtgaaatgagcagagctgattttttagagcagttttaggctgacagaaaattgaatagaagtactgtgagttcccatattgactgctcccccagtttcctctgttagtaatatcttgctttagtataggacatctgttacaatcagtgaaccagttgtgatcctcaagtccaagcttacatgaaggttcacgcttggagtcgtaacccagtagtgatcctcaagtacagagcttacatgagggtttacgcttggtgctgtacccaacagtgatcctcaagtccagagcttacatgagggtttatgcttggtgctgtacccagtagtgatcctcaagtccggagcttacatgagggtttacgcctggagttgtacccaacagtgatcctccagtccggagcttacatgagagttcactcttggtgttgtacgttgtcagttttgccagatgtcctgtatccaccgtcacagtatcataaagatcagcttcactgcccgagagctcctctgtgcccctcttcatccctgagcccctggcagctgctgaccctttcttttttttttttttttttttttttagactgagtctctctctgtcacccaggctggagtgcagtggcgtgatcttggctcactgc

SEQ ID NO: 10159 - DNA, 1026 bp, Homo sapiens
tcagggagggagccatgggctctgtggatgttggagcttgaattggaggggcctagaaggattcctgcaactgaagggtgagtagtgagcggccccacctggtcacacctgatacagcttgtttcttgtgccaggagtttccagagagtccttgcttagccaaggatgggggagggtgcgggtctggaaatctttctggaataaacaactgcccccacccagcctcacagccctgtggggagctttgagagccacacgtgagctcagcctttgacattggaagggagaaacaggagcttttgtgcacagggtcaggtttcctggcagggaggactctggccgcccactgaacccgacctcctgttggccgtcccaggatcattttcccagcgatgaggaacttaccctcgggctgtcttgggaagatgatagggccttttgctttcttgggcacaaacccacagaatcctcagatagagaattggtttgagtcttatattcaatcaaacctccttttgttctgaacactttgacagtgacaaagtgaattattgagcccctgctgacagctgttcagtagaatataattttaattcaacaaaaattagaagtcatggctagaagtggatttgcctggcctttgcctttcctggctcactggtgagtctcacagaggggacctgggaacatgaccaagttgttgttatttcagtcctcagaggtgctattatatgtttgaagtgttgtgattggtttgcaggccctgttgacactatttaactttgcaaaaatgaactctcatggcaactgatttgattttccatcaaatcgtttttccgtaattgctttcctgtgtcctttgggaggagaggtgatgactgcatttttaaagcttttgtgttcagagtcagcgtaggtagtatgaaaactttctcgtcagtgtggttataagacaaggcttccaccgaatctgaaatgctaaagaacgatccatgtcaaaattaagtcacattgaaatatgcgcgg

SEQ ID NO: 10160 - DNA, 1033 bp, Homo sapiens
gcacgtggctgtattttcagagtggcgcagtcatcacccaaatcaatattaacatttgtgaagagtaatctttttttatattcccccccaaaacctgtaccattagaagtcactccctcctcctgaatccctctaaccaatcacctccggccctggcgaccacaaatctccatttcatctctacggatttgcccatctgggacagttcatataaatggaatcgtataatacatgacctttgtgtccatcttctcactcagcatcatgttttcaaggcttgaccacgtttagcatgattcagtgattccttccttttaaaggctgagtgatactgcaccatatgatacagcatctttttaatccaatattatgtttatcacatgctggacatttgggttgttcccactttttggcttttacacacttggacattcttgtacaggcttttgtgtggacgcgatttcgtttctctcgggtagattcctaggagtggagctgctgggccgtgtggagtcgtgtgtccctcagtggaggagggacaaaccatgttccagagagtggctgcgccgttggacctcctctccagcgtcggatgagggctccacttgctccactcccttgcctgcttctgttcccatctctcttcttggttatcttcatcctggagggtgggggaggcgctgtctcattgtggttcgaaagatttgatttgagcatcagcaatgtgcccaaggtggtggtaggtgctgcgggagcctgactccactccttgtccctaaaaaggttgtggtctgactacagagtgggggtgccgcttctggggtgtcatgtctgggttttgctaaataatcgtgtttgcagaggtttgagctcctgagctggcacgcctgcagtgtgtgcagggagagaggtgtagatggatgtccgaggacattagcagggccctgagtgggagccactgtgccacggatggctatgtggggacacctcctcggggaacagttggggctgtggccttctgcaggtgcctgcc

SEQ ID NO: 10161 - DNA, 1649 bp, Homo sapiens
atttccccgaggtccatgggggccccaggagggccgggggtggtcagcggctgcttctgtcttgcaggccatctacgtgattgacttcttctggaacgaaacctggtacctgaagaccattgacatctgccatgaccacttcgggtggtacctgggctggggcgactgtgtctggctgccttatctttacacgctgcaggtgaggaggtgggcagagctggcccagcggggcatttggcagacacatgctaagctttctccttgcagaagcgtctgtccttgggggcaccaaagctgccccctgtttctaggaagaagggaaggcctcgtgtattagccagctcagccagcttgggccagcagccagggaggtggccttgagtatgtccctaacatctgcaaagtagggcagatgccggctcagggctggatggggcagtggaggtggaggtgggtcagtgcgggcactggcaggaggggtcctcttcattcctgcctcctaggatgtgctgggcactggggcagggctgccctgggagttccaggacagtaggggatagcaagtggccttgtcattggcatcaagccccccactcccctcccagctcaacgagagcagccctgctctgatttggggagagtgctgggctcccaggtaaggtggctgcttgaccagatgccacctgcccatttcaagagcaacgagccccctggggacagaaataactcaccccagggcacttgcttagcagaacggtggggtggcctgccccaagaggctgtgcccaagtggagagaaccaacgtggagaggctgtcacctattcaggatgtgacaggcccggcatcacctgtgacagccagtcctgtgggatggaggtgcgggtgtcctggaaaaccaggattcccacagcagagggggccagtaccaggtggagggtgcagagccccagctggccccatgctcacaccaggtccttggagccccccgcatggcccacccggccccatttctccacctggctggctgcaggtctgctggttccctggttttataaactccattttccaaggatgtgaaaacgtagcaataggtcccactatataatagctcttacttgctttagcctctgtgtgtgtctcgagatgtacattttttatactatatattaggtttctcccaagaagcagaatcaatagaggggtggagggtatacgtgtaagaaagagatgtatttttcaactcatgtgattgaagagtgacaagtccaagatcttcagggcagcctggagccccagggaagagttgatgctgtgcttaaatagaaggtcactttttttttttttttgagacggagtctcgctctgtcacacaggctagagtgcagtggtgtgatcttggctcactgcaacctccacctcctgggttcaagtgattctcctgcctcagcctcccgagtagctgggattacaggtgcatgccaccacgcccagctaatttttgtacttttagtagagatggggtttcaccatgttagtcaggctggtctcaaactcctgatctcgtgatccgcccgccttggcctcccaaagtgctgggattacaggtgtgagccactgtgcatggccagaaggccactttttagcaga

SEQ ID NO: 10162 - DNA, 1027 bp, Homo sapiens
ggaaatctgcagggtggctgttttgaactcactactagtttagtttaggggacgtctaatcacttggacgtggagtatgacgatctaaatacttacaactttcatggtgctagaaatcttaatcaggcaaatgtttttcacacttgttcttgtaacaacacttgacttggttctggcagaaaagacaggactgtggtggccagcctaaatgattgatgagaaatttaacctcctatgacaaaaaatcagcactaaggactttgaagaactttttacttagacgtcttcggcaatatcagcgtcttgacatgcaaaactttcacaactactaacaagacaatagaaactgaacagaacaatcaacataaaacaaacaaacagttgactttagggcatgtaaacagttatgacagtttcttccttttttttttttttttagacagacaaggggaggggtttctgtgatgggatcagtcagatgcctgcctggccgctccccctgagcggacttgggctcctcttagcattggcaggccggtataaacttccggctcagatcgagctatgcctgatgctgccttaagccttatgaggtcgccacggaaccgcaggtgagggcctacttgaactccgtagctttcgccgtggagctacaaagtggaggacaagcgcaagcccttgtcctcactcattcattcattattcacaaagagtttataacagtttttttttctttcttggagattcttcaagaaacttgaacaagagaaagatgagagatagaaaaagagagagagagagagtgactggtctgccagaaacctggactcagtcctccagcattctgggatgtggactgagtcaaaggaggacccctgtcagggccacttccctcctagaaagagacacagaggtgcctaacagaaaaccagggctctaccttctagcgtcctagagaaatgggcagagtcaaaagagtgacacactcgtcagggccgcttccctcttactagaactgaaatcaaat

SEQ ID NO: 10163 - DNA, 1049 bp, Homo sapiens
acaccagcatgataaaacagccgaacctgtcagctaccttgcaagtctttcctatatttgattcaatgtacttttcccgaagcaaaatgaaagttctcacagaggggccctcctctgccttgtcctcagaattggaaaatgtattgtccgtgaaggagcctcaccactgaacctaaaactcaagagaaaatgtttcctgaatatcaagtgggatgacttgaaattttgccaaacaggcacaatcttaatacgatcggccttactaaggctaaatggccttatccatggttgaaattgacacatcattatactttaaaaactccacaaatgattgattttactctgcagccagggtttatgtcaactgtgaggataatgagcaagaaattcaagcccttggcaaactggttggagaggcaaggactgtgtccaggcagacagagctcatataattatttattgtttaatctatttaattaaatatgtaatttacccacaaactgtagctgacattatatgtactcctgagccacattaagatgtactatttgtgctgtgaaattctatgggatttgacaaatgcatggtggcagatctccagccattattaaagcgtaacacagaatgcttctcttattcaagctcgtcttccctccacatagagggaatcaatcgacttttgtatactgatttttgtatttgcttctttatttccatcttctttaattaaagcacaagatatcgtactcaatttccatttgatcttccaaaaggaaagtactgaataatccacacctgaatttcagtgattcagactcaggtctaccgctaaggccaaacgtcctgtgctgccacctcatggccggcagagggcaatgaaacccatctttccggccatgcagggcgcatgagcagtctgcctccctcggcgggccgggtctccagggaggacctgatttttcttcacccatagttagggaggcgcaatcgccctggctttggggctggggcctccggggaggttccggtaggggcgttggagaggccgc

SEQ ID NO: 10164 - DNA, 1049 bp, Homo sapiens
tattaaaaagtcaagaagcaatagatgctggtgatgctctggagaaataggaatgcttttacactgttggtgggaatgtaaatcagatcaaccattgtagaagacagtgtggcgattcttcaaggatctagaaccagaaataccatttgtcccagcaatcccattactgggcatatacccaaaggaatcataagtcattctactgtaaagacacaagcacatgtatgtctattacagcactatttacaatagcaaagacatgtaaccaacacaaatgcctatcagtgatagactggtaaagaaaatgtggtaaatatacaccatggaatactatgcagccataaaaaggaatgacaccatgtcatttgcagggacatggatgaagctggaagccatcatcctcagcaaactaacacaggaacagaaaaactaacaccggaacagaaaaactaacaccacatgttctcactcataagtgggagttgaacaatgagaacacatggacacaggaaggggaataacacacaccagagccagtcaggggatggggaggaggggagggagagcattaggataaatagctcatgcatgtggagcttaaaacctaaatgaggggttggtaggagcagcaaaccaccagggcacaggtaaaccttgcaacaaacctacacgttttgcacttgtatcccagaacttaaagcaaaatgaaaaaataaaaaaaaagtagtacaagaacctacttgtactacttgatggtggtcatcaaaacaccaccatcattcttcagagttagaaaaaacaattctaaaattcatatggaaccaaaaaagagcccacatatccaaagcaagactaagcaaaaagaacaaatctggaggcatcacactacctgatttcaaactgtactataaaatcatagtcaccaaaacagtgtggtaccaggaaaatatatacatcaaaatatgtgcacttaaataacatagcatcaaatttattaaacaaaaattgagcaacctacaaggaaaaatgaaaaaattccgaactataga

SEQ ID NO: 10165 - DNA, 1029 bp, Homo sapiens
tgagtgatttttttttttttgcttacatttaatagaaaaatttgtacttaacaaggggaagataatttcatttcaggcagtaattcatttggattctaatgtctttgtgctttaacatagagattgaagagattcaatctttgaacttcaatttatgcctagaaattttataagaacacttgtttatattcaaatgtgggaaatttttcttttttagcattttaatataggaggttatttatgacttttaaagtctcttaatgtcatttaattatcaaagaatctctaatgtgctacactggataatgtagtggcacataacttaagatgacaaagaagagaagatgtaaattttcagctatgtgtaaaatgtatatggtaaaaattgtattagtgtattattctgagattagcttagaatctgatctcagagtaatatgccgttcatgagggattctgagaagatatagaaaaagtaatgactagtattgaagaaacagatccatgaagatgagattagcgttattttaatagactcctgacatctctgcatagggagataacccatcctcccctgattcattgaccataagctttgtggttaaaaaaatacaaactcttgaattttgtttgtgaggtaatttggcctcattctagatgttttccatctttgtgacactcatgccatgtcatactcctggtatcctccctgccctttaattttcttggccccaggaaatggagttatctgatggagagtttggaaagaactaaccaggcatgctgagttagcaagtcttcagctctacagctcctcctagtgagcctacttgtagaaagcaggtcttcttttctacttctctaggggcagggggcagtagaggggagacctgcttcaagtgctggaatgactggaatggtcatgcgcctaattctcaggtgcaatgttagcaaggtcacatgattagcaggctttaacccatattatctaagtaggtctctattagtaatgaaaatgatatttgttca

SEQ ID NO: 10166 - DNA, 1044 bp, Homo sapiens
gagacagggtctcactctgttgcccaggctggtgtgcagtggcatgaactaagctgaatgcagccttgacatctcaggctcaagcgatcctcctgcctaagcttcctgagcagccagaaccacaggcacgcgccactatacctgactaattttttgtattttttttttttttgtagagatggggtttcaccctgttgcccccaccgggctggtctagaactcccaagctcacccacctcaaactccccaaatgctgggattatagacatgagccactgtgcctggcctcaagtgagtttatcataggttaaatcactgcagtgaaccaccttatttatttctttagtatcaactcttcaatcttctgagcagccttcatggtacagtaaaatctgcccatgcctaatttattttcagactcttgaaagaccttgcattttcttttacttatatttttagaactttggaataaaaaagtttctgccttacttggaggaactgtggacatcaaggaaaggactccaaagacaaaaaacaagaccctcatggttgaataggtaaagcaggttagagagaatcagtagttgagatgaagaggacttctgtgtacattcagtcctctgaagaggtgagttgctgagtgattattgaacctttcaggagcaataacatttctgtgtttcaatgagattttatatcaggagacagcatgcaatcatcatgactatcagtcatttaaagtacatttatcaaaggtcaacagggtgtgtgcaaaggtagtagaaagcacagccatggcaaaggcaggagagagacttgaaatatcagcattgtcttatgcattctggaggaactgtaaaagttaaggaagcagttatagaggaaaagcattcattttatttttctgataatgggaagaaccacgtaatacaacagcatgcctatttattactattttggcaccgtgtgttagcatgcttaagcaatggaattataaacagactagtgagatacagaaaaacttttatttgattatctttctgt

SEQ ID NO: 10167 - DNA, 1084 bp, Homo sapiens
tgcagtgagccgagattgtgccactgcactccagcctgggcgacagagcaagactctgtctcaaaaaaaaaaaaaaaaagagctctgctttccgaaacctggaaattctgctttgcttggttatttagcctatggccttcagtaagtttctgaacctctcagcttcagtattgatctgttaacttggaagtaataatagtaaccacctaagaattgttatgaagattaaaggaggtcatctggtaaatgggatagagaaaaatggtatctgtaaaccacttggcacatgataacagtattcctatggcctcccatctggtgccttttctatcatgttaggatgactgggaaggtttggggttttagcgatccctcattcatgggcatcctttttcccttgggcgcagtgagattcctgattttctcctcctctcttacttaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtgagttctctgtggcctaggaaccttgaggaagaacacaggaatgacagtcccctctaactactccactaacatgtctcagttcattctggctgagcagcctttatggaataagttttacctgggtgtcaaagggaaatgtggcccttgcccttggagcagatctgtgtggagaactccaagggctctattcacatagaatacaatgtgaatggcgctcctcaaattatgcaacataactaccatgctttgatcttagtggcctgggtaaaaccttaggacactgacgtaattataaatcccggccaggcacaatggctcatgcctgtaatcccaacactttgggaggcgaaggcgggaggatcccttgagcccaggagtgtgagatcagcctgggcaacatggcaaaatcctgtctctaccaaaaatacaaaaattagccaggtgtggtggcgcacacctgtagtcccagttacatgagaggctgaggtgggaggatc

SEQ ID NO: 10168 - DNA, 1029 bp, Homo sapiens
gtcttgctctgttgcccaggctagagtgcagtggcgtgatctcggctcattgcaagctccgcctcccaggttcacgccattctcctgcctcagcctcccgagtagttgggactacaggcccccgccaccacgtccggctaattttttgtactcctgacctcgtgatccgcccacctcagcctcccaaagtgctgggattacaggcgtgagccaccgcgcctggctcagagactatgtcttatttttattatttttatatctctaaaatctagcagaagaggaaagatttttgtgtgcccagtgagttcccgtagtgggaatagtgagctttaattaatctgagccctagagaggagactcaggactcatctttcattcttctgtctttgaagccttagccgcatactggctgtggcctgtgaggactgcttgatgtttagatggcattcactaagagcttgttactgctattgctgcaatctaccccattttgaatgctttatgactgtgagccctttggagcacaatttttatggtcattcgttcaacagacatttgcaaatcaggaactatattctcccttttacattgggtacacagaaatgattcagacgtgaaacctgtccgccgagagcttacaatttgtcaagggacaaagaagacatacccatataattgtaatgtgaggcactctgttaaaggctaagtgagaattgacaggttggagctgtcaccttgagctgtttaagcagaggagaggtgacatttgagcaccaaagatgcattagatttggtaaatgggaaagagaaagaacattccaagcagaggcaatggcatgagcaaaatcgtggagaaaagggaaaaaaagttttggtggggagggtaagaaaaagaccattatggccaggagtatatcaagagtcacggactcatattttcaggagccagatgggtagtaaacatgaataaaatggacagggataaatatttgaagagattccacctaaagacactcagacaactttaaa

SEQ ID NO: 10169 - DNA, 1174 bp, Homo sapiens
tggacccctgtgccctctcctcctaggccactgctgccttaggcttttcttcactctccccctggccctctccttctcaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataacgaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccgactattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttaggagctgttcaggaagcttggtgattgggctcgccaagcaggacgacattggattatgcccacgttcatggcttgggggcctgagtggggggcgttcctattcactgaaatgggag

SEQ ID NO: 10170 - DNA, 1043 bp, Homo sapiens
tttgaacgtcacagttatctcggaaatgaataaagtggggcttcctcccagtatcctacctttctgggaccaagcataggtcagttgtcatcttttttttttttttttttttttttttttaagaaaaagcacattagattgtttgccccaggccaaggatagactgaagtgttgaaggtgtttatgtgccatacgtggcagttaggaactggtatcagggactcatatctctgaagcaagcactttagctacctgttcataggtaacagctcattgatagggaaagaaggtagaattaagcttatcaaaggctagaactgtgtctgattcatcttggggtcctccctacctagcttaggatgctacattgtttaggttttagtgaatgtttgttgagtgaagagatgagttggtgttctctatcagcaaggtctagcggggccaagtggcccaggacagatgggtctgctgctaaagtggtttttatttgaagtgtgtgttgatcgtgggttatcttacaggattttttaatattccatatggctctaaccaggacctgccttagtacctctgaaagaagtcactattcttattttggtccagacagtaccattttctctcccagttacccaggcaggacatttcaacatcatcttgacttctctgtctccttggcgctgatctctaattggtcatcatcctctctgctcacatccagcgtccctccctctgcctcattctggatactaggccctcatggcctagttcttctctaatctgcccttattgcagttcattcctatgcacgagttctcaagaatctttctcaaatcttgttttctttgtgacacttcagtgactcttcatcaaacctcagtgaatattcatttctaataggtagaaatctaaaatcttcagcctggtgtttaagatctttcatcagggggtcatttcctctcaccagttttgtttcctgcttttttctctccccactcgacaccacctcatttttttttaatcttatagaaatccttaaatcctgg

SEQ ID NO: 10171 - DNA, 1050 bp, Homo sapiens
atggaccaaactggtttgccccgacctcaggaaactctttggacttggaccagacggtctacccaggactccccaggaattgagaaagattgtttttctctgtatggcgtctcttggagccactggtcctcttgccttttatcttctcagaggcaggggatgtaccagcaaagtatttcctatgctgtttttatagcttattagcctagggcaaggtggcttggcccctctgggtaacctgccaggtgagatctcggtgtttgcttgcatgtgcctcctggcctatccgtcctagagttggaggaggaggagccccaagatcagggttttcactctttggatgtgagtgtctctcagatggggagtatctttctaagaaaggggtacagagcatggaattcttaggctacaggcaggcagcgtctcagggtaagtggtggtaaattttgcaagtgagcactggcgcacagatggggcagccatttcctttgtgagctgtgaggctgtaggcctttggaactatcaggtggagaagggggtggggttctgggaaggaccctttgaggtgggagcttgtgtgggctttgggccctgaaattctgggagtgggagttagcactaagagaatgagggttcagcagaagcaagggcccatgagctgagagatcggtatagtttaacaactctctgggaccaaaggtcactttggtgttatcttgaggtaggtctggtgttcccttgatgggcagtaagtggctaagaggcagtctcaaaggagctggcacccaggccaagggcggggtaaggagagcagtgctgctgcagctcagaccctctggcctttggcctatcacttgttctgtacttaaaactgaagctttttcagaacagacttcagagctcagcaacttgaccctctggtcctgcttcttgtgtctgagcaggtggtttacattagcctcagccctggtaggaaatcatggctaggctttaactctttaaggtccagagagggtacaggcagagtggctgcgtgtctctttagtgtca

SEQ ID NO: 10172 - DNA, 1026 bp, Homo sapiens
ccttaaactctgggtggaaaacagagcgaagggggagtgtccggttgatcccagtttgtcaggcaggccactgtaagatgtgttttgtgtgtttatgccacagtttgccttggctcttgctgctgttggagttcagtaattttgcctgcctgcttgtgccttcaccctcaacccgccgcccccattcgtcctgcttttcttgttcgtggaccaagcctccagccttcccctttgcagcccctcctctccagtgcaccccctccctctgggccccacccccactgagagtcccctgcttgctgtcgctcccagatcggggaagcttgctgtgcctttaaagaaagcagactcctggctgtgacgcacttctggctgtcagccaggaagatcgctcctgccaggcagactgagaagaaaaccaacaacttttcttttgtgtgtggggttactttccactggcccccccttcctcctctcctttcaagatttaaatgctaatggcggattaaaacctgtagatacgtttggctttaggagtctggtaaggcccccccgcaccgagactttttctccctcactctttctctgggtttttgttcaaacatggacgagggggtggggtggattctcccccctcacctccctttcctgcgccatccttaaaggggagggagagaagagggagagcaagtaaacatactcagaaacaggcgctgtggagcagagcttgccaacatccgggagttggcgcctttcagagcaaagggttgctttctttcccccttgcgtagatgtcagcatgtttttgttcagagaaggaaagcgtgtttgcctgcacgttgagctgtagagacagctcaggagagggcttcaccatttctgcgtgaggccgtgggtgtgtgcacggtggtgggcagtgaaaaaaggttcattttgtcagctgatagggaccagggtgtgtgaatatagtggtggggggcccaggtcagtgtgtgtgtgtgtgtgtgtgtgtgtgtgtgtgtgtgt

SEQ ID NO: 10173 - DNA, 1454 bp, Homo sapiens
ctagccaattttctttttttgatatatatctatttatttatctatctatagatagatgaataggcaaatatatatatatatatacacacacacacactatatatatatatatatatatattattattatttttttttttagacaggttctcactatgttgcccacgctggtctcaaattccttggctcaagtgatcctcccatcttggcctccaaaagtgccgggattacaagcatgagcaactgtgcctggccctgaaaaggtactttagagctgatccgaccctagcttggttctcagtaatttgcctctgtgacttgcattaagccacatagctagtaagtgacccatcacccctccaggggctttcaacaccagatctactatgttttctaccactatggaggctgtctccagtaagagtattccccctgcgtttcaggttctttcacatttcttataattagttctgtgtttgtgagcaaacattgtgctagatatgttgatatgttgcctgtagggacagagccattttactcctctgtgacagtgaaacagggtggagaggttcttagctgttttgtagaaaggccttcttgagagagaactgagtgggcctgttggatgttataatgaatcctctctgggttttgatttgccctctgcttttctctccaggaagcctcagacttaccaacactgcctcattaatcagccattatcctctggagagggacaatgaggccatggtaaataagctcaaggtcaggctcctgaaacagcagtccttccctttagcaccagcatttccttccagcctccccctctaacccttgagacactgccaacatccctcctagtacaagacttttcttggtgcttgctgtttttagaggagttttggcccttcagtgtttgtaaagctctcggatcctcagaaaaaaattctttagtgattaattttgaaattggagctgtttgattattttgattaagaagctgattttcggcctggcacggtggctcactcctgtaatcccagcactttgggaggcccaggcaggtggatcacctgaggtaaggagttcaagcccagcctggccaacatggtgaaacgccatctctactaaaaataaaaaaaattagaccggcatgttggcgagcgcctgtaatcccagctactcgggaggctgaggcaggagaatcgcttgaacctggcaggtggaggttgcagtgagctgaggtcgtgccattgtactccagcctgggcgacaaagcaaactctgtctcaaaaaataaaaaaaagttgattttcatgaggaaaagcacacggcttctttgatttgctgagaatgtgctagcttttattcattcactcaatgattgcctatttaacagctgtagacaataatataggctggctgggtgcagtggctcatgcctattatcccagc

SEQ ID NO: 10174 - DNA, 1058 bp, Homo sapiens
aaagaaagagctttgccttaaaagggataaatttcagttagtaggaaaattgcttgtgtgaaattttgtacttctcagtgatgccagatacgtaggatttattttctctgatggtgatcacgttatttattagcatctttaaaagtgtggataggacagcacggtggctcacaccgtttaattccaacactttgggaggtcaatgcaggcagatcgcttgagcccaggtgtttgagaccagcctaggcaacatagcgagacttcatcgctactaaaaattaaaaatagccaggcgtggtggcgcgtgcctgttgtagcagcagctacttgtaaggctgaggcgggaggatcacttgagcccagaagtttgaggttgcagcgagctatgattatgccactgcactccagcctgggtgacagagcaagaccctgtctcaaaaaaaaaaaaaaaaaaaaggtgggtatagatctggtgccatttagacatctgcattgtccttttcatgagctgtggcagaagcagtgtgaacaatgaatgcagaaatgctttgtatacatgaagacctatactgatgagaaagatagaggatgtagctgagatgtgctggagagagcactggatttagaagacatctctttgagttctggctctgcagccttaccagtcgaccttgaggcaggtattttctttttactgagccttacgttcctaatttataaaattggaataaaccttgcctcttagggttcttttgggaagattaattgagatgtgagacacagccttccttaaaaatcctgaagtttgttcaaatccctagcacagtatgtattttagggttttattttatcatgcccatgttagacaccattcccacttatttcacttattagtaacatattgacaagttggttcttgaggctatctgtcttcctgtttagaactcatattcatgtttgttcatttctatcagtgattaaaggcattctggtgtggaaaaaggaaaagtggacctggaaccagaaagacgggtctcagtgctgtgtaggacagggat

SEQ ID NO: 10175 - DNA, 1095 bp, Homo sapiens
ttgtttctcttgagacagagtctcactctgtcacccaggctggagtgaactggtatgatctcagctcactgcagcctccaccttccaggttcaagcaattcttgtgcctcagccttctgagtagctgggattataggcgtgcaccaccacacctggctaattgtgtgtgtgtgtgtgtgtgtgtgtgtgtgtgtatgtgtatttttagtagagatgtggttttaccatgttggtcaggctgatctcgaactcctggcctcaggtaatctgtctgcctcggcctctcaaagtgctaagattacaggtgtaagcttccgcgcccagctgaattttttttttttttgagagatgggggtcttgctttgtcacccaggctggtcttgaattcctgggctcaagtgatcctcccatctcagcctcctgagccattgggattacaagtgcaagcctcctgacctggcttgcctggtatttaataattacagtatgacatatatacagaaaagtacacaaagtttacagctcaaggactttccacaaggtgaacacacctgtgttactagcacctacatcaagaaacagaacattaccagcataccattagccccttcccagtcactatccccctattgttttatttttaaacacagtgaaactatacatagggatgatgactcttggttcataagtgagtggctcatgttatctcaggtgagtcttctggaaagagccccagattaggagccagaaaaccgtggttacatcgtggcccggttgctttttagctgtatgaccttagacaaggtaaacttaacttttctggacttcattcctctttggtaaagtgaaaataataatgccctcaccttaaacagctgttgtaaggttcatctgacattattggtaaacaggaaataccttgtaaatgggaaacactttgttagttgtaaagagccatacacaaataatagtcatttttgttgagagctgtggaatctcaagcagaagagaaaatgatgatccccaaatctattctctttatcacctttgctgtctcatttttttttgttgacattggtgtcactgtctttctgt

SEQ ID NO: 10176 - DNA, 1093 bp, Homo sapiens
gttgtacaacagacttctaacagtggtcacttctgagctggggagtgtcactggcaaatgtgggttgaggcttaatgaagagggagttttacattttactctagatacctccgtattatattatttcacagtgataatgtattccttctcctttccaattgtttggagagctcctgggcctgtctgcacttgccaggattaggagtgtgacaaggtagctagctgtgctcacatcagttgagttggaagcagctgctgagaccagaacagggagcacatgtaaggggaggagggggatagcatgtgcaagtgactgagagaggcagccaagacaggccatttccaatttaccaacagtaactatcacatgtcttgtcttgacattctccaagttactttgctctctgtcatcacactggaccctgaggatgattctctgagcaagggaggtagggatgatgatgagaccaggagtaatcaaaacatgggacaacaaggaaagtatgtgtgtagaaatagttttttttctttaacttgaaatacgtcaaggatactcattacagcattgtttgaaatggtaacactgaaaatagccattccctcaatagaaaaatatgtgaacacgttatggatatcccttatatggacttttatgtagctttttaaaagtatgagttagaattttagttattgatgcttggggagatgttgataaattgttagatgagataagttgcagagcaatgtgtaaagtttaaacctagttttctaaaaacagagaacaacaaaaccctttccaatatatttgtatttatgtttttgggggacacaaaaatatgttaccatttctcatcttgtaggaggccttggagaggaatggaaaggggctgggagattactaattttgtcttttatctaactttgtattgcttcactggttttgaagaacaaggaaaacaaacttgtataagcaagaaatgaagtttcctaaacatcgtttcatcttaattaattattattatgtttttttttgagatgtagttttgctcttgttgcccaggctgtaatgcagtggcacaatcttggctcactg

SEQ ID NO: 10177 - DNA, 1025 bp, Homo sapiens
gggctgtatcggggcaaaatcaaaacaaacaaaaagacagaaaaaaacctctcactctcccctaccctccaaaagacagtaacaacacatctgcaagcatatgggaagaatctctttaggcttttaagtagattatggtttcttcctagggaccacactgggcctgctgccttagtgagtggagtactgtgctctgggggctgaccttgaatgacgtggatgcttctgaaggagtagtcaagagggggctcctgtaccgaagtgttcatatagtcccgtttgttcatagttcaggccatcattcaaaggtgcaagcaggtgccctgggagtctgggttcagcctgggaggacagagaaagaccagtgtttcaagtacaccggctttcaggtttccccatagtcctccatccctgctttctgtcctctactactctaggcctgcctggctgtatttccattttaagatatgaaatcactcttccttgcatccttgcatgtatagagcactttctacttctcagagcaccttcacatctcttagaactcatttgagaatcgaacacccatttctttgtctggaaaatgccagatgaagaaactgaaacccaaggggtaaaaggacttgcccagagttaagccagtgagtcagttgtagactgcagtcataatctcctgaatcctactctgagaccttttctgttactctacagtagttactgtggagactgtcttgatacccaccctctgttgacatcaactgggctattctattgcttaacaaatccttgagggcctgcaccgcatctggttggtgtctcaccacccctctcagtctggcccagctggggatttgccaccttctccgcttggcttctctgccagccccattacctttccatccaaataccctactttcagccctatcctgaatgtagccatacacatataaacatacacacacacaaaaccagagtctacctctcactcacctgtcactgatggctgaaactccaccattaggcat

SEQ ID NO: 10178 - DNA, 1028 bp, Homo sapiens
gtgcaggcatatgacagatgttcctttattattatacttgggtgagtggatgggacctgcagcaagtgcagatcttctcagtgggctctggaacagaaaagtattgtttgtttgctcagcatatttttatttgtcccatgttgctgtggccaggatttgagctctgagacaatgcagcaaggtgagacccagatttcttttgttttgttttgttttttgagacagagtcttgctctgtcgcccaggctggagtgcggtggtgcaatcttggctcactgcaacctccacctccagttcaagcaggtctcatgcctcagcctcctcagtagctgggactacaggcatatgccaccatacccagctaattttttttgtatttttagtaaagacggggtttcaccatgtttgccaggctagtctcaaactcctggtctcaagtgatccacccaccttggcctcccagagtgctgagattacaagcgtcaacgactgtacccggccccaaattccttattgaggatcctagaatacatgagaccagacttggaaatgaaagtgtaacatgtttattgttcaaaaagaaaaactcaaaggtgtgtagtgattttaaaatttagggaaattcctcaatatagtgaaagaagaaaaacaagaaagaaatttaggaaagaaacacacttaaaccataaaaaatagaaaatggaccaataaagataaaagctaaacttaacaaggtaggaaaaagaaaaagaataaattaaaaaattctttgaaagcaccaataaaatagataaaacctcctgagcctgataaaaggggaaaggagccaaaaaaattaacaaaattaggcatgagaaattagacataaccatatatattgaggaattgagaagaagaatagaactctatggcaacaaatttgaaatcagaggaaatggataatttcccagcaaacactgatcctagaaatagtttgaataggccagttggttacccaagaagaaactggaaaggtggttaaaatttta

SEQ ID NO: 10179 - DNA, 1035 bp, Homo sapiens
gaaccccactaggaccagggaactgggctgggagcctcagaaacttgagcgcagtcctgcgagctagctgttattagccccaattggcaaatgagaaagctgaggctcaggctcaaaggaggtctctgagttgccctagcagtaagtgatggaggccgacctccaagctgggtccaggccgagggagtgaccacttcacctccccaccgacaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctg

SEQ ID NO: 10180 - DNA, 1046 bp, Homo sapiens
gggctgctaaggtcagtctggctaggaagcagatctggagcctggggctatggggtatggcctggcaccagggcaggcctagaggcttagtctgagggtatcagccgggagtttgggagccttccaggcactgagttttactggagtgggcctggtttcagggtccaaggcaaagtccagccctcacttccctctccttcccccatgagtgtatgtctctccatgtgtaccgcctggagttcggggaggggtgatatgggtaaggggagactgtcttcctaccctctgtaggtaatcttttctttacctctgtgctacgcccaggtgctataatctctcatttggtttacttagctcttgtgaaggtatttttgcatgtggataattgttcaaattgatgtttctgctggggagcaagtgctggagagtcctgttctgccatcttgctgatgccgtaagggctttcttgatcctgtttcttggtctgctgcacgtttctcctgtcgtaacctttatcacactttgagctgtagctttatacttaattattgtttttctcagcagactggccctagcttcttgaggtcacagacctcagcacctaaaatagggactagaacatggtaggcatttgataagtaattgttggataaacagtttgtattttataattgtggaaactgggccttagaaaggtgttaagtaacttgtcccaagcttctcagctgataagtttcagaggctgctgcctttttttttaaaaatgaagtttcactatgttgcccagactggtcttgaactcccggactcaagtaattctcccaaagtgctgggattacagtcattagtcactgcacccggctaagatctcctgtccctgtctttcctatccttgtcttttacactcccaaagttcatggtttttttcccaccgtatcactcacatgagcagagacagctccagtccccaaacatgcttccggatctgggtctgtacctcctgggcctttcttgcttttgacacttctgtctttgtgatttcttct

SEQ ID NO: 10181 - DNA, 1314 bp, Homo sapiens
ggagacgagggcagtgagggggtggtgacatgggtggggctggagatcgaggcagaggcagccatgcagggcctagcagcaatgcaagaccatcggagggctagtgaatggcagtttaagaagattgctactcgctgatgggtggggagagggaaattagagcacactttgaaggccatggtttcgtccaaggagaaggcggtaatgtgggctggggtggcagcagtggagatagacagagcagagagattcgacgtgtggattgggagagggaggaggggtttgtttctgagttgagcagcctggcgggtggtggtggtgtttccctgatgggggccacagggagggtgggatgggaggcagggggtggagatcatgggcatggttttgcacatgttgaatttgagcagctttggtcacagccaggtgtgtcaagcctgaagcttggtcatgggaagggtggtcatgatggtggtgttttgtgtcgtggcacttgcatatggttggagtggacaggggatgtgtaggtgatatgtgcccatctgccagcctttggtggtatcgggccatgtggtcccagtgacggtaggtgtgacctctccccagagcgccccctgcactttgcggagaaggtgctgcccatcctgcacgggctgggcacggacagccacctggtggtgaagaagcaccaggccatggaggccatgctgctgtacctgggtaggtggtgcctgcagggtggccaggctccgggtggtcctctcttccagagccagggtgggacctggtggtgccaggtaggaacagctcagacagagggcgccaagtgggtgggcctctatggagaggctggggcaggatggggcagcttccttcatcctgggacccagccccgggtaggggttggtgcagcctgtgcccactccagtcccaccccccagccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccgggtaagtggccccgctgggttctgccccagggtgggcacctgtacacctgaatgtgctcagagattccccttggtctgcaagtggaaatattcccgttacaggctctcaggatggcacagcagtgggggagaactgtagactctcaagacccctcctgctgtggccctggacggccactctagtgtgccctgtagccccactaagccctggcacccggatgccatcac

SEQ ID NO: 10182 - DNA, 1034 bp, Homo sapiens
gcatgggggaggctttgtgaagcccagtgtggtgccccaggagaggaggccaggccccttgccctgaggccccccaacccctctctcaccagatgactctgactacgatgaggtcccagaggaggggccgggggccccagccagagtgatgaccaagaaggtggggccaggcatgggactgtctgcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaagtgagtgtccggccaccctccttcccactgagcccaacctcagcccgccccctccttgcctcctcagcccggccccccatcccctcatctctcgctagtggcggatggcataccagcagcctgagcttgtccttgc

SEQ ID NO: 10183 - DNA, 1050 bp, Homo sapiens
tttttattttttatttttttttctgaagtggagtctctctctgttgcccaggctggagtgcagtgatctcggctcactgtaatctccacctcctgggttcaagcaattctgccttagcctcctgagtagctgagattacaggtgcttgccaccatgcccggctaattttttgtatttttagtagagacaagggtttgccgtgttggccaagctggtctcaaactcctgacctcaggggatctgcctgcctcagcatccctaagtgctgggattataggtgtgagccaccttgcccagccatggttttttaaaatactgaagtctttgatacagctgtaatgtttcttgttgtaaagtgtgagatagggatccacattagttttttttgagagcactccacagctgtcccaacaacttaagaatcccttgtttccccacaagtttgagaggctacttttagtgtatcctaaatttgtatatgtatttgggtctacttttgaactttctgttctgtttaattgatctgtctgttcatgcactgttaccatatactgttttaatcattgtggctttataatatgttttaacatgtggtgaggttgactcctactctttaccctccccgccctccacccctgcttccagaattttcctcactcttcctgcttatttttccacatgaaatttcaaatcagcttcaaaaaaaattctgtacatatttaattggattgtgtacatttataaagtaacttagacatcattaatctctttatgttgtcttctatccagaacttactgtgctctgccatttgtccaggtcttctttttgtccctcagtaacactcccaatttttcttcctatcgctgttgtttatctcttaggaagtttattggtgttttctattttgtgatgcttttgtaaatggggtctttcatcctggtttctacctgtttgttgcttataaatgttgatttctgttatattaattttcgtttgtttcttttgtttttgtttttgtttttgttttgagacggagcctcactctgttg

SEQ ID NO: 10184 - DNA, 1066 bp, Homo sapiens
tggcaagaaattgaaaagaaagcaagccactggactctcccgctgggacctgggacaaaacaaacctttatcctctagattgcaactgcatcccaggctgctctatccactcactgcctgaagaacccagctgcagcttttggttttgtggccaatgactgcccagccctctcccagtggccttaggatgaaatccagctgctctgaatcttcgcatttattttgttcatcgtgaagttgtttttcatgacagaaatataactaaattacagaaattttaggttagaagggggaggattgtaatttatccccaaatcctgcaacttttaagtttcctcctagactcttcctgtgtttgccttgttactgcttgatctgccaagaaccaaatgaatgccaaagagcatcttgttcctagactattttccctcggtcccagaggccaaaaaacacacttttgctgtgtctgtttctgagagctctggtctgggaatattttcctgaaaaaaaaaaaaatttttttttttgagacggagtttcgctcgtcacccaggctggagtgtgatggcactatgtcagctcactgcaacctctgcctcctgggttcaagcgattctcctgcctcagcctctcaagtagctgggattacaggcatgtgccaccacacccggctaatttttttgtatttttagtagaaacggggtttcaccatgttggccaggctggtctcaaactcctgacctcaggtgatccacctgccccagcctccaaaagtgctgggattacaggcatgagccacctcgcccggcctttcctagaatgttttatgctgaaacattgacagaaatgaacccagggacagggctcacagcccttctacactgcgcatagaactcactcttcaccacttgctcctgtgaggaacagaaaagagcacagccaaaggaaatgtattccagtccccaggccacctcagattagctgtgacttgaggctcatcccttcaccttctggaccctgctttcctcatctgtaaagtaggaacaagcagatagtgcaacttcta

SEQ ID NO: 10185 - DNA, 1033 bp, Homo sapiens
tccacccaccactgtactccaaggtcataacttgcacggtaatccagtcggatactttgcaattttattttccttgacccctattagcttttgataccattcctttaccactggcttcttttggcttcattcattcagcaaatatgtattgagtgccttcttaaggacttgagtctttatcccaaatgagacaggaagccattgtaaagtggtaagctggacagtgttgtggctggtgcatttttaaagcatcgctatggcagctaagaggcggatggatggagggtggcagaaaggatatagggagcgattaggaggctggagcagcatccaagaaagaagtggtggcaagatggactggtgggtaagagtgggaagagagagcagtgggctgatgtgcttctctacatttgcctcgtttgctttcttcctctctggtcctacctttctgtggacctttgcagccttgccgccacctgtctctgctgataattctcatggttctgtcactgggctgcttctcttgaagttgttgaacgcactcttgccgaatgacctcatctacttccacagctatgataaccatttatatgccagcaagtctcagatttataactgccaatccgatctcttctcttgagcttcagatgtgtggatatctcagtttatatatcccagatccccaaaactcagcaaaaatgagttatgttcccttccagacatgttccttctcccatattgcctatcttggtaaatggaacccccatcctactggtgttctggcatcattcttaatacctcctgcccctgcctcccacagtcattcccaaatcctgccaggtataccttgcagagagctcgcaaatctttccacttctctacttcccctactgccagtaccctcgtttgggctattgtcaactctcattcagaggattacaaaagtctcctaagttgccttcttacttggactcttgcttgcctctgatcctttctccagttgttacctgagtcatcttttcgcagatctgat

SEQ ID NO: 10186 - DNA, 1029 bp, Homo sapiens
tagtagttctatttttagtcttttgagaaacctccatgctgttttccataatagctgtactaatttacattcccaccaacagtgtataacagttcccttttttctgcatcttcactagcacttgttattttttgtctttttgataaatagtgattctaactggggtaagatgatatctgattttggttttgatatctggttttgatttgcattttactgatgataagtgatgttgagtattttttcatatacctgttggccattatgtcttcttttgagaaaagtggttacacatccattgcccaatttttaataagattacatggtattttgctattgagttgtttgagttccgtgtatattccgtatattagtcccttgttgcatgaataatttgcaagtattttcttccattctgtaggtcatctgttaactcttttgtttcctttgctgcatagagtttttaatttaatgtagtcctatttgtctgttttttgttttgttgcctgtggccttaaagcctcagccataaaaatctcccttgaccaatgtccagaagcatttcccctatgttttcttgtactagttctatagtgtgggtgtttgtttgttgttgttgttgttgttttctttttttttttttcgagacagggtatcactctgtcacccaggctggagtgcagtggcacagtcacagctcactgcagccttggcctccccaggctcaggtgatcctcccacctgagtttttgtatttttagtaagatggggtttcgctatgttgcccagactggtctcgaactcctgggctcaagggatccacccgcctcagcctcccaaagtgctaagattacaggtgtgagccactgtgcccagccataatattgggtttatttttaaagtctttaatcattttgagccgacttttatatatggtgagagatagggatctagtttcattctttggcaggtggatattcagttttcccagcagcatttattgaagagggtgtcctttccccaatgtaa

SEQ ID NO: 10187 - DNA, 1034 bp, Homo sapiens
tgagaccagcctgagcaacatggcaaaaaacccggtgtctacaaaaaattcaaaaattagtcgggcatgggggcgcacacctatcttcccacctattcgggaggctaaggttggggagaattgcttgagcccgggaggtggaggttacattgaggtaagatcatgcctctgaactccagactgggtgacagagaaagaccctgtctccaaaaaaaaaaaagaaagaaagaaagaaagaaaatatatctcgaagactaaactctaagcacaaagaaattatttggagtatagtactttttttctgtttcatttattgatacctatatccgtctcattctttgccttcacatcctgcttcttaaaagaattgcctatgcttattatctatagaatctcacctcccacttactttttagcccattacatttgagctttcctgtcctttccttcccctgtctaagcttaccaaaatcgccaatgatgtctgtgttgctagcttccaagtggacactttgatttctcatttttcttaatctgtcaacaatttcatcacaattaacaattccatgtcttaaaatgttatcttctctagtcatccacgattcaacattgtcctggctttccttctgcctttctggccatacctagattttttcatgggttcctctttctccatcccacaatgaaatattcagtttctcagattcctatacttggctatcttgttttcttattctttaccctcatataggcattctcagtcacttccatggttttactttaccaccaaatcataaattaacatcttcaacattgggccttgctactactgtgtatccatataatctcttgcctgttttgacatcttcttttcactatctcacaggtgtctcaaattcagtgttccacttatgtaatgttgcttaacaaaccacctcaaacttaatgccatagaacaagagggtttttacattatctctcactaatctgagtattggatggtctcagcttagcagtttcccttggggtctctc

SEQ ID NO: 10188 - DNA, 1032 bp, Homo sapiens
atgggagttgaacaatgagaacacatggacacagggtagggaacatcacgcactgggacctgtcggggggtggggggctaggggaaggatagcattgggagaaatacctaacgtaaatgatgagttgatgggtgcagcaaaccagcatggcacatgtatacctgtgtaacaaacctgcacgttgtgcctatgtaccctagaactgaaagtataataaaaataaaaaagtataattggattttttgtaatacaaagtaaggataaatgcttgaggtggtggataccccatttaccttgatatgattattacacattgtagtcctgtatcaaaatatcttatgtaccccataaatataaatacctactatatacccacagagattaaaagttaaaactttttgaaaaaaaggagagcgggacacaggcacagggagaagatcacgtgaagataccagaagaaggtggccaactacaagccgacaataattaccgtcagaagaaattaaacctgtcaacactcgatcttggacttctacaaagtcacttttgccaaatgaagtaacattcacaggttttgggaattaggacatgaacatatcttttgagaggctaccattcagcccactacagctgtttgtaaaaagaagcaagcttcctgatggaagtaaacgttaccttcccaagaaaataaataaataaacaagacaaaaaacacccattccaatgtataggaaatactggaaacagaatactacaaggatgtaataaaaattacatgtttgtcatttcttcccagactacaggaaactctacagaacaaaaacccagtttcttcaacaattaaattgcaagagggaggaaaggagagatagatgaagaaactagtatatgaaaagaaagctaaacagcatcgtgcaattgcactgtgggggctgtatttgtatcctgatttgaaaaacttttttgtaaaaaaaagaaacaatcagggaaatttgagaacttgttgctttgtaagtacttactgtaaattgt

SEQ ID NO: 10189 - DNA, 1052 bp, Homo sapiens
tctgaaaaataaatcaagaaagtaatgtcatttacaatagctacaaatacattaaaatacataggaattaaccaaagaagtgaaaggtctcttaaaatgaaagaaattgggaggctgagacaggagaatcgcttgaattcaagagatggaggttgcagtgagccaggattgtgccagtgcactccagcctaggcaacaaaagcgaacatatgtaactaacctgcacattgtgcacatgtaccctaaaacttaaagtataataataataaaaataaaaaaggaaggaaggaataaattgaagaggacacaaacaaatggaaagatattccatgttgatggattgggagaataaatattcttaaaatgtcaatactacccaaagcagtctacagattcaatgcagtctctttcaaaataccagtgccattcttcacagagatagaaaaagcaatcctaaaattttgacagaaccacaaaagacccagaataaccaaagctatccagctatcctgaacaaaaagaactcaaggaatcatattgtgtgacttctaattatactacaaagctatagtaaccaaaacagcatggtactggcataaaaacaaataccagtggaacagaatagagaacccagaatcaaatctacctatctgcagtgaactcatttttgacaaagttgtcaagaacatacattggagaaaggacaatctcttcaataaatggtgctggagaaactggatatattcatatgcagaagaattaagacccctatctcttgccatatacaaaaatcaaatcaaaatggattaaagacttaaatctaagacctcaaactatgaaactactaaaagaaaacactgagaaactctctaagacataggactaggcaaagattgagtaataccctgcaagcacaggcaaccaaagcaaaaatggacaagtgggatcacatcaagttaaaaagtttctgcacagcaaaggaaataatcaacaaagtgaagcaacaacccacagaatgggagacaatatttgcaaaatatccatctgacaga

SEQ ID NO: 10190 - DNA, 1047 bp, Homo sapiens
ttaatcatattggccttttactattccacaccaagcacattgtcacctctggactttcacatgtgatgtttcctcaagcaagctcttaatgccagagagccacagaactcgatactccctcactccattcaagtctttgctcaaatgtgactctaacagtgaggccttccctgactacacaacataaggcggcatcttttcttcattctctatttcttttctttgtttatgtttattgtatttattacaacctgccataacatttaagagcaagagtttttgtgttttttttttcccccatgcagtgtctccagtacctggaataatgtctgacaaatagtagactcttgataaatattttgttgagtgactttttatggattcatgttcaataaattcatgtggttgaaattgatttaggtgatatattagcagtatcttttatatagctgtaaattagatgatgttttacaaggagtactagtgtcaaataagctctcaactggccttaagagagagaatttattttccaaatgtagatatttcagaaagcagaattagagattaaagattttttgaaaaagaaattgtgaaaaaggaattttgaaaaaggaattgatgggaagtatactcatcaccagcagtaggtttctggagatctaagatctggagtttacctcactaccttagtttctaatgcttgtcatgctttctcaagaccatttctcaaagaatgttcctcttctctaactataccttttctttctgatccagcactgttaggcatctcatgttttctggtgtgttttacttttcttaatatctaatactatgtttattttattttctattggagcacaataacttcataaatatctcttattctttgcactttcagtaacaaaattttttcaagtcaaagtctgccagcaccatagaggagtagttgtgtttgcttcaggattgtctgaggctttaaagcgggtgaactgctgaccttgaggaaaagcagataattctatcaagaaagcctccctccaggagtag

SEQ ID NO: 10191 - DNA, 1093 bp, Homo sapiens
cttgctccccgcccacacacttaaggagtctattttagaaatcccttcatgtcagtatgttctggtccctcattctttttaatgcctgctttagtgccatagtattgatgaactatacttttgttatccacatccctatttgtagttatttagtttattagtatttcaaataatgcagtgaataagttctgtatgaacataagtatatttttgtacactgaaagtgtatctgtagggtaaattcttagagggagaaatgctggatcaaagggtttatatatttaaaatgttgatattggagggagggtcttcaaggtggctgactaggggcacttcgtacctcctccactaagaagaaccaaactagtgagtgaataatcacatgttgactagatcatccaagagaacactggaattcaacagaaaagtgacaggaaatacctaaagttaaaaaggaaagggaaacaaggtagcctgttcaggtgggattagtcaggagccaagagagacccccattggtccacattcccactgtagacttctgtagtgctggccatggaagagcccttcaaccttcctgggccttgaaactaagatagggagctgccaggagattgtgtgatggcactacaccaagaagggagctcatgctgggtcccacacacgctctgagaactaagcaactgcagcaaggcactattttagagccctgcccccaacagactgtgcactgtcctggggtccagcatcactagggctaaaccacaagagaagtgtgagctgctgcccttggggccaagctgtgggttaacactgttaggttagcagtgtaagtgctgctggggagcgagtggtgctggggcaagtattccccacctgctagcctaggtggtgcacatgttccccacctgctagcctaggcttccagctcagaaggtagccctcccttttccagtggcagggcagcagtgcagccactactgcctcccacctgagcattctgccagtggcctagggatcagcctgcccctgcctaccatggctggcacctgcacatattgttgagagcctgagggcaagccaccccagcctg

SEQ ID NO: 10192 - DNA, 1040 bp, Homo sapiens
ggaacttgagattgaagctaatttgacagcagaccttaatagaaaggtaccatgtagagtgtagtgttgattttacttgagtaatttttgcctcaagcaggtagttgattaatagatgtgattgttcttcatttcagcattgtgttctttttagttacgtgtatagaaataagtatctcaatgttaatgatttctataaccattacattaggccctgttatagtgttaggggaccacatatattcctatccaaaagtaatacgttggccaggtttggtgactcatacttgtaatcccagaactttgggaggacaagggaggtggcttgcttgagcccaggagttgagccatgggcaacatggcgaaacactgtgtctactaaaaatacaaaaagttagctgggctcagtggcatgtgcctgtagtcccaggtacttgggaggctgagttgggaggattgtttgagcccaggaagttgaggctgcattgagccatgatcgcgccactgcactccagcctgggcattggaatgaggccttgtctcaaacaaacaaacgaacgaaaacaaacaagcaaaaaaacaaacataatacattgtataattggaatgagcagtttaaaatcaattcttaacaaaatggtcttctcaattcaaatccctgtacctctccctgacacctgttatagataaacattctgttttatccagatttgtgttgtgtagataatagtaagtgggcaaatttctttgtaaaacagtttattttgttgtttgaagtgacttgtgtcatggtatcatttaaaaagaaaagacccttaaaatctgtcttgagaattaataatatggaacagcaccaaaatttgttcattaattttacatgccagtatatatctgtctacttcaaattgaatttgtttttctctttcctggtatttgagagtttggctgccgagatttagaaagctgtgtgatcagagttctatggagatggacagctgtgttccctgtgacatgccagaggtggtttgtttttatggcta

SEQ ID NO: 10193 - DNA, 1048 bp, Homo sapiens
aacttttacactctacttcccttttaaacataagttccaattttagaccatctctttatgactggatatgactgtatgctttcagaaaaagccaggttacattttgaatgctttgctgcttagaaatttcttctgccagataccctaaatcatctctctcaagttcaaagttccagagatctctagggcaggggcaaaatgctgccagtctctctgttaaagcatagcaagagtgacctttgctctagttctcaataagttcctcttctccctctgagacctactcagcctggatttcattgcccatatcactatcagtgatcaatggttttggtcaaaaccattcaacaggtctctaggaagttccaaactttccgacatcctcctctcttcttctgagccctccaaactgttccaacctctgcctgctacccagttccaaggtcacttccacattttcaggtatttttatagaaatacgccatgtctctcggtaccaattttctgtattactccatttccacactgctataaagaactagctgagactgggtaatttatcaaggaagaggtttaattgactcacaggtctgcatggttggggagccttcaggaaacttaaaatcatggtagaaggcaaagggaaagcaaggcatgtcttacatggtcgcaggagagagagcgagcaaagggggaagtgccaaacttttaaaccattagatctcatgagaactcacttgctgtcatgagaacagcatggggaaatctgcccctgtgatccaatcacctcctagcaggtccctcctctgacacatggggattacaattcaagatgagatttgggtggggatacagagccaaaccatatcacttcccttagacagttaactctcatttgtccttctgatctttaatcatatgtagttctcaattaagtctatttgaatatacaaaccacctccccctatctttaaagttttttagagcactgtatatctgttttatatattctacattatttttatactcggtttcttttattttaaaa

SEQ ID NO: 10194 - DNA, 1050 bp, Homo sapiens
tacatgttttttaaattaaaataggaccgtgctattcatttttctgcagcttatatatttttattaaatatttgagactatatagcacattctctttaataattgtgtaacattgcagcatactgatgaccataatttagttaatagttcctcttggtggatattaattttttaaattaatccctggcagaatatacataccagaagaacattgataatacccataatgtttattgctattcccccagcatctaatacagtgccttccctatagaaagcacttaataaaacttgttaagcaatgcatatgccttttccaggcgaaaaggctgctgtgccagctcttacctgatttgtgttggttacctgtaatgtatcagttcatatcaatggtgagaaatagaataacgggagtgtggactggccttggagtcagaaggcttgggttggattcctgggtataagcagtgttggttaatatggtcctttgttggtcagattctaataggatacttactacattcagtttaagtgaagatcgaacaacataatgcatatacaaatactttgtaagtgtaacacccagtacaaatgttggcattactgtctccctccccgttcctggtaaccactgctttattctctctctgtctctctttttttttcggagacagggtcttgttctgtcacccaggctggagtgcagtagtcacaactcaatgcagcctccacctcccgccctcaagtgatcctcccacctcagcctcccgagtagctgggactacaggcacacaccaccacaccaggctaatttttataatttttgatagagacagggtttcgttatgttgcccaggctggtctcaaacttggctctagcaatccacctgcctcagcctcctaaagtgctagaattacagatgtgagccaccgtgcccggcctttattctctatttattcaagtttttttatttttttagattccatatataacagatcaaatagtagtcgtcttctttctatctggcttatttcacttaacatattctg

SEQ ID NO: 10195 - DNA, 1406 bp, Homo sapiens
tccaactcctgacctcaagtgatccgcccacctctgcttcccaaagtgctgggcttacaggtgtgagcactgcaccctgcagaaagttaggttctgttatggaggtaggtttatgaggaatcctaaaggaattgcttactcccagtgagacagtcttgaactagactcttaggaatagataggatttggaatacacggatattccagtttgaaactggttgcagataaaaataaacagtgattctgcaattattatggagacttaagtaatattagaaagaagtaaggagatacacttggaagatactaagttgatacaacttgatagaagattatgaatactaggctgggggtcattacagaagtcaagccaaaaaaatgtactggaaaaagaacactaaagtgggaggcatgtcataatttatatggatattggccttattacttggtgacagatcttttttttcaacttttattttagaatcaggggaatacatgtacaggtttgttacaaaaatatattgcatgatgccgaggtttggagtatgaatgaatctatcacccaggtagtgagcatgcctaattattttttcaacccttgcccctgcctcactccctgctcttggattccctagtgtttattattcccatgtttatgtccatttgtattcaatgtttagctcccacttagatatgagaacatgtggtatttggttttctgtttctgtgttagtttgcttaggataatcgttgccagctacattcatgttgctacaaaggacaagatttcattcttttcatggctgcatagtatccacgctgtatatgtaccacaggtgcccatcagtggtgagtgatcttgagtcactgcccatttttcttgatctgagaggattcgactggataaattataaggtccctttaagaatcaatcagtcatcagaatttcttttcctttttttttttttttcttaaagagacagggtcttactctgtcacccaggctggagtgcagtggcacaatcatagctcactgcagcttcaaactcctgggctcaagcgatcttcccatttcagcctcctgagtagttgagactagaggcatgcactaccacgcccagttaatttttaaattttttaatagagacagatctccttgttgcctaggcttggcttgaactcctggcctcaagcaatcttcccacctcgtcataagaattttttagtgatagatggttttgtttttaatatttcagctggaaaactattttagcatctagcagaagacttgtttgtggaaaaagcttgacttggtgaatcttttcatcagagtaatccctatgtttcacatatttcatataaaaataaaataagtttcccactctttagtgtgaaattggtgaggg

SEQ ID NO: 10196 - DNA, 1018 bp, Homo sapiens
tcttagagtttatggtagattgaattattgctcagcaaatattcattccccaccctttctcttgaggtgaactatacatacatccctgtcttactgattttagacttggtcatacggcttgcttggactagtagaatggagatggaattgactgtaaagccatttctaaaatgaggctttaagaggcatggcaagttatttccagctttttcgtacttccggcacttactgtaagaagaacttgccccaggtaactacttcagatggggtcccagaatgaaagatatgtgaaggatacctgaacttgaccctgcaacctgaagcagagatgctctagccaacctgcagattcatgagcagaagttagcatttattgttttaatccatttccactttttgagttgttacagagtattgattcagcaatagctggtccatacacagctaaccaagccattctgttttgcaggaattatctctgaaatgcctagtacctgtaaataacaagccagtactagactatcatgaaccttggcttaagggagatcagaggtaacttttgggtcccatatgtgtgtcggtacatggcatgagctgagggatgccgctgaagaaaggaactacagttggctaaacaggatatacagaaatatcctgctgctctagctatgcctcaaatgctttgggtcagatttttactttttgcagtttgatatgctaacattgtcaagtttttctattactttctgttctgttttcttgttcctcctgtattttttttttaacttcctgcctttttagaaataactcatgttttcacagtatgtactacttaaagaaacaatatagaataagaccattagagttctaattatggctccaccatttgttaacataatcactctacataaattacttaagccatttccccctctgcatattgggattaataaataactcacagttgttgctaagcttaaatgagataacaaagtcattagctcaccatcatttgtat

SEQ ID NO: 10197 - DNA, 1040 bp, Homo sapiens
ccatactatctttgcatttattaagtttcaattaaaaacatgtcactaaatttctttgttctgtgaattggtcttccatgtcattaaccagttcctgaattcatcagactatggtgtcattggaaattggttctttattgcagattcactgaatatttccaagcaaacatctttggtggaatttttccctgatgtcagtgtgtgtggggtgtgtgtgtgtgtgtgtgtgtgtgtgtgtgtgtgtgtgtgtgtgtgtttatataccgtgttagcatcctgaaggtctattatataaaaagcctgaaaacactaatacttatttgaaatagcagacatttgcttctgttggctttgcaattcactactatttatttcaaattttttttgttgttttgaatgtctatatggtttttgcataaatactacttaggttttgagggttttattgttgcatagccagtacatctctgcagataacccatagtggttttaaactttgctgtcagtcatacttttgtgtaaaatagtataaagtcgttggtctttatttctttgaaattactttcattgttgtttggtttactacctctgcctcattcagagacattttatctttttttgccaaggaaagcccattaaactttttctgtttgtaaattaggtgtaaaaatacctatttacttccttaatttagctaaaaatattaaattataaattataggctgattaaaatttaaatgacacaatgacagattatgaaaatatgcttacattttctcagatttaaattttttatttttttattttttagagctagagtcttactctgtcacccaatctgaagtgcaataatgcaatcttggctcaccgtagcctcaatcccctgggttcaactgattttccctcctcagcatgcaacaccactggcagcaccatgtgtgacaccacgtcctgctaatttttaaagtttggtagagacagggtctcactttgttagcccagactagtcttgaactcttggattcaagcgatcctcccac

SEQ ID NO: 10198 - DNA, 1063 bp, Homo sapiens
cccagtagctgagattacaggcacatgccaccaggcccacatgtctgtagtcctagctactctagaggccgaggtgggggggatcacttaagaccaggaggtcaaggctgcagtgagccatgattgtgccactgcacttcagcctgggtgacaaagccaagactctgtctgaaaaaaaaaattataacaggaaaaggtcctttctctctttcctccaccccctctgtttgtttcccccacctccatccctccctcccctcctgtagttggaatacttgttatgtgtctgggattctttagggtcttccagatttagtgcttcttcccctatctggatcagactatacttcgattctttttaaatccaaaatagacaggaattttaggataccaagagacagagactacattgaagggtttacatgcccatcattccctatcacaggaaatacctaaatggtatttaaatttcttttttttttctagccccctgtctgcgtgttggaatgtttaatcgttttaagggtctgggcagtcctgtctttgcttactgaatgattgggaaggaaaatagagaagtaattccagtgggttatgttcaaccatccagagcagagattggcaaacttttttttttttttctgcaaaggaccagatagtaaatattttatgctttgagggccatatggtctctgtcaaatttcccaacattgctgttgtagagtgtaagcagccatagacaattggcaaacaaatggatgtgactgtcttccagtcaaactttatttagtgaaacagacagcaggctagaatttgccaacctgtgcactcaaactatctgttgtgaggactcttccccccttttcccttaaaatttgtagatggacatttttgtaaaatacaataaaagtgaattattggatgagtaaaaaatacatggttaaaatttttagattacagacaacaagttacatttcaatctataatttaaatggtcatacatagggaaaaagaaaacaattagaagaaccataaatgttgttacttgaagatatcttctatt

SEQ ID NO: 10199 - DNA, 1093 bp, Homo sapiens
atgtcctgataaaactaacaagacgcttaacctattaatgtataatggacatctgctggtccagataagtaagacacttagggaagcaaggttgtaggtcaaagatagtaagcatttaatttgaactgagagaatgagtttagttttttttatggggtggggcttgtgatcagattttttttattgtggtaaaatatacataacataaaatttatcattttaactatttttaagggtaaaattcattggcattcacagtgttgtgcaactatcaccactatttccagaacattttcatcaacccaaatagatattctgtaatcattaagcagtaattcccctttgtctcctcccacagcccctgaatctactttctgtttctataaatttgcctagtctagatacttcatataaatggaatcacgatgtttgtccttttggacttcagtattcttaaaggatatttctgcttttctactctacagattgtctgtttaaataatggttttcaaatatcttttgatggtatgttttatctattaaaaaatttaagtgatatatatatttgtaacatacatgtactctgtactaatatattgtatacattataaaatatgcataaaatcttaatgaaataaatattattttgaaatatcagtatcttttgatgactttctgctatcattagcttgtatctcaaggtttaaaactttgtcttatttcttatcagattttattggatggtcattgtatacttctcctgataaagagctctgtatgggtagaaagtggcagctctgccatttgtttgtatttgaattattagtatttacttcagtgtttctttatcagaattttttttttttttcgagacagggtctcactctgttgcccaggctggagtccagtggggtgatcatggctaatacggtttggctgtgtccccacccaaatctcatcttgaattgtagctcccataatccccacacatgttgtaggaggcaccctgtgggaggtaattgaatcatgggggtggttttccccctgttgttctcatgatagtgagttctttcgagatctgatggtttttata

SEQ ID NO: 10200 - DNA, 1034 bp, Homo sapiens
tgtcctaggtactatgccggtcacttaaagacatgatttcatttaatctttaattgtggggtattcatttgtttactacaaaggtccttctgcattttcctaggttgtttccttatgtacttcacgatgcaaatcaattgtcaacctatggattttatttatttattttattttattttttagtttttgagtcggagtcttgctctgtcgcccaggctagagtgcagtggtgtgatctcggctcactgcaagctccgcctcctgggttcacgccattctcctgcctcagtttcccaagtagctgggactacaggcgcctgccaccatgcccggctaatttttttgtatttttagtagagatggggtttcactgtgttagccaggatggtctcaatctcctgaccctgtgatccacccaccttggcctcccaaagtgctgggattacaggcgtgagccaccgcgcccggccttgtcaatctatggattttattccctcatctgttgctgctcagtctgaatttgatggctctcatgtgctctcctgtagtaccttttgtttctgtcatatgacttattgttctgttatgctctcttctctacctattttgcatagtctctggtatgtgttaaatgcatggtgaatgtttatttaatgaatgaatgaatgaggaaatatagtttcaagttctgagaatgataataaatccttaggtgaaatttaccccatttgaaagattaaattgattcattttagcaaagttgaagagacaaatgtacctaaacagtcctttttcattgtgaacatgtatgacttttagaatctagggagacaaaaaataatttttaaaaagattacattttgggggtatgagcagtgttctttactaataccggtattccctagcagtaaaaaataactcctgtacatcaattagcaatttgtttgcatcaaagagattttaaagatggagaccatctctttactttaggcacagttgcacaggacccctaccttggctcgtaagcccagaaa

SEQ ID NO: 10201 - DNA, 1051 bp, Homo sapiens
tcccactcacaagcgagaacatgcacataatggcatatttttaaagaagaaattatttcttcatttatttggggtactgatatggtttgcctgtgcccccacccaaatctcatcttgaattgtagttcccataattcccatgtgttgtgcgagggacctggtgggagttaactgaatcatgggggcagtttcttccatactgttctcgtggtagtgaataagtctcacgagatctgatggttttataaggggaaacccctttcacttggttcttattctctcgtgtctgtcaccatgtaagacatggctttagccttctgccatgattgtgaggcctcccaagccacatggaactatcagtccattaatcctctttttctttataaattacccagtcttgagtatgtctttatcagcagtgtgaaaatggactaatgcaggtacctcataaaggtccttgtaagactgttctcaatgatttcatgtgaaatgattttgtatttcaattgctggaatattggtttaaagcctcattttgagaggtaggggtttttgttttttttcattccgctcattttctctgtgcttatccttctctgtctgatgattttgcacttgttccttttcagctcctaagtctttaatgtagaaccaggtcttataaatgcttcagggatcttgaacatgatgatattggggatatggcagacctaccactgaaccagaggggaagttcaaattgttttttattcaatttaagagcatatctattttctttctttcttttttttttattatactttaagttctgggatacatgtgcagaacgcgcagttttgttacataggtgtaatgtgccatggtggtttgttgcacccaacaacccgtcacctatgttaggtatttctcctaatgttatccaccctctagcccccaacccccaacaggccctggtgtgtgatattcccctccctatgtccatgagttctcattgttcaactcccacttatgagtgagaacatgcagtgtttcgttttctgttgtgatagtt

SEQ ID NO: 10202 - DNA, 1756 bp, Homo sapiens
aattaagtttttaaacttcattaaagaaatggtggctataattaaatgttagtactcttggggacatagatttgctagtaagtttcactttttcatggctattcggtagcacatctcgtaaaggtgttgagaggaaatcattgttgatgctgatccccattattttcctccccaaaccttctgtttctattaattaatttagtggttaggccaggataaaacagagtggagagaggggagaattcatactagatctgtgattttgaaccttttgtgtgtgaacatgcccgtttttattttggctccttttatacaggacatagtggtctgcgtatgtcttcactcatttgttgtttacctggtcccactggttgagtttgagtcccctgccctgaccgctgatcaaaaaataagattttttataggcacctctgtcttaacctctctatatcagtttatgctgtggactctttctctgtattttgggttaaagaacatatattaagatcatgtgtcaggcactgttctaagcactttacatagattaactcatttatgttttccctataacctttgagggatacagtagttactgttattcccattttataattgtggacaccaagacaagaaacctgtgtttcactctgtccatttccctcccttcaaataatctactactggacacttttttttgtctttttgttgagatggagtctcattctgtcgccaggctggagtgcagtgacatgatctcggctcactgcagcctctgcctctcaggttcaagcgattctcctgcctcagccccccgagtagttgggactacgggcacacaccaccatgcccagctaattttttttttttttttgtatttttagtagaaacagggtttcaccatgttggccaggatggtctcaatctcctgacctcgtgatctgcccgcctcgacctctcaaggtgctgggattacaggcgtgagccactgcgcccagtcctggacacattttaagagagacattggcagtctgaggtgcatccaaaagatgaccaaagttggtggtggggttggaaatcatgctttttgggaaaatggtcaaagaagctgcattattttcaacagcctccattatagatttcatgtgtatgcacgtgaattgaatttgactagtttttgtaactctgaagtgcaaaactaggaagagggagtagagagatcaggatgacagaaggtattagctagttagagcagctccagaatggaagagactgtgtcttccaaaagtgttcttgtaaaataattggtagaccatcttttagtaatattgtaggaggcatttatggaaaacatttttctccttaaaagattttgtttaatgtttccaattgcttgtggaattggacaaataaaacatgtgtaaaggcccttcccatctgaaggatgccagtttgcaacttctgctttaattgttctaggttttacttctgaatcaaactaaattcttagttttcagaccacattatttcacttccagcagactgcttttactgaggtatgcttaaacctcacttaactaaccactgaggtgttggttagttattaagtgaatggtgacgctctaaggtcaccattcacttaataacttgttcaatttcttttttttttttaatttgacatttaggccgggtatggtggctcacgcctgtaataccagcactttgggaggccaaggtgggcagatcacttgaggccagg

SEQ ID NO: 10203 - DNA, 1036 bp, Homo sapiens
catgttcatttttctgtatgaaaatgcttatctagttaaataaaaatactgtacttttggattaatggcaaagtttttctcaatctcccaggccttggcaaccactaatttactttttgtctctctggacttgcttattctagacactttgtataaatgaaattctaaaatatatggccttttgcatccgttttctttcacttagcgtaatgttattgaggttcatccatattgtagcatgtatcagtacttcattctttcttatggctgaataacattccattatataaatataccacatcttgtttatacattcatcagttgatggacatgtgggttgtttgtactgtttggatattatgaataatgctgctgtgaacattcatttaccagtttttgtgtggacatgtgttttaagttttcatggatatacacctaggaatagaattgttggatcatatgctaatgatgtgtttaaccagtttgggaattcccagattgttttccacagaacctgcaccatttacttttccactaacgctatgagagttctgatttcttcacatacttaccaatacttgttactgtctgttttattatagcatccattaatatcatttaaaagttttatgagacattgattcagaattttagcaaatgccttttcatcttacatggagattatcaggtttcttctgctgtgctctcttgatatatatatgatacattataatgaatagatttccaaatatttattatgtgaattttgagtagttgttatcccagatttgtcttttgctttaaaacaggaaattagttggtagacaagtaactttttactaacaactaaaaatgccactgagaatatttaaattagttgatatgcacatcaagggtacaaaagctattcctttttcttgtggacttcacgtgaatgtccttattttaaaatgagttatgtataaacttaaaagggtaaaaaatacataatttaaatatttccttttatcttttgtgaaatataaaaaaatccaac

SEQ ID NO: 10204 - DNA, 1049 bp, Homo sapiens
gtgagctataattgtgccactgccttccagtttaggtgacagagtgagaccccatatgtattaaaaaacaaatctgtcatcatagtaggagattttaacacacctctctgaagtggatatattaagcacataaaaattttaaagtatatagatttgaatttaatgattaatacactagttacataatacagaattctatatcccatattagagaatatgcattcttttttttttttttgaggcagagtctcgctctgttgtgcaggctggaatgcaatggcatgatcttggctcactacaacctctgcctcccagactcaaagcaatcttccctcttcagtctcccgagtagctgggactacaggcatgtgccactatgcctggctaatttttgtattttatgtagagacaggatctcatcatgttgcccaggatagccccgaactcccaagcttgagctatccatctgccttggcctcccaaagtggtaggattacagacgtgagtcaccgcgcctggcctttagagaatatgcattcttttcaaacaaaaattaattatttatttattagcccataaaaagagtctcaaataattctgtggaattgatatcatacatgttgtgtagtatgtgtctaagagagggctcaggaaccaaatgtggttttcccctagttgtatgaccttgggtaagttacttatgtgcttcaattttctcatctgtaaaacagaaatggtaatagtggtctctcagagttgtgagggctggcattcagaacaatgcattacacgtggtaagggctcagttagtgtttgccatcatcattatagtatcatcatattctctgatcacatgcaatgaaaatagaaatcagtaatgaagagataaacatcctcttccttacaccaaaaagaaaaacctccaaatataccattcagcaataaaaatgagtgaattatggatacacacatcaatgtgggtgaatctcagaaacattcttagtgaaagaattcagatacaagaatatatactgtatactatactccag

SEQ ID NO: 10205 - DNA, 1026 bp, Homo sapiens
ataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgctt

SEQ ID NO: 10206 - DNA, 1070 bp, Homo sapiens
gtggttagaaagtcctgggtttgaatcctgattacccaactcactagttgtaaggccttgggcaagtcacctcacctctctaagattcaaatgtgactacctgcctcagggttgtggatggttttatgtaagttccatttactcaataagtattgaatgtcttccatactggaatagaaaaattaaatgatgccatctttgcctgcctgaagtagctcccatttgggagcctggcatataaactcactgcagtactaatgtgctaagtattgtaaaaaggaatacatggaaggaggagggaacaacggtctgcctgggggtgaaagtgtaggggaagcttcagagagtggagaacaacagagatttgaagaagtagaagctgttctttaagcacacaaaggaatagtgggcattccaggcagagtagagcatgggcagaggcttagagatgtgagaacatgacactgtgaggaacgtagaagtaggggagtggctaaactgtgagcagctagatgaatctgaactatagatatacaagggctgacttggagaggccttgaatgtcttgataatacccgcccattttcttgtttagcacttatcattatagaattagaaagcttcaaaagaccttagagatcgtccagttcaaccttttctcttgaaaaaggagaatcaaaaagcagtgttttgtcccaagttacccagtgagtcagcagccacatatggactagaatctttggcagatctcctgactctcgtcctatgcttttctctgccaatctagtatttattctactgtcattctctttcttggggcttacttaaaggagaaaagaatacaggttgtctgaagacctagatttgagtcctcactgtgtcatttcctagattcgcaaccttagagtcacctgacctatcagaacctcatttcccccatctctaagtaggaatcatgtcataattatacacacacaccaagaagttatcagacagcccctgttttttggacaaacaagagctattttatgtaaataggctatggtatcccctaaggtgcttacatagat

SEQ ID NO: 10207 - DNA, 1046 bp, Homo sapiens
tgtttttatttagaattataagatgattagagaccatcaaatccaaccctgttcttagatgagaaacctgaggtctaataagtgcctaaggaaagcacttaagattcacagtgggccatgtgccgtggctcatacctgtaatcccagcactttaagaggctgatgggggaggatctcttgaggccaggagtttgagaccagcctgagcaacatggcgagacctcatctctataaaaaaatgtaaaaattagctgggtgtggtggcacctgcctgtagttccagctactctggaggctgagttgggagggtcacttgagcccaggaagtcaaggcttcagtgagccatgcttgtaccattgcaccccagcctgggtgacaagagtggagaccttgtcttaaaaaaaaaagattgacaatgaattcagtatctgatttactcctgtatctctaatacccagctaggcccctgcatgccatgaatattgactagtttttcaacaaatggatggacagatagatgtcaaacctggaagtagaacccagacctctggcagccaatctagttctctttctgctcaccttatagctgctttttaatttccaacacacttagttagatttctttaaacaaggtaactctcttatcttcggtcatttcccacctctctgagtttcttctataaagtagggataatagtgtctgcttacttcaaaagtgctttgaggggctgggcacagtggctcacgcctgtaatcccagcactttggaaggccgaggtgggtggattacctgaagtcaggagttcgagaccagcctggccaacatggtgaaaccccgtctctactaaaaatacaaaaattagccaggcatggtggcacattcctgtagtcctagctactggggaggctgaggcaggagaatcgcttgaactcaggaagcagaggttgcagtgagctgagattgtgccactatactccagcctgggcaatagagtgagactttgtctcaaaaaaaaaaaaaaaaaaaaaagcattagtagccttt

SEQ ID NO: 10208 - DNA, 1051 bp, Homo sapiens
gctgctcacctcctgctatgctgcctggttcctagcaggccatggaatggactggtgctggtccatggccccaggcttgggaacccctgctttacagtttttattgccatctgatatatctttcacttgaaaaaaaatctctctttcttccccctcccaactagcatgtaagcagaaatttttgttgttcttgttctctgctgtatctcaattcctctagacagcctatgtgagagaaatggcatttgggaaagaaaggctaaggcatggtcctcaaactgggcaacaaaatctccttaggaacataaatacacagatttctgagccccatcccagatagagcatcaaggatcttgtatactctgtgaaagagtttggattttattcataaggcttttgaagaaggctggtggtattaactacaaatgtatgacaactttttggggtaatgaaaatattttatatcttgattgtggtgatgtttgtacaactgaatacgtttttcaggggctcatagaactatatacctaaaagaggtaaaattttactatatggaaattatactttaatgaacctgtcattaaaaaatttttttttacaaattatgttttttgtttttttcccattttgaggttagaggaaacagagactcagaagttaaaggactaccctgtgatcccatcatggtatgtggcagatccaggatttgaacctaaatctgcctgattgtagagtttatgatcttcctactcatttttagcctgtccctgaaactatttacagtatagattttgttataaaaggccaaccttcctttagaagctgggaatcccatctacccttgagcagctccctagaagtggctgtcatattctaaagtttgaaaccctggcagatctcatttctgtcagtcattaattgagattggaattgatggagtgctatcatggagtgctaccccaggcatgatctaccccaggcatgatctcctcctgtggcagtggccctcattttggagcagcaggagaccagtttcaaagctgatgagttt

SEQ ID NO: 10209 - DNA, 1050 bp, Homo sapiens
gtgatctgcccacttcggcctcccacagtgctgggattacaggcgtgatctaccgcgcttggcctggggaggcctatttattctcaggttgatggctgaggttcacctgatatgattcaccattgacaaactttgatgaagacaagcatgtttatgctttctttcaaataactttttatttgtggtcccaaatttcttctggtataaataggatctgaattctgtcttttatgttggggctttcctgtatatctggtgattcttggttgtctgttcgttgttaaaagtggaatactaaaaagctgattagaagttttaaatgctggccgagtgtgatggctcacacctgtaatcctaacactttgggaagctgaagtagacagattgcttgagacgagaatttgagaccagcatgggcaacacactgaaacctcatttctgcaaaaaatagaaaaattagctaggcgtggtggtgtgccacctgtagtcccagctactcagtaggctgaggtgggaggatcacctgagcccagggaggttggggctgcagtgagccatgagtgacagagtgaaaccctgtctcaaaaaaaaaaaaatgttttaagtgcaggccagatgtggtggctcacacctgcaaccctagtgccttgggaggccaaggtgggaggatcacttcagcccaggagtttgagaccagcctgaacaacatggtgatacccccatctctcaaaaaaaaaaaaaaaaaaagaagggtgaggtgcggtggctcacgcctgtaatcccaacactttgggaggccaaggcaggcagatcatgaggtcagaggatcaagaccatcctggctaacacagtgaaaccccgtctctactaaaaatacaaaaaattagccgggtgtggtggcgggcacctgtagtcccagctactcgggaggctgaggcaggagaatggcatgaacccgggaggtggagattgcagtgagctgcagattacaccactgcactccagcctgggcgacagaacaagactctgtctcaaaaaaaaaaaaaaaaa

SEQ ID NO: 10210 - DNA, 1032 bp, Homo sapiens
gccaccacacccggccatttctaaatcttaatgagaactctgataggtaggtattgtttccatgttacccatgtaaaaagttaagacacgtttagtaactaaattaagggattcagctaattagtggcagacagtttaccagattcaaagcttatcctaggctttcaattacagggtaagacattctgaagatacattcaagttgaaattaaactgttagatattacagcagttggctcaaaaataatattatatgtgaattaatacctatcatcagatgtatatatctgattgttcttcctgtcatttaatcttgttttacagcagtaacatacatggaatattttgattatctcaccaaaattaaaggacttctaggcataatcctgttttaagaattctttaaaaggctccaaagcatggcgtagtcactggaaatagcctcagacttgggtttcaaaatcttggcactgccatttattgggttatcttggataaaccttttgaccatcattggataacccttactcttgtatgagccttattttgctcatctgcaaaatagggatatgatacacactttacagggatgttagggttaatgtatgtggtggggtctagtatatgactgtaatatgttggtttcctttattgagtaatgctactgctagtagagtatcaggggataatttggtgctttcatcattggcctcaggatttattaaaagatggccaacatcggatgggcacggtggctcacacctgtaatcccagcactttgggaggctgagatgagcgggtcactggaggtcaggagtttgagactagcctggccaaaatggtgaaaccttttctctactaaaaaaaaaaaaaaaaaaaaaaaaatgccaggtgtagtggcacatcccagctacttgggaggctgaggcaggagaatcacttgaacctggaaggcagaggttgcagtgagccaagatcatgtcatcgcactccagcttgggcgacaagagggaaactccatctcagaaaaaa

SEQ ID NO: 10211 - DNA, 1023 bp, Homo sapiens
aataatatgtgtaccatagttggcatatagcagatgcccagtgacgctagcttcattccttccatttccaaaattggtagatttgtggattcgttgaactattcctgaagggatgacttttgccttctctattccgtgatgcggttcagcacaggttagctgttaggtagtgtctcaggtttcccattcaagtctgtaaatgtcatttgagctttatggtgctagcagttattgcaaaggaattttttttttttttttaaataatgggaggcacctatgctttgcttttgtactttctcatcaattctcattgctctgtctagctagagatactttgtattgtgagagccagggaaaccaggggccattttcttgtctctctgtgtttatttgggttggaggattgtctaaaagttccctagtgaataaagtagatttgctgagttcagattcttccctcctgggtgagcccaggatcgaactactgggcaagaaaagaaataggaagatgtggagaaaactggtgagttctgcttgtaaagttgtcaggatctttgagttggggggcatgtagaaaacagttgattccccatttccgtcttcatttccagagcctgtacactccaacacaaagggagctttaagatggaggtctgcattgtaatttcctagaaattactgcttctggtaaccgctcattcagttttcacctctttgctgcagtagatgaaacaatggggacaataaaaccatttatctgatggctgtagcctcaatgggatgtttgttttaataatggtataatttgcagggttcataaattgtgattttattctcatggaaataactgcccggtggtatttggattctcaggtctcctgttgtgaataatttcgctaacattctggctgacaattccctttattctacacttcgatttagattgttcatgctggttgggtaattagcccagaacagagccagtttttttcagtttggggatggcaggtggttactaggtaa

SEQ ID NO: 10212 - DNA, 1078 bp, Homo sapiens
atcatttcaaactggcctattaacagctgtaatttcccaatgagtcagttactccatgttgctctgggctgagttttttttgtttgtttgtttttgtttttgagacagagtcttgctctgtcacccaggctggagtgcagtggcgtgatctcggctcactgcatcctctgcctcctgggttcaagtaattctcctgcctcagcctcccgagtagctgggattacaggtatgcaccaccatgcccaactaatttttgtatttttagtaaagacggggtttcactcttttagccaggatggtcttgatctcctgacctcgtgatccgcctgccttggcctcccaaggtgctgggactataggcatgagccattgcacctggcctgggctgagttttaatagagtgtcttctatcattgttgttgccccttgctccctgcccgttgtgttgtctctactctactttagcccactctcatgtagctttcctttactctttgcccatagctgggtcagtggagctgtgtacacagtagacacaatgagactcagaaagaacttgatttatgacggatccctggaatctcacttggaatgaatgcagatcacattggtaaatggagaagacgggaccttatgattgcttttctgactcagtctagagttcttttttctgcttcaaagtttcctctttattaacctttggtcagttttaatttgtagataatataaaatgaatgctataaaaccaaattgtatcaaatgcttgtgtatttgatttttacaactgaaatataagacttgacttaactatttgatggtagaaagattgagactttaagaaatgtgggtttttaattaccctattaagccattagtagtttctggcaggcaattttttttttccccaggctggagtgcaatggcaccatctcgactcactgcaagctccgcctcctgggttcatgccaatctcctgcctcagcctcccgagtagctgggactacaggtgtgtgcctccacgcctggctaattttttttgtatttttagtagagatggggtttcactgtgttagccggg

SEQ ID NO: 10213 - DNA, 1059 bp, Homo sapiens
gtcgcattgtattaactacagaaacagcatctccacctattcatcagaaattcgatttaaaccttagcgatatgctcattcttagggcagaacgatgataatggaaggtacacaggagtgcaaatggagggaacatctttagagaaacagttctatggacctaattgcattaactgtgataatatgttaaacataaagtggctgttgattagagctcagactgaaaaaaaatgaggagggatgtaaagaagataaaattggcaccattgggatcgaaataattctttttatttttgttcaagcttcagaatttagctcgcaaacaaaccattttccttggctttcacgattgagcatataaaaataccatttagaatcttttttttttagctccaaaatgggcagaatgatggaacgttggacttatcctttgaattgaaagtgttttgtaatgaggaagctttctgtattataataaagatcaggtttgagcagttacctgtaattcagtgagactgtaatctaatgtgagcatttctctcataactttactctgaggtctagacgttgtttttgcagatctgcaggcttggtctagaggtgggatgtttatattaaagccctagcttttgaaagcccaaaatgaaaagtgcctgggagaaatgtgttggtggattttttttttccacagccgtggttacctgtgtagtagtaatgtgtttttgtatctttacctcatttgatcctcccgatatcttggtgagaagagagcagatggaggtattgatagacagaagcctttgtggaacgaatagcccatgagtttaggagttgagtcccagattcaaatcccagttctactacttgaaagctgagtgatttcagtcaagtcattaaaaacctttcagatggccaggcgtggtggctcacgccagtagtcccagcactttgggaggccgaggtgggtggatcacttgaggtcaggagtttgagatcagcctggccaacatggcaaaaccccatctctactacaaatacaaaaattagctggtagcacgt

SEQ ID NO: 10214 - DNA, 1071 bp, Homo sapiens
attatggagcttacattctggtatggagagttagacaattagtgaaatataatccttaaggaggttatagattctatagagaaaaatgaagtaggggccaggcacagtggctcatgcctgtaatcccagtgttttgggagactgaagcaggcagatcacttgaggccaggagttcaagatcagcctggccaacatagtgaaacccgtctctactaaaaatacgaaaatcagccgagtgtggtggtgctcacctgtaatcccagctacttagaaggctgaagcacaagaatcacttgaacctgggtggtggaggttgcagtgaggcggaggttgcagtgagccgagaccatgccactgcactccagtctgggagacagagtgagactgtttcaaaaagaaaaaaaaagaaaagaaaaacagaaaaataaagtagggtaagaaggataaagaatactggtgaagggaattatgatatattgatgtcttataaaaggagggaaagcctgtctgataaggtgatatttgagcaaagaactgaaggaattgagaaagtgagccatttatacatccagggaagagcatgccaagcttcaagtgcagtgacaaattcaaaggaacttgtcatgtttaaggaatagtaaggaaattagtaaggttacactagagtgaaggaaggggcatatgataagaaaagagctcacagagatagttatggagaacagaggccttaagaccatgtgggcagtagtgaggatttggcattttattcccagtgagagaggaagccattttcatgagagatttgacaggatctcacttaaaatttaaaagtaatcaggccaggcacgatggctcatgcccggtaatcccagcaccttgggaggccaaggtgggaggactgcttgaaccctggagttcaagactagcctgggcaacatagggagagtgtgtgtctgcaaaaaaaaaaaaattctaggcatggtggtgtgttgactgtagttccagctactccagaggctgaggtgggaggattggttgagcctgggtggatgaggctgcagtgacccatga

SEQ ID NO: 10215 - DNA, 1056 bp, Homo sapiens
tgtatataaggtatatatttatcagtactataggtaccatgtagttctacttttccatatacagagttgtttcctagctttctgctaatctaactggattcctcttccccatttcctcatttactagattataatgcacatcacataataaaagcttaaaaatgggctttcacagttactgttttctttttaaataattgtgagagagcttttacatcatttattatctaatcatgattcaagtgactaggctgtagcacccaagaaccttgccttaaaacagtttattttacccaataatactactttgccttcttacttaaaaatgtcctgtgcttaacccttttgctctttattttgatttaagcacttgaccctaaagtcctgcttctgtcttacagaagattgttgtcatttaaaaaataaaacaatcagtactagaactagcataaatagtaatatctaacatgatcatttgtattatatagcatatttaagtaaaatgtgtttcattccattcagtatttcataaaaagacagcctctgaaaaatagttttactccttagatttctcatccactaccctcctcccccccccccccccacacacacacttttttttttttttttgagacagggtcttgctctgtcacccaggctggagtatagtggtatgaacacggctcactgcagccttgaactgctgggctcaagcaatcctcctgcctcatcagccttctaagtagctaggactacaggcccccactatcatacccagctaattatttatttttcctagagatgggtcttgctatattgcccaggcctcaagtgatccaccagccttggcctcccaaagtgttggaattacaggtgtgagccatggtgcctggcccaaattctttttttctaatgcataagtattactttgtttttgaaagtggtatggtgtttaaattgctgaagaaatgataatgataaggtgattactttagccttcacctggcttttcatctgggaattagtacattcttttagtgaagcaataagtgtgtg

SEQ ID NO: 10216 - DNA, 1058 bp, Homo sapiens
acttaaggagaaaactcattggtcccctttggaagatgccagagactgactcgagcatttatcctcctttcctctccctccctccgtcactccctccctccttgttctaagtacctcaggataaccaaataattgagaaagtttctttctaaagaagtatttaatttgctataaaggacattggaataactggcagtaaaggacattattgggataattgacaagaataaaacctatagattcaatgatggtatgatgttgatgttaattcccagatttaataattgtactgtggttatataagagaatgtccttgtttttaggaaattcacactgctgaagtatttagggctaaaggtctgcagattggcggtttactctcaaacagttttttaaaagtgtttcagaaaatttatatacacagagagaatgagaagataacacaagcaaatgtaaaatcttaacagttggagtgttatgtaagagaatgttcttgtttttagggagtggagaattctagaataataatttcttgtaggcaagaagggagtgggatctaatacatagatgtaagttttgagaataaggacaactctttcatagtaataggactagaggtaggatataagggcacacttgcaagtaaatggaagcttgtggaaattctcttccattgcccattttctgtgttgtaggaagcagggtttgtcagctgatagtttaaatctagctaattagaacatttgtatatttatggaatacttatctgccagcttaagcattaggaataccaatataaatgacataatcttgcacttgagatctcacaatttgagacatagtgctaattgtaatgcatcacaaaataccctgtaaaggtaatattaaagtattaatattttgtatctagaggctttaccatacatgtctttgactcacttacttcacttacagaaatccacaaaatcggctgggcacggtggctcacgcctctaatcccagcactttggtaggctgagatgggtggatcacctgaggtcaggagtttgagaccagcc

SEQ ID NO: 10217 - DNA, 1875 bp, Homo sapiens
gatggggtttcaccatgttggccaggctggtctcgaactcctgacctcaagtgatctgcccgcctcagcttcccaaaatgctgtgattacaagcgtaagccactgcgcccagcccccccgactatttctaaccagtctcacttatacttgcacttttccaccaccatttattctccacactgtagccagtgtaatatcacactctaatcagatcttacctcactttaccactggcagggggaacactctttaagcctgtcaaaaccccaaaaaacttccatattcctaagtcaattatcaaatctcagtgcctgattgcatgtgacacagttgatctctctcctttgaacactttcttcacttatttctaaggcatcacttcttcttggttctcctccctcactggctgctcccgctctgccttgtttgctgggtctccctcatttcccctacttcttcttctatatgctgaagactcccgatggttaacttggcccagacctaactctacaactgtaactctacaactgcctacccagcatcttcacttgaatatctaatagatgtctcaaatttaacatgtccaaaattgagctccagattttattcccaaatccatttccccttcagtcttctcaatttcgattaaagggtacagctgaactctggaggggggtggtgttttttgtttgtttgtttgtttgtttgttttttgagacagggtctccctctgttgcccagactggagtgcagtggcatgatctcggctcactgcaaactcctgggctcaagtgatctcctgcctcagcctcctgagtagctgggactctagttgagttgttcagaccaaaactcttggaatcctccctgatgccagttttcaattaaacaggaaattctggcagctctatctttaaaatatacagaaatgtgcttctcaccaccctggtctcaaccatcattatttctggcctagattattgcagtaacctcctaacttgcctttctgctgcttcccttgctcctcacaacccattccccatacagcatcctgttaactttttaagacgttaaatcagtcatcaactcaatcatgtgacttctctgctcagaaccttccaataacttcccgtcattgaataggagaactagagctgggcctgaggataggcaggccagaaagtaggaagatagttttgacctcagacttgaaatttgcatcttttaacaaatgtgcaaagccacagtcctgagctaggtgcagaagacaggagcttccctcggggaactcacagttccctggggagccagccttatatctaagttcctccaactcctgccaactgcctgtcatgctgaaagagctaggaccctcatgctgtggaccctgcctttagggagctcgcagttcttggaaacgcactggactccaaaccactcatttcctcaaatgacatttgcctatattagcactgaagtaaagcaaagggaatgagtataggaaaagaaagacagagccatgtggggtggcttaagttgaattcaacaaagataaaggaaaggcttttcatgctgtggatttgaaaagaagaaaccttagaatcaacagaagttggacagcagaaggtacaagcactgtgtgctagagacatggtcagaaatgggaagagatgggcctggactgaaacaagataggaattagaagcaaaggacaagaagcagcctgtcttctgagccttggcctccctgccctgtccacatggcacttctttaccatgaggtgagccttgtcttgctctgtgccttcctgtgttaagcccacgctctgcccacatcatgaatgggcccctggattaaccacaggcatcgggccag

SEQ ID NO: 10218 - DNA, 1045 bp, Homo sapiens
tttaaggctaggctataattcactctctaaccatcttaacagagatccagctcttcctgaccctgccctgctcaagggacagggtggtaaagtgggctgtgaggtcagacagatctggaatcctatcctggctttaccacttactagttacatgtgacctgaggctaattactttagttttctgagctttagctttctaatttgtaggatgaaaataatatagtacctcaagggctgttacaaagagtaaatgagaatagaaataactcacttttatatggactttatatacattagctcactgggttttcacagcagccttaagagagaggttttattactaataatacttgtgaaatgcgtagaacagcagtttccaaactttctggtctttgtgctttatttgtaataaccaaaaactataaacaactcaggtgtccatcaacaaagaggtgaacaaataacaaaattgtcgtatatccatacaatgaaatattaatactactcaaaaacaagaagaaatgcattactgatagacaacaaaatgaatataaaaataattatgctgaggaagagaagctagacgaaaaagagtacattgggccagccatggtgactcaggcctttaatctcagtgctttaggaggctgagatgggaggatcgcttgaggccaggagttcaagatgatcctggacaacatagtgagaccccatctccacaaaaaaattaaaaatttgcctgcctgtagtcctagctactcaggaggttgaggcaggaggctcacttgagcccaggtacttaagggtgcagtgagctatgatcacaccactgcacttcagcctgagtgacagagtgagaacctgtctcttaaaataataaaaagtaccttgtatatgattccatttatataaaatcctagaaaatgcatcctaacctatagtgacagaaagcaaatcagtggttgcctagggacaaggcagggtggataaggaggaaaggaggaaggaattgcaaaagacaagaagaaacttttggagatggtag

SEQ ID NO: 10219 - DNA, 1035 bp, Homo sapiens
gcaacttgcaggtcaatagtattatcccatttaacaggtaagagaaccaggcctggaagaagctaagtgcatggccagagtcactcaggtgataatagcagagctagcattcagaggtgaatcttttaattcccagctagaattagaatctctgaccaatatttgtttcactttagcaccgtgccgctcattggtcaggaagtaggctctattcacttccccaggggtgtttggggaatgaaatcaagcctcttggttttctctagatctccatcttgcttacctggagcactggcacctggtttggaactttccaacactttgtcacttaaaactgtaatttatgtaatatataaatgtattggaggtgttcagtggattccacttcagcttctttatctggtgtgaaagttaggcattttcttattttgttgccttgcctctgcatggtgtagcattgaggtcaggcaagccagggtttaaatcctagccctactacttactgactcttaagtgacctcaagcaaaccattttacttctctgagtccaaccttatcatctgtaaaataaggataataatgtccatgttataggcttttgtgcagatgaaatgtatatgaaacacgtggtgccatgcctggcccaaggtaggcactcagtaaatgttctttttctcttcctcttcccttctctccattctctcattctaaggcataagcggaatcattacccattccagtaaaactcttaaatgcatgttgaggaacttcttttccatacttcctcctctgtcttagggaaactttgggagtggtggggaggaaatgttgtgtcaggggagcctgttttcaagtcttggcaagttacttcacctctctgagcttccatcccctcattttaactgtgaagataaaaatatatgccagaagatggctaagaagatgaaatagtgttgggaaagtgctttgcaaattacaagatattcttcaaatctaagttttatactacagaaagttcctatacatttagtttac

SEQ ID NO: 10220 - DNA, 1106 bp, Homo sapiens
caatatttggtcatctgactcttaggttcaggactctttgtagttctgtcctgtcttttgcctctcaacacagtattttccatcttcccacaaagtacagaacatgagagaagtcacttctttttggagaatatttatgaactgagccttaaaaagacagggtaatagcagaaaggtcactgaaaacatgtcatcaattgattgattgattgattgacacggtctcactctgtaccccagtctggagtgtagtggtgcaatctcagctcactgcagcctctgcctcccagactcaagagatcctcccacctcctgagtagctgggactacaggcatgtgccaccatgcttggctaattttttttttatacatgggatctcactgtattgcccaggctggtcttgaatttctgcgctcaagttgtcctcctaccttggtctcccaacgtgctgggattacaggcttgagccactacacccagcctgaaaacatttcagacacagggggatagcttgagcaaagaccccataggaagaagagggccaggaatagtcctgcttgtgcctgtataatctgaggcttcttgtgtaccctaaagtacagtcactgcactttattctatttcagggagccccttgacagagcggaaagtatcgatacccagttgttgtgtatcctttgcaacagccgatgagtcatctcctgtatacacccaagtggttgaaaacacagattcccccatctggaattttcaacagcagtcaaggtttgtgttatccgttattcgtcagccttccagaatctgctttttgttccaagacacaaagtcagagcaaggactataaccaacacaatttttgagcagacctggaaaatgcttttcttatccaagcaattatttaatcctagtgtttatgaattcacaggaagcagtggtttaaaggttttgttttagtgtttttaactcttctcagtatgctcaaaaattgttcagtgagaggacctctctgttttaggcacttggaattaaagattattaagatactccatgcaattgaggagttcatggtcttacctgggaaaaaatatcaataacaaattaccat

SEQ ID NO: 10221 - DNA, 1025 bp, Homo sapiens
tgtgagatctgatgctgaagagctaagatactcagtgtagttaatattgttcctcactaaattctccacgtagactctttcagttactgcccaagaacatcttagtgttagtgaaggtgatgtcaagacaggttggttttgggttttgtttttatgtttgttttggtttttggtgtgtttcgtttgtttgtttgtttaatttcaactttttattttagatacaggggtacatgtgcagatttgttatatgggtatgtcgcatgatgctaaggtttagggtacagatcccatcactgagacagtaaagcagttttataatcataccacttccttacattaaaacttgatgatttcccattgttgatagcagtgatctcataattttaattatgcattcctattaataaaaaaggtagcataccctttaaatatgtacatatttactcatgtataaatcatcttcatgtactgctatactcatatacaaaatatattctaagatataccatggaatagaaaaactttaatatatgagataaccaatatagtttatcctatgaacctcctaagttgtatacagccttctttagggatcattggtccatataataaggtccaacttccttagcttggcattcaagccccttcaaaataaatctgagtcttaaaagaagaatagtagttatcaagatacccaaaaggggtgaaaattattttggtgaaagagaagaacatgtgcaaaggcagggaggcatgaaacttgtgtttttggagtacctcctcagtctcagatccagccaacatcagaattcttcaatatggcattaaattaactagcatttaattggcagagaaggactcagaatttagatactcagtagatctcagagagggcagataacaagtcggaaactcagtagttgctctgtctgaggactcatgaggaaagtcagattggatgacaggcagtttgttctaaatctcccatttggtctgtgtcatatattcaaggagggagaacaaga

SEQ ID NO: 10222 - DNA, 1050 bp, Homo sapiens
cgcctgcctcggcctcccaaagtgctgggattacaggcataagccatcacgcccagccaatattttcaaggctgtgcaaccatcaccacaatctaattttagaacattttcatcccccctaaaagaaaccccatacttactagcattcgcttcgcatttccctcttcccccagccctaagcaactgctaatctttctttccctatcaatttgtccattctggatgtctcatataaatggaatcatgcaacttgtgatttttgtgactactgtctttgacttaccataatatttttaagtttcatgttatagtatatatcagtacttcattcctttctatggctgagtaatactccattgcatagatataccacatttcatttatccttttctcagttgctggacattcgtgttatttccacttcctggcaattttgcataatgctgctatgtgaacatttgtgtacgtggttttgtatggactgtgtgctttcatttcccttgggtatatatctaatggtagaattgctgggtcatatggtaactttatgttttaactttttcaagaactgccagactgttttcaacagtggctgcaccattttcccactagcagtatatgaaggttctaatttgtctacatcctcgtcaacacttgttactttccattcttttttattctggtcatcctggtggatgtgaagtgacatcacattgattttgatttgcattttcctgatggccaatcatgtcaagcatcttttcatgtgcttattggccatttatagatcttctttggagaaatgtctattcagatcctttgttcactttcaaatcaggctttttgttattgagttataagagttctttgtatatcctagatacaagccccttatcagatctatgatttgcaaatattttctcccattctgtgggttgtcctttcactctctagatggtattgtttacagcacaaaagtttttaatttttatgtactctagtttatctgtttttttttcttttgttgcttaggcttttggtgttgtcttt

SEQ ID NO: 10223 - DNA, 1925 bp, Homo sapiens
tggcaagatttcatgatgaaaacaacaaaagcaattgcaacaaaagcaaaaattgacaactgggacaattaatctaaagagcttttgcacagcaaaagaaactatcaacagaggcaacctacagaataagagaaaatatttccaagctatacatctgacaaaggtctaatatccagaatctataaggaacttaaagaaatgtacaagcaaaaaataaccccattaaaaagtgggcaaaggacatgaacagacacttttcaaaagaagacatacatgcgccaacaaacgtgaaaaaatgcccaatatcactaatcattagggaagtaaaaatcaaaaccacagtgagaatggcttacaccagtcagaatggctattattaaaaagtcaaaaaataacatatgctgacaagattgcagagaaaagcgaatgcttatacactgctggtgggagcataaatcagttcaaccgttctggaaagcagtgtggcgattcgtcaaagatctaaaaacagaactacgatttgacccagcagtcccactactgagtattgtaagaatttgccagtaaagtgatctggacctgaagatttctttttcagaaggttttacctaaaaattaaatttaaaaaataattatagctttaaataattatacttttagggtacatacccaaaggactataaattgttctatcacaaagacatatgcacatgttatgttcattgcagcactattcacaatagcaaaaacatagaatcaagctgagtgcccatcaatggtagaccgttaagaaaatgtggtacgtatacactatggaaaactatgcagccataaaaaagaatgagatcatgtcctttgcaggacatggatggaactggaggccattatccctagcaaactaacgcaggaacagaaaaccaagcaccacacgttctcacttacaagtgggagctaaataatgagaacagaagaacagaaatagaggaacaatagacactgggacctacttgaaggaggagagtgggaagagggagaggttcagaacaaaaaacctgtcgggtactgtgcttagtacctgggtaatgaaataatctgtacaccagacccccacgtcatgagtttacctatataacaaatctgcacatgtaccccgaacctaaaattaaaatttttttaaaaaagaaaaactgtacatattgtgtgccaaaaaagcttattggcactagagaagctttggggagctggcaagctctttttgatgagtgaccctctcattggtaggtgaaactgctctgagggttacagcaggccatttctgcatccaggcttgcagagaattgcattgttggagcaatctatataccctgagccctttttttcccctggcccctcaactgatttagttggatatgataagaaggacccaatttgtataatgaactttcacattctcttccacaaagaaatatgcttttttcttttgtttgttttgaaattaatgtctcttgttctctttcatgaacacaaatatttcactttccttttgattctactgtaagaaagacagcagcctatagcacccatagatattaaggaaatactgtgaacaactctacacatattaatttgacaacttagatgaaatgagccaattctttaaaaactgtaaactaccaaaactcactcaagatcaaatagataacctgaataaaatgataattatttttaaatttaatttttagcttaaaaccttctgaaaaagaaatctccaggcccagatcactttactggcaaattcttccaaacataaaggagaaaacagttattttaaggcctgcatcaccttaataccaaaaccagagggcaatataagaaaagtatagaacaatatccttaatgaacctagacttaaaatttttcaacgc

SEQ ID NO: 10224 - DNA, 1048 bp, Homo sapiens
ctgtagtcgttatttatttttttctaattttatatgttttaaaaagcttagaaatttgttttgttttttttttgtttttttttttttttttttttttgagacagggtcttgctctgtagcccagcccaggctggagtgcggtggtgtgatctaagctcactgcaacctctgcttcccaggttcaagtgattctcctgcctcagcctcccaagtagctaggattacaggcatgtaccaccacatccagctaatttttttttgtatttttttttttaagtagagacagggtttcaccttgttggccaggctggtttcaaactcctggcttgaagtgatccacctgcctcgcctctcaaagtgctaggattacaggcgtgagccaccgcacccatccacagaaacatttttcttgatatcaatttttttttttttttacaaaaggaaagtgtccattaagtacaacatagtggatgaaagcagactttcagcaagttatatcattgtgacattttagagcactgaaaacaaaaacaagattctataaacttccagagaacaggagaaacagtcacacacaaagaattaagtagagtggcttcaaacttctcaatagccacattagcgtccagaagacaattcaataatgcctccagaatgttgaatgaaaatggcctagaattctgtctctctaggcaaactatctagtgtaagagtagaatgaagtttttgtatatacaaagtctcaaaaatttgtacctctcccacactcttcctgacaaagcagctgagggactttctctgccaaaatgagggagtaaacttaaaaagaagacaaggtgggatattgcaaacaagagatacaacacaggagggagccgaagagaatcccttgatttgaggtgaagcagctgtacacaaggcatagatggcagctattccaaattggagtatatgctaaggctctgggagagatttctcaaaaaaaaaaaaaagttacaaaacacctattgtgtctgaaaatcttaagaggagaattcgataactggca

SEQ ID NO: 10225 - DNA, 1050 bp, Homo sapiens
gctgtgttgattgtttcctttgttgtgcagagctttttagtttgatgtactcccatttgtctatttttgctttgttgcttgtgcttttgaggtcttacccaaaaaatccttgcctggaccaatgtcatgaagcatttcccctatgttttcttctagtcgttttatagtcctagatcttacatttaagtctagtccacttttagcttatttttatgtatgatgagaggagtctactcttattctcctgcatgtgggtattcagttttccagcactatttattgaagatatcaacttatgttttcttcatatactgttacatgccactaacttgggatatacagagataagagatggccctttcatttaattttccagaaccctgtgtaatacatactgtgtgatagatatgcatgagatactaggaaagaacatagaatggtccctcttctgtggggggctcattgggagcactttctagaaaattctgaatattcaaaccccttagaaattccaggagggttatactttgtcaattgtattctaaaatgtatagagaaaattaaatactaaataagaaaatagtctaaaaaggataaggaaaaaacatctaacattaccaaatgtaagaatttattaatattataaaatcataagcatataattttgtcagtggaacagattccagaaatagatccatctaactgaaaaaaaacttaacatttattgtttttatcctattctcatttataatatattaaatgttaaaatagtgacactttatattgatgacttaagggtgaagtgagtctggtttagtcatgcttttctgttgatgatataaatttgcatcagcactgccagacagtttggcattatgtttcaaaagccacatgaattactgtatatcgtttacctcattattccacccctgggaatttaccttaagtaaatactatgaaaagagaaggaagctatatgcttcagtctagtattggaaatacatttttaatattgggaaaatgaaaacaatttattcaacaatattaaag

SEQ ID NO: 10226 - DNA, 1062 bp, Homo sapiens
agcctcgggcactacaatgtttatctttttctttttgaacaatattgtgaaaatgattgcattctcattgagcatgaaagtcaaaactggaattttctaaagctttggagaaaaggagagaattagtagggcaagatcaaagcatacattggaaataaacagtagaaataagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagaggtagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaacaaaaatgtcataaagggcactaaaagtaacatttgggtttcactccatatctagaagaatttagctcacaaaacaatttttgtgtgttttgagtaactgatgcataagtgcaatgaataattttcctgcttcactgttatttttaatttaacctggcaaattaagtgagacttgaacaaaattttgttcatcttgaagaatgtatagtggcttaggtt

SEQ ID NO: 10227 - DNA, 1025 bp, Homo sapiens
aatcagaaaaaagaaatgtagcctggagttgaatctgattctcaggtgtttggtttggcctgcacattgttctaaaatggcaaattagttgctgactctcaaataggagatttcacgtataaggcagactttccttgaaaaaaaagtgaagctctggcaacagtgacttaggtttctgcatggcagcagttggtaagagctgactagttgctgcctctatgagcaggtgcactctctctctctctctctctgacacatacacacacacacacacacacacacacacacacacacaccctcctactctcttcccctcgcctccagctttcttcactcactcacatagcctgcccaacttctgtaaccatttgtgtttgcaagtcctcggtaaaatgtaggtttttccaaggtttgacatcagactgtggtgaacaatctgtgaatgacaaatgataagtgcagttgtgattagggctatccatgcctttgaggaatcgtttttatgcctgtctctctgaagagaataatcatttgatgaagaaaagactgagtcataccctagagtcagaactatattctttttccaacttttttgcatgtgtgtgcatgcatgggcacacacacacccctaaagaatttctgactcactgtaaattggtattgaagagtctcggagccaccccatagcagatagaggatggaaggttatttcttttgtgctctttttattctctaggtgttagggaaatggaacacttgggatatttgaagtctctctcccatcacaactgtccctgaaggagcctgccctccctcatcctcagtgagggaacccctcccctggatgctgggtgcccttcttcctgctttctcagggatggctctgcgggtctgcccatctctctcctgcattgtcagcctttcctcccttgctgtctccttcctctcagtctagatgtagtgaagcttttctcatcctgttaatagcatagtaatggaaaatgagcagcatgagttagccatgt

SEQ ID NO: 10228 - DNA, 1100 bp, Homo sapiens
ctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgatgtgtgttgtctctgaattgccagcaggagggtggggacaagtgcgctgggtctaggtttcagttctgaccctataatctgaggaggaaccattctcaggaatgaatgggaaagtggcagaatggtgcctccccttccctgggtccgccatggtgccagtggctgggagccggtatcctcatatggtggatggggagacagtcttggagaggtaaagtgacctccaaaagccacacagcttagaacaggccaagccagaatcccatccagactctggcccc

SEQ ID NO: 10229 - DNA, 1032 bp, Homo sapiens
ggacataggtcctctatacagtgactcttctagcaaggacagggcctggcatatcttgtgtccccatcaccaggtgtggggctgcagacactataggtcttcagaaaagcttggccaagtggatcagaagtctgaacccggggaagctcccagtctggtgggtgaggcagccacggaagcagataattacagcgcactgaggcctgtgatcattctcaggagctctgccagatgatatgagcacaaaaaggaggaggcagtgggcttttgttggggggaatcagcccaagctttgcacagggtctgtttgttaagatggatgggatttggattgggatttggattgggatttggggagggctttcctggcagagggcccaacctgagtgaaggcatggaggtgggaaagctgggtaggtggtgtctttggagcacagtggtacaaggaggggtaggagaggacagagacaagattgctctgtacaagtctccactgtactcacgttcctcctcctcctccccctttcatttacttggtgtgccccactttcccactcccctctccctgggacttaggaagagccatcagaaaaagccaggctggcccctgcagctgaaccactgggctcctggaaggggcttgcacaagtcaaactgagggtgggggatgctgaaagtctctactacccccaaatagtagtcccggggccttcactggctctgcctgctccccagagaacctgtcagtgtcactgggggagaagggggtgggggcaggatctcttcttaggatggccttaatacagtcctggtggcttggagaaaactactcagccctccagggaggggagaggcctgtcactaggagtatgtgagtctagggaagccactgaccggtctggagaggctggagaaccaccagtaagagcagcacaggggatttctgaatggaaggggaggctggatggagtgcctccaggactttggtgctgatgttttgtgacttagcagtctgaaatccagggataattt

SEQ ID NO: 10230 - DNA, 1049 bp, Homo sapiens
aggagcatctctgggatgtcaggagtagaaactcacggatatgggaccctcccaatgtgccccgggcctcactgtggtgtacacccaggctgactgaagggaagggctttcttgtgattacttccaggagccaaagtgaccatgagcttgaaggaaacgaagacaagcttgggttacacatccatccccaggtgtgagctttggagtcaggcattcctatgccaccgagaagcaagtgtgtgccccatgtagggcagggaaggaagggctcaggaggaggtgacatcagctgaccagaaataaatctaacaatagctacttccgttaactgcccactgaatgtcaagcctttaaatcctgtgaagaatgtaaagaagatatggagtgtggccctgggtggcagcacagggtgtgggagacaggcagggattggagtcctagcctagcttgaccctaacctgcagcctgacataggatgcccctttgcagccatgcaaatgagactggactcaagagtaggattctgtcataaattttgtcttatcttatcctttaagagagacagaatggactcatgaaagaattgaagaatggcatgaaactgcctgctaaccacaaagatggccagtaaagtaaatgggccaggagctgagagatgggaaattttgggttgagtaacccaggagaggttcctggaagaggagaaccctgagctgggccttaaagaatagctagtattggggcagactgataggaggagagcaccatcaatggagaaacagtgctgcttcgctcagaaactttcagcatcttcccaggcacagcacatgcttccaaacatggcatgcaggctctgtgtcacctggccccagctcctatccagcctgggcaccttgcacagcctccaagaccccagcctgcaccctgagcagccaccctgatcagttcacctgctctctctgaacctgccatacagactcagactggtgcctgaattcccttcatccgcttttctgttgacatccttcaataaccctttccccagtcct

SEQ ID NO: 10231 - DNA, 1094 bp, Homo sapiens
atttgcccgcctcagcctcccaaattgctgggattacacatctatgaatgttttaaacactttgcctacgttctgttatttaagtctcaccatagccttttttttttttaagtagacaaggtttcactgtgtcacccagactggagtgcagcagtgtaatcatagttcactgtaacctcaaacccccgggctcaagtgatcctctcaagtagttcagactataggcatgcaccacaacacccggctaatttttttactttttggtagagacggctctcactatgttgcccagggtggtcttaaactcctggcctcaaaggatcctcctactttggcctcagagtagctgagatcatagacatgagcaacaacccccagcctcatcatagccttttgaagtagtaattatttctattttattttattttaatttattttattttatttttttgagacagagtctcgttctatcgcccaggctggagtgcagtggtgcaatctcggctcactgaaacctctgcctcctgggttcaagcaattctgcctcagcctcctgagcagctgggattacaggcatgcgccaccatgcctggctaatttttgtattttttgagtagatacagggtttcaccacgttaaccaggctggtgtcaaactcctgacctcagatgatctgcccgccttggcctcccaaagtgctgggatattacaggtgtaagccaccgcgcctggccttatcatttctttgtaacagatgaggaacatgaagcccagagaggttggataacttacctaggtcacacagctggtgtccaaggcttgtgctcttcctggggctaggccaggagtgagaacagctgggtcattgatttataatgattggtagctttatccagccattagactagggcatccttgaggaaaggatctatgtcatattcattaccaaatgagtctgggaagagttggtgcttagtaaatacttcttccacaagcagatcaagttcattcatgtccagaagcagggggaaaggcattcctggcatcaggaaaagcttgggcaaaggcatggtggcaagacagttcctttcaga

SEQ ID NO: 10232 - DNA, 1078 bp, Homo sapiens
tgtttgtttatgttctcttaaaatgcagtgtgcagaactagatgtttcatttgagatctgaccactatggagagagtgggactctttctaaactcaacacagcttaatgatttcattcttgttttatcttttaggttgtctgctttgactcccagtaagtttgcagtcaactaaaatttctgatttttttttttttttttacgtaagcttgcattaaactggaaatgtggaactttttcactatcttcattaagtcccatttttattattttagcccatcattccagcccatcaaaatttttttgcaaaatagtaatagtggttgtatataatatttgtattgtgctttactttgtaccaagcactttcatgaacagtatctcattgtgaggtagggtttttttatccatattttacagacaaggaaactgaggtttatagacgttaataacttgtccaagagtagtaagccataaaacagcaaagcagtgttttgaatttgaatattcctagcaccaatatctagcacctttctattttatcatgttcttttctccgatacctgaaaaaaaaaaaaagttaagcttcttgcccagggttcagagacatcgtaggtggaggtgaaattggactaaatcttggactctaatttctttacctcttatattgcatgaccagctacctcttcctgttactggtagatttcataagggcgccttcttgttctgcatctaaaacactagtaagcttcagtttccttaaagaagaaaagagttgaactttgacattcccaacactataaagaataaagccttcttctttgagatggctgtgtctccttaatgtgggtcctgactggctctgaagaatcctctgaaagttagtaccttatcatctctttcagaacttattatacagagaatatagctcatgcaaactactgaaggcgacaggggtattagattttggttcaggatatggaaaaatgaaagctgtcagtaagggtatggcctgtctcacaaaatggtgagttccccatcagtggatgcatctacatgataaaacgatgttattgaag

SEQ ID NO: 10233 - DNA, 1041 bp, Homo sapiens
cctttttgataaataaataagatatgctggcccacccccaaacacattctgaaattctccgcagggcccctttctccccacctgtcacccccccagttgaaaatcatagatctaatcttatcccttttatagatgaagagtttgaagccacaagaaattagagccacgtgccaagggtgatggaggagaggagagaagcaagcaggaacaggaaattaatatatattgagcatctgttatatgatatgcagttggctaagtactttacatgaactaatcaatttaaattatcttgtattctcttatgtccactttacaaatgaggaaagtgaagctcaaagaagttaaataactttcttaagatcctacctagtaggtactaggtagaagtaccaggttggaattcaggtctcctggccactagagcctacattctctgtactacctcttatagcttcttaaatgtgagaatggatgctgcagggagaggattatttttactgctcttgtttttgacactcacagattgtgtgtagaactgcatttgacaaatatcactttattgaacactgtgtttttttccctctttctccgccaccttactgttcagtgcttcaggcaccgtgtacacagcaatggatgtggccacaggacaggaggtgagtatccaccacccactgttgctcctttagttctgtttctttttatttgggattaatttttagcccttgttaggtcaacaggaacagttctaggtttttttttttttttttgggatggggtctcactctgtcatccaggctggagtgcagtggcgtgatctctgctcactgcagcctccgcctactaggttcaagcagttctccagcctcagcctcctgagtagctgggattataggaacctgccaccatgcctggctaatttttgtattttttagtagaggtgaggtttcaccatgttagccaggctgctctcgaactcctgaccttaggtgatcttcctgcctcggcctcccaaagggctaggattacaggcatgag

SEQ ID NO: 10234 - DNA, 1017 bp, Homo sapiens
aggcaggagaatggcgtgaacccgggaggcggagcttgcagtgagctgagatcgcgccactgcagtccggcctgggtgaaagagcgagactccgtctcaaaaaaaaaaaaaaaaaaaagaagaagaagagcccctctgttttcctcttacagcactttgttattttctgcgatggcatttataatgatttgtgattctgtatttatttgactcttggttatgtctagactttcaactccatggagtcaaaggtcatgtcttttggtcaccattgtacctcatcacttagtacaatgcttggaacacagtgaggcttgtaaatatttgcagaatgaataagctcttgctatcagtccaatggattatcaagccttgttagttttatctctgtagttttttttaccagtttatttttatttctctatcctttctgctctgatttagactgtaatcatctcttcccttgacttttagtaacctattaactagtgtcgtggcaaccagtctttgtgccctcttatttattcattattctgcctggagtaatttttctgatcctgtcactgttcttcccaaaagccatcagtgtgtctccattgtttataggataatatgtaaattagttattcagggaacttaataatttgacctcacctacctcttcagcatcatctcttctaaccctactctatctctctaaatagacagtttcagtttcattccatttcatatcatattaccctgttccctcagcctggaattctgttttcctctatgcttttaaaactctttattcctcaagatgcaacttggatgccagttcttccatgtaggcttccccagttttcatcctcccatttatgattttaagttcctagagggtagtactttgttttgttctttgctgtatcttcagtatcttgatcagtgcctggcatgtagtaggctcttaatacatatttgttgaaagactgaataaaataatttacttttgcactccctcgacatatattcatc

SEQ ID NO: 10235 - DNA, 1031 bp, Homo sapiens
cttcatttcctttaagctgaggaattgcatgttactgaaaaatggcattggactgagacccttgaaggcctatttgtcttctagtgggtcagctctttttagtattatcgaaggcaatgtttcaaaattcgcagttttcttttggattagtatgggtttctttaaagtgccacactattctaataaagcttaacatgaataatgtgactttgttccattaaaaataacagggctttgtttcacaaacttttgaatcaatttaaaatttagttatgatgccatcctgacaacccttttctgtttccttttttggtgtatgtaaacatacataaacatacatgtagttgtaatcataatgtagacctaagtttgttgtttgcccttttttcttgacttatacacattcccgcatgttactctttagtcttcattgtaaaatttaagatgatgttccataatttacccgaaactattgtgtcagtcaatgttctactggagaaacagaaccagtagaataattctttcttagagaaacttcagttttgctcttaaagcctttcaactgattagatgaagtccatccagattatggaggataatattctttacttaacgtcagctgattgtagatgttaaccacatctgcaaaataccttcccagcaacatctacattaatgtttaattgaataactggggactatagcctagccaagttgacacataaaactatcaggtgtaggtttttaggtttttcttttcctattataaattatactgtaattttacccaatagcactgcatatagctttctcctttcaaagattacttctttagaataaatttctataggtgggattactggatcaaagggtagaagacctaatgggctcttgacaggatttgacatttgcaaactgaaaaaaccactacagcctttcttttgatgatttcttcaggaattggcctattcaactgactcatttaccttttccacaagcctagttttctgcctgtgttttctatctctgga

SEQ ID NO: 10236 - DNA, 1050 bp, Homo sapiens
gtagctgggaccacaggtgcgtgccaccatgcccggctaattttttgtatttttagtagagacagggtttcaccgtgttagccaggatggtctcaatctcctgaccttgtgatctgcccgcttctgcctcccaaagtgctgggattacaggcgtgagccacctcgcccggccttgaagacatttttaaaaattattactgtgtaaccacagcaagtcacttaaccgtcctgagactcagttttccttagctgtcatataaatgtgttgaatttgatgccaacttctttgcttgaatatttcgacagtgattcttaaccttctcacctactccctgccctcaccctttctctgtgatacactgggatgtagtccatcagtaacagtatttcactatggaaatagttcccaatgggctacaggaacaaaatgtaaattgccagttttggggatgggtaaagagggacttggtatagttggaggggctcttggttctccaattacctgttagagaattactattaatattttatttatttatttttttgagacagggtcttgctctgtcatccaggttggagtacagtagctccatcatagctcactgcagtgctgccctcccgggctcaagcaatcgtctcactttagtctccgagtagctgggaccacaggggcatgctactaagcccagctaatttttgtattttttgtagagacagggttttgccgtgttgcccaggctggactcaagtgaactgcccgcctcagcctcccaacgtgctggaattacaggcatgagccactttgcccggccaagaattactattttataacattccctcccacttattttctcatatggaattatctcaccagtccagagtctgagatttttttggtatccaggatagattttgcttaatttaataaattacatatgtaatttgtaaagtaacttaaaaaaaaataaagaaccaggtgagcaaaatgagaaagcccattgtgatagacttgaaaagtccaagtttcctggactttctagagattatata

SEQ ID NO: 10237 - DNA, 1045 bp, Homo sapiens
gctatatagggcctgtttgactccacacaaaggtttctcttccttgtcaagctcttaaaatgctttgtttctttcactttcttattagccctaagataccatgcccagttttctcctttcctagcttccttctgggagagtggcttcaattattcatccgtttactataaaattatgagtccttctccaccatgtgccagaccctgtgctgggcaggatgttcagctatatacaagagtgcagcccaagtctttaaggagctagagataatatgacatgataagtgctgaaatgaagagatgaaatagagggatgaaaaaaggtggtatatgatcataaagggggggagaaagctgcctttctatttgtttccctcagtttaggaataatttgtcaaacaagcatcattttgacaggcagacttttaaaaaattttaagaggtcatgggctttgttggggaaaactaaaacaaaaatcaaggtggaatcagcagttgccaatttgagacattaattctgttgttgctggttttaatgaattttctgatccctctccatgttatttttctaaataataaccagaaagtgggagaaaaatatttctttttggcatagtaaagagacaagtttaaggttatcaaaagaatacatctcactacagtttattgtttatttttgaaaagcgataaacaatatgcatctaaaaacgaggcttttgactgtttatgataaagaaatgataaatgtttggagtgatgaatatgctaattatcctgatttgattattacgaattatatacatctcaaaatatcataaatatgtacaattattacatatcaactaaaaataaaaggaaaaatgcattgattcaaaattaatagtcagtatattcaaacttgaaaataaaaaatttaaaaacattctcccacaccagtgtttgctccttctgggtcattttctatgcccattattaaaaaaaaaaaaaaagtctcttcacagatgttttaatttctaaggggtaatgttgtaatttgtagtgggtga

SEQ ID NO: 10238 - DNA, 1067 bp, Homo sapiens
tccctgtctgctcgttatgaaaaaaagctttcagtaacacaactcccacctaccttcccacacagaagtcatagtcagctcttctttgcccaccttctcaaacatgtgcaagcaaaaacatttcagtaaaacaaaaaggataagttaaactaacagaaagaaacaatgctggaggaaggggagatcactcagaggaataagccaaataaataaaataaacaaatttaaaagaatcaccctccttagtattctcataaagatgatgcatccacaaaataagaacaggttgctatgaaaagggaagacctcacagtgcaagatagaggctttcccaaagttgataacaatcctaacagtttagagaacattacgaataatatcatatgtgaagcacaaagaaacttccaaattatcaattgcaaagaacaaactttggtcaaccgtagagacaaaactgaatatctttccatttgttgaactgaaaatgatattacaaaatcattgtcctaagaagagcctatcaaagagtaaacagctggccaggtgcggtgtacacacctgtacacacctgtaatctcagcactttgggagactgaggtgggggaatcatgagatcaagagattgagaccatcctggacaacatggtgaaaccccgtctctactaaaagtacaacaattagctgggcatgattgcacatgcattatattgagagtgtgttgcaagttgtttaaatagcaccctttcacaggcagtcacacgtatcaccacagaagtatgaccatgaaaacaaaatttagagaggtaatatttacattggctttagcaatgggggtatggctaagtcataagtgaatcacaaagtacacgtcttaatatccagttattagcagattataggacaaaaatgctactggtgaaaatatgtctccctacatgttctataatgcttaacaacctaaaccaaaaagggaaaggtaagctaacagttatttaaaattaaagaggaagaataacagcaattgaaaatcatgacaaactcaagacaacaccaatgatttgatgatc

SEQ ID NO: 10239 - DNA, 1051 bp, Homo sapiens
aaataataaagatcagagcagaaataaatgcatttgaaatgaagaaaacaatacaaaagatcaacaaaatgaaaagctgctttttttttttttttgagactgagtcttgcactgttgcccaggctggagtgtagtggtgcgatctcggcttattgcaacctctgcctcttgggttcaagcaattctcctacctcagcctcccgagtagctaagattacaggcacctgccaccacgcctggctaatttttctttttctttttttttgtacttttagtagacacagggtttcaccatattggtcaggctggttttgaactcctgacctcataatccacccaccttggcctcccaaagtgctgggattacaggcgtgagccactgcgcctggccgaaaagttgcatttttgaaatgataaacaaaagtgacaaacctttagccagactaagaaaaaaagaagttccaaatgaataaaatcagagatgaaaaggaagacattacaactgataccacagaaattcaaacttcgttatagactactatgaacaactgtatgccaataaattggaaaaacctagaagaaatggataaattcctagacacctacaacttaccaagatcgaaccatgaagaaatacaaatcctgactagaccagtaacaaataatgggattaaaggtgtaataaaagtctcccagcaaagtaatgctcagagcccaatggcttcgctgctgaattctaccaaacatttaaagaaaaactaataacagtccaacttaagttattccaaaaaatagaggaggcaggaatacttttccaaactcattctataagacaagtattaccctgataccaaaaccacacaaagacacatcaaaaaaagaaaactaagggccagtatctctggtgaacattgatgcaaaaatcttaacaaaatattggcaaactgaatttaacaacacattaataagatcatttatcatgaccaagtggaattcatcccagggatacaaagatggttcaacttaatcaatgtaatacatcatatcaaca

SEQ ID NO: 10240 - DNA, 1051 bp, Homo sapiens
gtgagttagtgggcgtagaccggtgcgcagggcctcctggagccttgcttttcttcacctgccaaaaaacatttctaaaaatggtggtaatatatgccagataaaattcgccactttaatcaatttaagtgtatatttcagtggcatcgattaccctcacagtgttgttcaacagtcacctcttttttccagaacttgagcggtgattcttcaaagtgtagcctagttttagcatgtgactgtctataacctttggcatgaactctttacgtataatatgaaacagttgtgtcttactgttacatgcactcttcgtgaagaggaaacaacaggtaactggagaggtctgtttccaagaactgggggtcctggcgcacctcttccatctgctttgaaagcaggaatacggctgcgtgaggtggagcgcgtccggagtcccagcacggagaggcttaggtgggaagaccgcttgaccccaggagttccaggctgcagtgagctgagatcgcgccactgcacccctgcctgggccacagagcgagacgctgtttttagaaacaaaaacaacaacaaaaaccgggcgcggctgggcgcggtggctcacgcctataatcccagcactttgggaggccgaggcgggcggatcaccggaggtcgggagttcgagactagcctgaccaacatgagaaacccccgtctctactaaaaatacaaaattagccgggcatggtggcgcatgcctgtcatcccagctactcgggaggatgatgcaggagaatcgcttgaacccgggaggcagaggttgtggtgagcctagatcgcgccattgtactccagcctgggcaacaagagcgaaactccgtctcaaaaacaacaacaacaacaacaacaacaacaacaaaccagtcaaacaaacaaaaaacaaaacatgaaagccacttagtacagttcccaatacgtagaaaatattcactaagtggtagcttacagtggaaacagcaggtttcagcagccagagtgcacggctcttgccaccgcattccagtcccaa

SEQ ID NO: 10241 - DNA, 1081 bp, Homo sapiens
catggtggctcacgcctgtaatcccagcactttgggaggctgaggcgggcacatcacctgaggctgggagttcaagaccagcctgaccaacatggagaaaccctgtctctactaaaaatacaaaattaaccaggcgtggtgctgcatgcctgtaatcccagctactcgggaggctgaggcaggagaatcgcttgaacctgggaggcagaggttgcagtgagcctagatcgtgccattgcactccagtctgggcaacaagagtgaaactccatctcaaacaaaaaaaaaataattagccaggtgtggtggcagacacctttaatcccagctactcaggaggctgaggcaggataatcatttgaacctgcgagacagagggtgcagtgagccaagattgcaccactgtgctccagcctgggcgacagagcaagactccatctcaagaaaaacccaaaaaacaacaacaaaaacaaccagtttggaaggttgtaacacaaacatcagagacaaggattaccgtggaaggaagagtagacagggaaggaaaggaaacaggcatggaggcatggaggatggcagtcaaaaggcactttagtctttgaattttttacatagagaacatatcacgtattgtgtaattaaaaatgaattattttttaaagaatcatcaggcatggaactatcaaaagatggcttcaaaaaacaagttactatttattgacatttgaaggggagatgacaatcatgcatgttgaagaagaggtataaccgggagatccagctagtccactgccaagagtcagaggacagcatggatttggtgaaattaccacagccagaggctaagtctcaaatctggcaattttaggcactaaagtttctcaatattcctaaagggaataaaattctctgtgacagaagaatactagttaaatatcacataacacccatgtagaagctggaaggtctatttattcatttagagtggaagctagctttctagtaactggaatatttgtcttccctctccagagaacccattttaatgagcacgtaagcaaagcaaaaggagtgttatcat

SEQ ID NO: 10242 - DNA, 1034 bp, Homo sapiens
aaggtggccttgaactcctggcctcaagcagttctatctcagcctcccaagtagctgggactacaggcatgtgccactgtgctttttttttttttttttttttttttttgagactcgctctgtcgcccaggctagagtgcagtagtgcgatctcggctcactgcaacctccacctcctgagttcaggtgaatctcctgcctcagcctcctgagtagctgggattacaggcacccatcatcacacccagctaatttttgtatttttagtagagttggccaggctggtctcaaactcctgacttgaggtgatccacgcacctcggcctcccaaagtgctgggattacaggcatgagccaccgcacccagcctacctggctactttttaatgttctttcaagtaatggatgaaataattccttaacacagagatcctcaacctttttagcaccagggaccggtttcctggaagacagtttttccatggactgggggcatggttttgggatggaactgttccaccttggatcatcaggcattagttagattctcataaggagtgtgtaacctagattgctcacatgctgagttcacagtaaggttcacgttcctatgagaatctaatgccaccgctgatctgacaggagacggagctttgtaagcttgattgccactcacctcctgctgtgcggcctggttactaacaggccacggactatactggtctgcagcctggggtttggggacctttgccttagcctactgttacaatagtagttggagcacgctaacaaataaatcatgttaatatatgttagtctccagacatactgggggaattttttcatataaaaactacctgtaggcctgcccaactagtgaccttgtttgttaacttcttaacttctttacattagtgacctttttaactttaaaatttaaaaacggattttttgagatggagtctcgctctgtcgcccaagctggagtgcagtggtgcgatctcagctcactgcaagctccgcctcctaggttc

SEQ ID NO: 10243 - DNA, 1035 bp, Homo sapiens
cttagcttcatgtttgcaagacgggaccattttaaagggaacaaccattattttgtgttgtatggcagaattcaggcctagtattgcaaggtctttggagtttttctaagagcagctagaactatggattttacttaatttcgactttttaaaaaaactactgtgaggccaaataaaataagtcagagactgcatttagccatttagtcacatttgtgaactctttttttttttttttttaagatggagtttcactcttgttgcccaggctggagtgcagtggcacgatctcggctcactgcaacctccgcctcccaggttcaagcgattctcctgcctcagcctcctgagtagctgggactacaggcgctcaccaacatgcctgactaatttttctacctttagtggagacagggtttcaccatcttggccaggctagtcttgaatcgctgaccttgtgatccacccacctcagcctcccaaagtgctgggattacaggcgtgagccactgtgcccggccgaactctgctttttaaaatacaaagctggctgccttgttgggtagacttggcaaaaggctgcacctgttcagtctgcaggtataaatagagtgactgtctacaagctggtcaccaagcagcacttaaattacctggcaactgcgactacaggtgcacgccaccatgcctggctaatttttatatttttagtagaggtgaggtttcaccatcttggccaggatggtctcaatctcttgacctcgtgatccgcctgtctcggcctcccaaagtgttgggattacaggcgtgagctaccgtgcccagcctttactttcaattctaactctgataatggaatttcctttgaagggatacatacttaacctttcatggcctgaacttttaataaaaattagaccgcatacaataaaagaagccttctaatatagtaaaactggaaggttctttaaacctcaaaaaatactagttaatttctaaacaagttttaacgttattataaagtatttaatgttt

SEQ ID NO: 10244 - DNA, 1059 bp, Homo sapiens
taatagatacttagaatttatctgcaggatttcagatgggttcactattacatacctgattatcatgcacatcctgttttaaaagtatagaatggatgaatccatatctgggactcatcttttgtgaccaataactgaattctaagcattgtctctcatggggatcctcacagaattgttgccatccctttatgaaggagctggaacatattttcactaacatctcactctgctcatgtttacataagtaaaatcagtatctaggggaacttcataatttcaaatgaaaaaaatggattattttggagattacatgaatcactagtacatgtaaagcacttagaacaacagtgcctagaatatagctcaatagatgatagtttttactaatagtagtaatccttttcataacagaaagcagcagctacaaatttatcaactcactgtttagaatacatctgattagcttgaagtttaaaaatccactgagcaattagacatcatgaaatctatacttatttctcaggacctcaggctttcactgcaaatctctactcttgctctacaaacaggtctgatgtacttgaatatctagtttctaggcacacaatgggtttgacaaggagaaaaaggtagttctatcagtagcagcagtaaatagctgacagaattatgaaaaaaggtaaacatatattcccacaaaatatagcagtctaagcctctaaacagtacaaatgaggacagtgtagcagtttatgttcataaaattatgaccctgcatcagcccaaattatgattgtaaatccaagtctgactaagcagatttttttttttttttttttttttgagacggaattttcctcttgttgcccaggctggagtgcagtggcgtgatcttggctcaccacaacctccgcctcccgggttcaagcaattctcctgcgtcagcctcctgagcagctgggattacaggcatgcaccaccacatcctgctaattttgtatttttagtagagacagggtttctccatgttggtcagactggtcttgaactcctgac

SEQ ID NO: 10245 - DNA, 1031 bp, Homo sapiens
tttaaggtgagtagttcattttctcccttgtcgctgatcatgaaaatcatatgaaatgattactttctactttttaaaattctttcttgagacagggtcttactctgtcacccaggctagagtgcagtggcatgatcctagctcactacagccttgaactcaagcaatccacctgcctcaccctcccaaatagctgggactataggcacatgcttaccacacccagcttattttaaaattttacgtagagacaaggtctcacatgttgcccaggctggtctctaactcctggcctcaaatgattctccctcctcggcatccgaaagtactgggattacagctgtgagccactgtatctggcctatttctttttccttctttaaaaaaatttttcttcttttaaacctcagattgttcctgacaatttatttgctactccattattctgagaaatatattgtcctttgccagcctaagtatttcaactatatgttagataataactgaaggtcatgttcatatcatacagagctagaaccagtaattgtagtagtcctttataagctgttgttaaattgttgtccctgtctccccactacaacttcctcctaccttatagcattgttttcttgaatactggctatcctccagtctttgagatgctctcgctagcctccttttattttactaaagcatatagtaatagcatggtaagatttatatgttttgacttgactctgctaccactgtcagtcatccagttaagttataagatcctttgttattccctgcaatgataaatatttcagaattccttctcttttcttctgatacagattttagttctgaacctagttctgtaatcattggcttttctccagttacaagttttaattcctttacccctgttctatttcatttcagaaaccagccttttaaagttccagttagcttccaagttactgctattgtgaaaactgtataacattgcttcttatactgaccatgaattgtgatactggacctgtgct

SEQ ID NO: 10246 - DNA, 1092 bp, Homo sapiens
aagtaaacttgaatttatttatatgcataaaggtgtccaagctgaacttttatatactttgtggtcttacatgaggatttactttctaaaaataatctacttaaaacatgtttttcagccgcctgtcttggttagatggctctggattaggattctcactggaataccccaccattagtttacatgcattatccagggaccgaagtgactgtctaggagagcatttgtatgttatggtgaatgccaaatttgaaggtatgtatggtgtaatttaatctaatgcctcctttgatagcaaattatattttaaaaaagagtctttgaggccgggcacggtggctcacgcctgtaatcccagcactctgggaggccgaggcgggcggatcacaaggtcaggagatcgagaccatcctggctaatacggtgaaaacccgtctctactaaaaaatacaaaaaattagccaggcgtggtggtgggcgcctgtagtcccagctactcaggagactgaggcaggagaatggtgtgaacctgggaggtggagcttgtagtgagccgagatcatgccactgcactccagcctgggcgacaaagtgagactccgtctaaaaaaaaaaaaagaaaaaaaagagtctttgataataatcaatgtaacattgaggccattgactcattttgggtagtagtttattaagcaaaatttcagcacagcaacttggacacttgaagttttcacaatggatgttcatgtgtgtctgtatatatttctctatatttacacttagaattcttcatttattatggatatgtatttctagcttttcctctaaagtttcactgtttattctgcctttctctttttaaaaggcacccttaggggcttggatcagtataccctgtgcttctcataatttaagatagaactgttttgttttgtttcagtagtgggtctcagtggttgtaggggggatatattttccatgggcctccaccaacctcaccattcccccacatttggcagtgacattttggttgaaagaggaagggtattattggtgtctagcagttagatgccaaggatgctattattatac

SEQ ID NO: 10247 - DNA, 1045 bp, Homo sapiens
tgcagagggaccagactcccgttttggggtcctggaaggaattgcccttttatttggccacgtggagcactttggtattttgacagtcagatagatctaccgtaaatattgtggttgtagaacagaggtccctgtttccttgacatgcagttttctttattttgaagcctgtaatgacacatcgaatctttcctgcccttcagatatgtgttgcttccccttttgctccatcacttgtctacagccagagaaaattctctacttttaagagctcatgtgattactttggaaccacctgtaaaatccaggataatctccctatgttactgtcgactggtaaccttaattacgtttgtgaagtcccttttgctgtgtaatataacatattcacccgcatgacaccagaaagtgaaggtcgtggggccaaaattctgcctactacagaatccagagcacaaaaactgtaaagaacctctgctttaaagggaaatttagacattgaacaaggtttaggcttcaggccagaaactgagataggacatatggatgggaggaaaagcaagattgaggtgagaggcagataatgagtttggtcaggacatgtgtggagtagttgtacatatgaccgtgttgggccgggcgcggtggctcacacctgtaatcccagcactttgggaggctgaggcaggcagatcgcttgagcccaggagtttgagatcagcctgggcagcatggcgaaacccagtctctacaaaaaatacaaaaattagccaggcatggtggcggcctgtagtcctagctactcaggaaactgaggtgggaggatcacctgagcccaggaggtcgaggctgcggtgagccgtgattgtgcccctgcactccagcctgcatgacagagtgagaccctgtctcaaaaaaaaaataaaaataaaaaaagaatgtgtatcttgggaaagtggtattaaagagagatgtttggaggtcgttaaagtgttagtgtatactcatggaaatggattagatatctcagaagagaagaggacca

SEQ ID NO: 10248 - DNA, 1023 bp, Homo sapiens
tatttcctaatagctataactgtgccccctaccagtagtacaagacaagctctaaaatatgaatttcttacatccatttagtcttttttgttttacttaaattatatatatatagtgtatatatatatacacacatatatacatataaatatatatatatatatatatatatatatatatatatatatttttttttttttttttttttttttttttttttggtgacagagtcttactctgtcacccaggctggagtgcagtggtgtgatcttggctcactgcaacctccgcctcccaagttcaaacgattctcctggctcagcctcccaatagctaggattttaggcatgtgccaccaagcctggctaatttttgtatttttagtagagatggggtttcaccatgttggccaagctagtctcgaactcctgacctcaggttatccgcccaccttggcctcccaaagtgctgggattacaggcgtgagccaccgcgcccggctttatggcctgttttgaagattgttttgctttcatagattaaacatgaatttaagtttgagcccaagacaaaagagaaagggaaaaaaaatgtttggatgtgggatgctaaagaagggaagtgaacatctttttcgaatgtgtacttaccttcatgtgtcacagaaacaaacataaattgcattagttaagccattaaatatgaatatttattaagctaggccctattccaagcactggaatataacagcaaacaaaatagctcttatgaaactcttattttagttgggaagaaggtgacaataaacaagatagataagtagaatatatgatatattagaaatgagtgctttggaaaaaaataaaggagaaaagggggttgggaaagtagttgaatttcagataatatactaaggaaatcctcactaagaaaacatttgagtgaagacctgaaagaaatgttgtgtgtgagtcatgcacttatctaaaagaagaatgatacaggcagatggaacaataaata

SEQ ID NO: 10249 - DNA, 1041 bp, Homo sapiens
tggataattctaactctgtcatttctgttatatttatttattgttgttctgtaaggaagaacatttcccttctcctccatatgtttgtttatttatgacagtgtaaactcgtggattcttattctgatcagtggatatactacattcccatcactatttaggctccatttgtcccaaatttggccaatgagaaccacttcaacctattggctagctattttgaaatgtttgaaatccacaaaagaataacaagcttgaatgtcgtacttcggtggaatttaacattctgaaaaacagctgtgacataatgccacagcctcactctggcttattgatcagagatgacaggaacaatgctatttagcagtgctttgcaagtttaactaggtctgtgtgctttatttagcagatttgtattctttatggagaagagtcaaaaatatatcttgagttctgtatttatgtggaacagattcatgagttttctttggttagagggcataacctctgcaatacattatgactatagtgacaggtagaacagcatattatcaggaggcggatttgtggtagccgtctaccaagaagagcagtcatggcagctgtgtacctgaccaggtagctgtaggtcgactgcagtaaggactatttctaaaaaagtataaaacatttaggctgggtgtggtggctcacacctgtaatcccagcactttgggaggccgaggcaggcggatcacttgaggccaggaattcaagaccagcctggccaacatggcgaaaccccatctctactaaaaatacaaaaattagccagatgtggtggcgggtacctgtagtcccagctactcggaaggctgaggcaggggaattgcttgaacccgggaagtggagtttgcagtgagccaagatcatgccactgcactccagcctgggcgacatagtgagactctgtctcaaaaacaaacaaactaaaaaggataaaacattttctaatcttgaggattcaccgctaagagtatatattgtgaggtttggcattaa

SEQ ID NO: 10250 - DNA, 1051 bp, Homo sapiens
ttgcaatttgtaaaaatgtgtataagtaatttcattccggcttaattaaatcacaagcttaaaaggcctgtcaagttatttccttgagtagcaacccctttcttctaaatctttcattcatgcagcatacctgttgaacatcttctgttgcaaattaaattatttatcaatggaaaaacttcatcatgactgttttaaaacaagtactggttataatctcacaaaagcgtcagaattttaatacagaaggatttcatcctttaatcaccagcattctttttaatctgtatactcagtgttgccatgtttattcacttttggaggggatcatctcaaactttttcagacctttcacatgtgctacctaaatggagattacaaaactgtttatcccaaggaactttgttctgcataaggaataacctctatgcttattatcatattttttaaggagccagacttttctgaagatcaagaagaaaagaaaaaagattcaaaaaaatccaaagcaaacttgcttgaaaggaggtcaacaagaacaaggaaatgtataagctacaggtatgaagtgtatggaaatgtctacagcaaaagaggatttattttgcaagtacacagcatgatccagaagtatatgctttttctatcatgctgattattgcagttgtatatatatttcttgccttccatctttagtcatagaattttttttttcctttttcttttttttttgagactgagtctcgctcttgttggccaggctggtctcgaatgcctgacctctggtgatttgccctcctcagcctcccaaagtgctgggattacagccatgagccaccgcgcccggcctagtcatataattttagagcagagtgatcctttccaaatgtaaatctgttcatgtcatcctcttttgctttaacatactttatcagatttccatagctcttgggttaaggattgttttgttttgttttttccaagatggagtcttgctctgtctccaggctggagtgcagtggcaccatctcggctcactgcaacctccacc

SEQ ID NO: 10251 - DNA, 1035 bp, Homo sapiens
ccattgagaacaccaaaacaaaaagtaaaaagcagaaacctaaatttttctaaattttttttaatatctagaagttgtatctcaaagtttttgtaattttcttcattgtcagattttattttttactgtcaaatatccaatgacagaggccacctcttttaaaatagaaactttaaatggaaatatacattatactaagtcttatattttatagccttgaaagtttctattcatgtaattaagctttttctgatttttagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttga

SEQ ID NO: 10252 - DNA, 1051 bp, Homo sapiens
ttaggcagctagaagttgcagggccaggttctgaaaagaagagggctatgcagaagacagaatttcagaaatctgtacatgggctaccttgagtctttgctgaagactaggtcgtatatgcaaacagtgaaaatccacaacgctaggcactgaacatccaggttattactagccaaacatttcctagaacttacactggagatgtttgaactctgaccagagtgaaatattctttgtagcactcagggcattcaatggagaacccaattgattcattgtagtaaacctgacagaaaaggccttaaaaagataagatgaatctgcaaataaatacctgccaaaacaaagcccaactgatttttacagcacattgcaaaatcttaacagcacatcttagcagcgcttagcagcatggtaacattgatattttccaacatccaagcttaatttactcaatatggctcaaattactagctgtgctgagaaactggtctaactcttaaccaggagaaaaatgaacccaaagaagcagattcagaaatgatggagatactagatctagcagacaaggacagtaaaataagtattataattagtaaaagtatttaaagaaaaatatgaacataatgaaagaaatgaaagataagaaaaataaacatatagaacttctagagattaaaaaaataatagtatcttaaataaattactgaaaggcatttcacagaagattggatgctgcagaacaaactagtgaacttgaagacatgtcagtagactttatcctaaaatgaagcagtgagaaagagaactgaaaataatcaagtgcttcactggtctgtggaatagtatcaagcagcctccataaagtgtatttgagatcctagaaggaggatggagccaagaatattggaagaataatgaatgcaaaatttcaaatttgatgaaaattataaacccacaaacccaataatctcaacaaacctaaagtacgacaaacacagacaaacatttacagacatttgtatgtttgtcctttgccagaaagcagtga

SEQ ID NO: 10253 - DNA, 1036 bp, Homo sapiens
tcaaaggccttttctgcatctattgagataatcatgtaatttttgtcattggttctgtttatgtgatgaattacgtttattgacttgtgtatgttgaaccagccttgcatcccagggatgaagttgacttgatcatggtagataagctttttgatgtgctgctggatttggtttgccaatattgtattgaggattttcacattgatgttcatcagggatattggcctgaaattttctttttttgttgtgtctctgccaggttttgctatcagggtggtgctggcctcataaaatgcgttagggaggattccctcttttcctattttttggaatactaataaaaaagaaaagagagaagaatcaaatagacacaagaagaaacgatataggggatatcactgctgatcccacagaaatacaaactaccatcagagaatgctataaacgcctctacgcaaataaactagaaattctagaagaaatggataaattcctggacacatacacctctaaaccaggaaaagtcgaatccctgaggaaaccaataacaagttctgaaattgaggcagtgattaatagcctgctaaccaaaaaaagtccaggaccagatggattcacagccgaattctaccagagctcttcttagctttaatatatttgcctaggtcagtgtcctgaagagttttccctatgttttctacaaataatgtttaagttgttaattcatcttaatttgatttttgtgtttgatgagaaatagaggtccagttttattcttctgcatatgcttttccagttatttcagcaccacttatttgagagggtgtcctttccccagtgtaggttcttgacagctttgtctaagatcagttggctggtaaatatatttatttctgagttctctattctgtttcattggtctgtgtgtctgattttataccaatactgaaatgttttggttactgtagcttgtaatatatttttaagttgggtagtgtgatgcccccagctttgttgacagctgtctctctgtttg

SEQ ID NO: 10254 - DNA, 1024 bp, Homo sapiens
ttgactgtggtcaactggtttctccttgctatctttttgcctcatggccttttcattttataccctatcttctattattacctagttgtattcaccatgataactatatctcactcctttagtgtcctattttcctgtattttggacttcccctttaaaccttaattatcttctccattcttatctttcgtagaaaaatagattacaaaaatgcaaaaataaggggctttgtagtatgcatgctttaccataattttataggttaaatgcctgtagtagtactgttgtaattatcagagcttactgttgagccagactccatgataaagtcatctaccaagattatcttatttaatccttagagccactctatttatagtgtcattattttcattttatagataaggaaactatttagaaaggtaaagtaacttgcctgaagtcacacagtgttaaagggttggagaaaattttgataaaaagatacttgtaatgctgtgggaatttaaaactgggtaagtctggcttcagagcccaactcttaaccagtgttttgtccccacaggtatgctcttaaaatgattgtagtgtgatccacagtactatggttgtggtctgaactctaagcaatgatctgaacacttaggcttctgagtcagataacgtagcatatttccccactcacctctttttactttaaaagttttaattttattagcatgaacattatttttaaaaggtataatatttgaggccgggcgcggtggctcacgcctgtaatcccagcactttgggaggccgaggtgggcggatcacgaggtcaggagatcgagaccatcccggttaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgaga

SEQ ID NO: 10255 - DNA, 1067 bp, Homo sapiens
cccaggctggagtgcagtggcgcgatcctggttcactacaacctctgcctcctgggttcaagtgattctcctgcctcacgctcccaagtaactgggattacaggcatgcaccaccatgcctggctcatttttatgtgtttagtagggacaggttttgccatgttggtcaggctggtcttgaactcctggcttcaggtgatccagccacctccacctctcaaagtgctgggattgcaggcatgagccactgtgcccagccacttcttatttttatcctgagtttagggatgtgttaaattgtattaattctccattatctctgtgtgtgtgtgtgtgtgtgtgtgtgtgtgtgtgtgtccttttacaaattataaatggccgctctttgaggaagtcgcggtggtaggtgctgcggctctgtgatccgcaggctcctgctccttactcactactgttcgctctcgccgaggaacaagtcggtcaggaagccgtgcagcagctatggctttgaaggttaccggaaaaacacgcgtggagctggaggtggcagttcaccgaaattgaatcactctaacgagccgcaacataaaatccctggaaaaggtgtgtgctgacttcatcagaggagcagaggcaaagaatctccaagtgaaaggaccagttcgaatacctaccaagactttgagaatcactacagaaaaagtccttgtggtgaaggttctaagacgtgggatcctttccagatgagaatccacaagcgactcattgacttgcacagtccttctgagattgttaagcagattgcttccatcagtttgagccgggagttgaggtgaaagtcaccattgcagatgcttaagtcaactattttaataaattgattaccagttgttaaaaaaaaattataaatggcagacttgatcccattcatcattagactactttcatgttttgctcagaattaagtaagttttaatattcatttaaaaatacttatcaaataaatttggtttctctcaaagtaagttgtgtaagatattctgattttagcaaattatttcataatt

SEQ ID NO: 10256 - DNA, 1027 bp, Homo sapiens
tatagttaatggtagaatatgatttccaacccaagtctgagtccaaagccacaaaattatataccttgccatagtatcatggtttccaaactgcaccaaggcaccctagagcattgttgccaactccatctgatagtttaaattttcaagtaggatacagtggtagccgaaatttgctggttgccaggtgagctactgccttgacatacttcatggtttcaaggttgtgccacatttctatagatgatatgtctttgtgaagctggttttttagcggttgctgtggtaaaattcacaaaaaagtcagtatgcagcaggaaagaggatagcagggtccactctgattccaaggtttgaaaagttgtgcagtgcccaacagtaatacacatttcacaagtaattatggttaagaatgaagtaaaaacattatttgttgaaatttagctaggttattttttcacatggctactgactacttaataagtggaagtgttattatttctggcctagggctgctgtgagaaaattactgagatactgagggtgccgtgaagctagaatgtttgagaacctttgctctagaaactatcattgaatttcggggcaagaaagaagggactattgtgtcattgcctttatttttcaggaggaaaatcaagctacagagagagatttcaagtgtatacagctaactgttggtgttagtcaaattcttatttgaaaagcccacatatatgctgaaattgtcaacaaaaaatttagatttatagttgatactagttataaaaggatgtgccaaatgaaggtggtgttttatcctcctctccctgcagtctactttagtcctcccaattctgtgctttgtgtggacttccccaggtttctcctaactggaggtagatgatggtggttatggataaagttgacgttgactttgtgagatccctgacacccaaggctcctaagtatctttcctctcctgcagagaatatttcttttcaagaggaaactatactactgtattctt

SEQ ID NO: 10257 - DNA, 1025 bp, Homo sapiens
gagactatatgcctggctaattatttttattttttgtagagacaggtctcactatgttgcccaggctagtctcaaacacctgggatcaagtgattctcctgccttgccctcccaaagtgctgggattataggcttgagccttatccagctcttaccaggatttggcttcttgaaagtgctatgccaactggggctgtggttgtggtctgccacttgggatggaatgggagagtgtggcaggaaagcagatataggtacctattttgattccaccctaagtgggagattcatctggagcctggtatcagagaacagtgttagtttcatgacagttacactcatggctgctgcatgaccctcatgttgtcatgtgagtgtgtgcttatcacatggctggtacttgatgatgaggctgcacttagatctcatgctgaaatctgaggtgcactggattgctctggccttgggctgactgcaaacctttcccttcctggaggacagcaatccagtctctactctgacccatagagagaagcttggatgtaaccaggaagaggtctggggaggcactgagaagtcctggagtctctgcccttgttaatttagatccatctagccttcattcctaccctctgaacttcttagccttgggatcatcttcaacttacactttttgctctggttgcaccaaattaaggagacatcccaagctcactccattcctggcctttgcacttgcccttacatttttctgaaattctctccctcttctttatagaagcttgtggttaatagaatgagtaactgcttcagtttatgaactgggctcaaattcttacccaggtgtgcatctggggagtctctgagaacctatctgattcttgggatttttgccaagattgtgacagtctttctttcataatgtagcaggataagaactcttggggttaactgtttggcatagaatggatattctattccaaagccttcctgcgctcctcctcagtacttcttgcaggcttggt

SEQ ID NO: 10258 - DNA, 1101 bp, Homo sapiens
atattctgtagtcagtaattctttatgaagaattatacaacaacatgacaaaatatttagggtgtaatgttatgtacccaaaagaaggggagccaatcataatcccaaaagatagtccagaacatcatagtcctaaactgtttaaattccaaaagactaaaatccctaaggtctaaaatcccaaaaaccacagcccagaaaatatcaaaatccccaaaatataattatggaagaaataatttaaaaaatttaaagatatttattttttaaaggggaatttatttgagaaacataaaaacacaacagaatactttatacatcacttaatataataaaacagacaataacaacatacatttttgcaagcataaacactcaggttactaatgacagttgggtgggtctaacagttatgagcagatgagccatatttataaagaaattggtcataaagggaaaggtataaatgcatatcactttggttgttaattgtgtatacccagctttttaactgtggtcatctgaaatactgtgcccaacaacctcaagtcttttgacgagattgatggaaactgtgctgggtcaccactgcatatgcagtcacccaaagagctgagatctcaagaaattttatctttcacaaatgcagatgtacgaaaaggatatctcatttatcgaggaagtttcaacattttgtgtacacactcaatgcttatacacaaagtcagtattgtgatgatgcactttcatggagtcagatttctgatatccaagcagcagaacccagagagtccgttttgctatattgccttttttttttttttgagacagagtctcagcttatcatccaggctgaatacagtggcgtgatctcggctcactgctgcaacctctgcctcttgggttcaagcaattctcctgtctcagtctcccaagtagctgggattacaggtgtgcaccaccacgcctggctaatttttgtatttttagtagagacagggttttgccatgttggtcaggctggtctccatctcctgacctcaggtcatccacccacctcggccttccaaagtgctaggattacaggcatgagccaccact

SEQ ID NO: 10259 - DNA, 1032 bp, Homo sapiens
gtgctgggattacaggtgtgagccactgcacccggcctgtagaggttcttaatagggtaaaaattgcaactgtttgtcaatggcagatctgtcacaagctttttcagactacagtaatgaaggctatctgtgattcataactacaaccgctgtttctattgccaaatgccattttggtttatgactatcatacaatgtgcctaaaagttttttttttttgtaattgagatataatttatatacaaatatttactcttgatggaaaagatacaaagtatgttttctgaccacagtgggatgaaattataaattagttaacaggaagaaatttagtaaacccacaaatgtggaaattaaacaacatacttctatgtaactaatgagtcaacgaagaaatcaaaagggaaattagaaaatactttgagatgaataaaatagaaaatgatgcagctaaagcagtgcttatagaagtttatagttttaagtgcccatcataaaaaaaaaacaagaataaggatctaaaatcagtaacctaaccttccaacttaagatgctggaaaaagaagcacccattaaacttaaagcatgtgaaggaagggaatactaaagattagaatagaaattaattaaacagaatagaaaaacaacagataatcaacaaaaccaaatttacttctctgaaaagatcaacaaaattgacaaacctttagttatattgaccaagaaagagagagaagactcaaattactagactcagaaatgagaagaccagaagatggacatattaggaaaaaaaaggaaaagtgaggatactgtcgagggcggtggcttatgtctgtaatcccacagttggagaggtcaaggcaggaggatcacttgagcccaggagttcaagaccagcctgggtcacataggaagaccccatatctacataaaacaaaaaaattagccgggtctggtggcttgtacctgtagtccagctacctgggaggctgagatgggaggatcgctgtgcctgggaggttgagactg

SEQ ID NO: 10260 - DNA, 1052 bp, Homo sapiens
cctggggacgttgttcaaatgtcgattctatttgataagtcaagcagaggaggtgaggcaagattctgcattcctgacatgcccccaaatttacaccagtgcattggttgcattcttagatccttagacttgtagagtggcaaggcttagagcatccagcaggatactgatccttaaacattacatggattcattcatccagcattaaaatatgttaatacaaatacaaaatatgtcaatacataatataaaatttacaattttaacaattttaagtataaagttcagtggcattaagaacattagcactgttgcacaatgtgatttcctctcttcccaacattctgttgttcccatttcccaagactgctcagccctcttccacccatcctcacatgaccagatatgccatgtgttcttgtgtttgcatatctcaaaactcttgcactggttgtctcttctcacagaatacatgccattcttccctttctttttgttctccacccagtggacttaacatttgtgcttcaagacccaaatgaaacctcagcgagagcttagtctcttcttcacctgtttctgtagcattctgtggtactaatctatttgtactttttgttcagtgctgctgtcattaccggtgtacctatcttcccaccagtcggaggtccttgatggcagagctaatgcctggctcatctccgtgtcctggagatggacaatagggcctggctcactaaagtgttattggtggttgaatgacagttgatattgcttgtcctctcccttatataatacttagggaaaaaattcctagcttttgacctaactacagcttcgataagactgaaaactgagtttgagaggactaggatagaaatggctaagaattttaagggaagagctaatttcttcacttaatttttcatcagttgttaacataaagtgattaaatgagatcttagtgcttctgttcttttttctccgctgaaaagatgaggagggagaactgatatgtgcctagcacttacatatacgtataataaagttat

SEQ ID NO: 10261 - DNA, 1030 bp, Homo sapiens
cctctacaaaaaaaaaatttgagccaggcgcagtggcttatgcctgtaatcccaacactttgagaggctgaggcaggtggatcacttgagtccaggagttcaagacgagcctgcgcaacatggtgaaaccctgtctctacaaaaaatacaaaaattaactgagggtggaggtgcatgcctgtagtcccagctacttgggaggctgaagtaggagaattgcttgagcccgggaggtggaggctgcagtgagctgagattgcactactgcactccagcctgggcgacagagcaagacttgtctcaaataataataataataataaaataaaaattagcctggcatggtggcactcgcctgtagtctcagctacccaggaacctgaggtgggaggattgcttgagcccaggaggttgaggcttcagtgagtcatgattttgccactgcattccagcctggatgacagagtgaaaccttgtctcaaaaaaataaataaaaaataaaaggacagaactaacttggacatgatcttaagcaagtcagtctgcctttgtaggcctcagtctcctatctggaaagtgcaggatcttccaagctgaaaaaacacagttcctctgaatggagggttttgaggcatgatgagccaaacaaccagctaaggaaagctatttatttgagggagtggtggggccccttctctggagtccttaagtcatgctaagaggcccagacctttcctgcttactctggaatatctctgctgttcggagaatctgctgcgaactctactgttacaaaggcaccttatgaagggctgaccagagtggaccaggagcaggggcaggtcttcccgtccagccccacccccaacttcccccctgtcacacccctcccccagttctgggaaaacacagcccttcctctagctgatgcaactagccctgggggccagcctaaggccttctaggtttgctgagaggtagagagaggggcgatgtcaacaaagcaccccctcatcagccaatctcaaat

SEQ ID NO: 10262 - DNA, 1051 bp, Homo sapiens
gtctatgcgaatgaacgactgaaaactcagaaaacgaaaactagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtgagtgctgcgcggccgggatcggctgggaggagaaggggtcgtagggctgcagactggcccggccgtaggcccccctgaggtgctctgcttttccgtgcctttttgcctagctggccccatctcgcctttccggggagtccgcgccccattagctctttagaatcaagcagagccagagtgtcatttggcacttgaagaaactgaggtgcagtgaagcaggaactgagtctgtgaaggacccgaaactactctcctcagttcgtgttgtgctgtgtgcgcaaatgagccatgactccatgccatgcactactcacactgtgggcattattgatagcatttcggccttaaaacacttttagggatgta

SEQ ID NO: 10263 - DNA, 1368 bp, Homo sapiens
ggcatgagccaccatgcccagccagtagaattaattttaatgagttaaatatatacatcaaggctaggtgcggtggctcaaacctgtaatcccagcactttgggaggccaaggcaggcagatcacgaggtcaggattttgagaccagcctggccaacatggtgaaaccccgtctctattaaaaatacaaaaattagctgggcgtggtggcaggcacctgtaatcccagctacttgggaggttgaggcaggaaaatcgcttgaacccaggaggtggaggttgcagtgagccgagatcgcaccactgcactccagccttggcaacaaagcgagactccgtctcaaaaaaacaaaaaattatatatatatatatatatatatatttacatataaaatatatttatttacatataaaaatatatatatacacatcaaatgccaattttttctgagttgttgcttttatgttaacttttgttagactgtgcacaaagtgatgaatgattcggtttcatgaagaattgtctaagattggctgtctttcagagatgatgcaaattgtattcacctgaactctgtttctgtaaagtctgtttcaaatgatactgaagtttatctttgcctgttgtttctagccctctattttctgtctttggtttaaaccccaagggcccagaggctttctccgatgtctaactctttgtgccttgagctcctttatgtttgggtggcatgttcatgaaaaagccatacttctagcaattctcccaatgaggtaagcagatagctcagccagtgagcattttggcatatttcacaatgatcctattttctatttgctctgtcccttcttgtcatgttcaccaggataggcaaaaacaaagatgtataggaacagatgtccactaggacaggacagggatgcttaacttgagattcttggacccatgaaggtatgcaaaaatgcatgtactatttctgtttctgcgtttttggaaagaagcactgtagtgattaagtaccatgaaagccggcttttagatctgatcattgagggacagtatgttatagaaaaaacctgggctggccgggcgcggtagctcacgcctgtaatcccagcacttagggaggccaaggcgggcagatcacgaggtcaggagatcgagactatcctggctaacatggtgaaaccccatctctactaaaaatacaaaaaattagctgggcatagtggcacatgcctgtagtcccagctactcgggaggctgaggcaggagaattgcttgaacccgggaggaagaggttgcagtgagccgagatcgcaccactgcattccattctgggtgaccgaaggagactctgtctcaaaa

SEQ ID NO: 10264 - DNA, 1053 bp, Homo sapiens
tcaaactgtctctgactgtcctattagccagagcttgttggggcttgtattgtcattctctgaattgatttatttaataaccaagtatttattgagctcctatgtactggggatagaaatgaactcatcatcattcctgccttcaaggaatacagtatagtagaggaaatgagcacataaacaagtgcagtgccttgtggtgaacactgttagagtgagctcactcagctgtgcacgttggctcaggcctgtaatcctagcactttgggaggctgagatgggcggatcacctgaagtcaggagctcgagaccagcctggccaacatggtgacaccccgtctctactaaaaatacaaaaattagccgggcatggtggcacatgcctgtaatcccagttaatggggaggctgaggcaggagaatcgctggaacctggaacctgggaggcagaggctgcagtgagctgagattgcgccactgcattccagcctctgtctctgggtgacagagtaagactccatctcaaaaaaaaaaagtgagctcacaagaaaatcagttctgcttattgatttaggagctttctcaggtgattgaattagaagttaatttggcaaagggagttgcctgggcagagggacacaggtgttgagagtggtatattgaggactcacagttacttcattgtggccaagccgcatttaacaaagtaaagatgagattgaacaggggggaaggggcgatgagatcatggaagacactggatactatgtttaggaatagagggtttctcccataggagatgaaggattcaaagttccttcatgacatgctcagactgttctagaagcttgctttcagaggtgagagcagattaccatttgtgctgcctgccagcaagtttcctataagctgcacaaattccctgttccaatgcaaagagctgctttatatattataatcttaagaccagaggcattttgggtagaatagtataggattaaattcatgaaatcttagcctttaagcagcaataagatttagtagcttacttttt

SEQ ID NO: 10265 - DNA, 1053 bp, Homo sapiens
agaatttaacagatgttcagatgttttctttcttcctcttcttccctgccctgaaatcaactaattaattttaattcttactaaaactgaaacgcgtcacatcttttgtagtttcccagctctccccttcaccctagtagacatggataagctgcagtctgtgttctgctttgtagcttgtaaattcttctgttattataatagtatggacgggtattcagagtatttttatgtatattgtcccactggacagtggacaaagtgagaccaaaagaaggttctgtgaacttacattgtggtgagcatataaccacttacttactagaacccagaccccataactttctacacactataccatagagagttccctagttctctttttgaatttgaaaaagattgatgactgtttaatcagtttcatttctcttttcaacagaatcagctgcctcaagtcttttcccgactctttcctttcaagaggggcctctgtcatgcatattgggctccaaacttctgggctttgtacaatgctttggacaaagtgctgtctgtcatcggtatggtagcgagcattttttactcagactctgaatattgaaaggacttaggcacatggagaaatggaaaaacctttgtgttttgaatgtggctgaattgtttgttctccagtcctgcatttcagctttcaggatgaacagggggagcagttcttgggactgaggctttagtgcagtaaacagactgttttccttataaaagctccttgtggtaatgaggttattgatcctttcctggggaaaaaataaaatatgtagacactctataaaggtaatttttgccttaattaaaaaactattcagcagcagcagttaaccctgctttttttccccccttctcaccattcctattcaaacccctacttatttttagagacagggtctcactgtcacccaggatggagtgcaatggtgttgagatcatagtgcactgcagccttaaattcctgggctcaaacagtcctcttgtctcagcctcctgagttgctgggac

SEQ ID NO: 10266 - DNA, 1050 bp, Homo sapiens
tcttttcccaccttctctgtcagatgaactcctcatccttatgtcttggtatatgaggcctttttcaggtaatgaattttgttagaattgtttgtgagcaagaggaagtcacttctgagcaaaggcctgagggccgcctgtaagaaaaagtttgggctaggccgggcgtggtggctcacgcctgtaatcccagcactttgggagactgaggcaggtggatcacctgaggtcaggagtttgagaccagcctggccaacatggcgaaaccccacctctactaaaaattagccaggattggtggtacatgcctgtagtctcagctgctcgggaggctgagacaggagactcgcgtgaacccggggggcggcagttgcagtgagctgagatgggtccactacactccagcctgggtgacagaaggagactccgcctcaaaaaaaaaaaaaaagaaaagaaaaagagaaagtctgggcttcttgtcagccctttaggtagttctgagacccttttcactgacttgtagattgctcaacaactttctagaagatctgacctccagataaatgaggttttacaggattatgtaatgtctatttgtgtctctataggacagtgagctgtgacagcttagggaatgtcagtccatttaaaagcataactatgggaattagaaattgataaatattgcaaaatctcattttatttatctaattgttttgagtagccattccacagattttgaagtacaccgaaactggcttgctatcactcacagtttgccaatatcacagtggtattatgaggtaagttttaattttcacctttttttttttaagattcatctataaactaggtaaatattactgatattaaaaatgttttctggctgggtgcggtggctcacgcttgtaatcccagcactttgggaggccaaggcgggcagatcatgaggtcaggggttggagaccagcctggccaacacagtgaaaccctgtctctactaaaaatacaaaaattagctgggtgtggtggtgggcacctgtaatccca

SEQ ID NO: 10267 - DNA, 1106 bp, Homo sapiens
agcctcgctcagagttctaaaaacacaatgtttctcacctctgtatctttgcacatgccattctctagctggatttaatactccggtgcaagcgtccaggttgggagcccccgcagttctctgaggtacttttatctactgtaactctagggcaacaatcctggcttctccactagtgcgtgaacgtctctagcgttaagtttttttctcacctaagtatccccaatactacacagtgatgacccagcgcaaacgaccactctttcaacgcaagcatgaactagctgataaaacttaaaagtggctacaaacgcctgcgcaggagcccttccggcccggggtgagacgcgggtctaaagaaaaggtgggcgggaggtttaaatagctgactgcagtccccggactggctgcgccgctcgccgcatgcgcgcagctagcgggcacggcttcagagggctttctccgcatgcgcgggatcccggatgtggatcaagttggtgggaagcgtgcggtgccgcagcaatggcggcgctcacaattgccacgggtactggcaattggttttcggctttggcgctcggggtgactcttctcaaatgccttctcatccccacatagtaagggactcgcacggccaggggctgggcggggaggccccgcggtcggtcagggcgggagagaaaggtgtggatatccctgggtatgaagagaaaactttaggtcgtgtttgtcgctatcctgcctttgctaagctttctgtttcgccagttgttacttgacttagccccagctggctaggttcagacctggcgctgtctgatttggaacaaatcactttaacgtttctgaacctcagggtcctcatccttaataggcagttaagaacctctgcctccaacagccattcagccagtattatcagatgcctgaggtgccaggtaccgttctaactcccgggagatgcggtggtgagcaagacattgctggtccttgccctcgaagttggtgggtggagctagacaaacaggaacttttcagattgtgataaaggaaatagagggttactaagtggctgtgcgctattcctttagaaggtgatgtttgag

SEQ ID NO: 10268 - DNA, 1046 bp, Homo sapiens
tgttgtaaaaactgacatgccttgaaaagaacataaaaagcattatgaaggttccgaggaaatagaggtccacttcagatgaatggatcagggaagttgtcactgaggccagacacttagagttgtttgtacttggttctgaattgtttggctttttaaaaacacatggggccccatgccgtggctcacgcctgtaatcccagcactttgggaggctgaggtgggtggatcaattaaggttaggagttcaataccagcctgaccaacatggtgaaaccccgtctctactaaaaatacaaaattagctgggcatagtggcacacgcctgtaatcccatttactgaagagaggcggaggcgggagaatcgcctgaacctgggaggtggaagttgcagtgaacgagatgatgccactgcacaccagcctgggtactctaaaaatatatataaataaataaaacctggaagtggagagaaggtgttgtggtggaagagggatgtgtgaatttgggactagactagacagccttgctgactctgtcataaatatatcagtattttgtaggcagccatttatcagcctacaccacttacttggaagcaaaacctgacaggctctgatattatctgtagcaaacatggttttcttgttcatgagggtgtctgtgttttttgtgcttgcacctgcataccagagatttggggacagctctttccacagagacaagactaacggggacacatcaactgaaatgccagctgaactagaaacagatctttttaaaatgcaccttggtgcccacacactatgtgtctatgtgtgaacctgcagcacacagaagtacatgcataattctgaaagcagtgaccgggttaagattttaaattactataaataaatagtacttatttttatttttctcagctccatcctatctggctatacctcaattttcatttcagtctaaggcttattgggcaccagttatgtctcctttgacctgctagataatagaaggatttcatgcaagaaaatgattcattaat

SEQ ID NO: 10269 - DNA, 1035 bp, Homo sapiens
ggtcaactgtgtgagaaaaccctttcctaaaaagaagctttaccttatctatttccctgttattttgaatttacacttactaaggaggaaaccaaggcaagaaagacagccaaggacattttaattgactcaagagatacttacttttaaccaagtcttttatgttctggaaagtgccttgagatcttttaataatcttgccaaatcagcatttcaatttggtactcaggatgagtgattagaagtcatgacaaatcagctagcttctctgtggagaatagctgaagcctctggagaaccacagtcttaaattagtctgaagaagcgtgaggtcacaacaggaagtaatgtgaacaggaggagttactgatcagatggttcagagagctggatgatcttaataacttgattccaattttccttgtatgtaacgaacacttattgattgcttctcttaaattcatctcctttctccttccttgcaacaccttaatttgtgttcagacatctgtgtgattctggggaagctggctccatctatcctaagcttcaggtttggctagttagcacattgcattccctcagccaccatgattattttggattgggcatgtgatctaagcaggtatagtctgagtgtattctagttggtatggtaagtggatataaggcctctattctgccatatgatttggttaaatataagaagtgtctatggggcacagtggctcgtggttataatcccaactacttgggagatggaggcaggaggattgcttgaggccaggagttcaagacaagcctgagcattaagactcctgtttcaaagaaacaaaacaaaagaacaaaaagaaaaaagtgactatgaatcctgtactctgatcctaggcttacaaagaagttcacaccatcacagatatgcagtcagggtgaagggagaaagagagaaccaatgccttcacatcagggttgctatgagaattgaatgggatcttgactgtaaagcaccttgcagaaaagtctgacataaaatat

SEQ ID NO: 10270 - DNA, 1150 bp, Homo sapiens
catgtacataagtcttataaatatcacgtaagtgaatgtaccacacctgtgtgcacattcccccagttaaacatttgttacttccagttattcactgttgtatacagtgcaggcctgtcatgtcatataggtggcatgtctgagagtttcacccatgttcatgagccataacatttaggtgtcattaactattaccacagttcactgcgaagattttctcgggtagacagcgtgtctttccttagtgtgcattggaagaacatgccaattggagttctgctgacttgcaagagcaggggaaagtgctaagttttacgtatagtatcatgaggattgttgaaatgagtttgttgatcttttcatataatttcctagaggaaaacattgagtataggccagggatgtgtgtgtgtgtgtgtgtgtagctattcacaggcaggaccatagcacactacagcctcaaactcctgagctcaagtgctcctctcacttagcctcctgaatagctgggactataggtgcaccactgtgcctggatttacttttttggataccaacagagactataacttattgaggctaaaacctgttagaggtccacttgaagatactgtcattaacagatagtaagtatctacagtgtacataagtatctacagtgtacatagtattcccctcaaagtttatagtcttggtggggaagcagcttgaatgtagaatgtactgccaggcagtacatactacacaaatgacaaagaccagtgccataggagtccggaagagattggtctagtgtggtcagtgaggttagtgtcataagacctatgtttagattttacttgtgggtaatctgccatttcacctctgtgccctcatttcctcatatgttcttaggactaatttcacttgccaccttgtggcagtctttcctgcaccatccacctcatcagaatgaattatgaagctccttcctctagttcacctgtgtcaccgtcaggccttagtaccactcagtaactgttggtttacgctgtgcttcccctaaaatggtagcttttccaatgcaccatgccctttgttcatgttcttgtagccttggtacctaaagcacagtaagttattggttcattagtgctttatatgcttttaa

SEQ ID NO: 10271 - DNA, 1046 bp, Homo sapiens
gcgccacccggcctggctaattttttgttttattttttgcagaggtgagggctcactatgttgcccaggctcatctcgaactcctgagctcaagtgactttcctgccttggcctcctaaagtgctgggattaaaggcatgagccactgtgcccagccctgaataatattccattgtgtatatgtaccacattttttaaatgcattcatcgattgatggacacttaggttgattctgcatgttggctactataataagcatgggagtgcagatatctcttcaatacattgatttcctttcttttggatatatagccagcagtgggattgctagatcatatggtagttctatttttagttttttgaagaactatcatactgttctctatgggggctgtactaatttacattcctaccaacaatgtgtgagggcttccctttctccacatccttcccagcgtctgttatcacttgtctttttttctgtagatacttagcatattttacaaaaaaaaagaactgaatgccagcatatatgactttgagctccttatatattctagttattaatcccttgtcagatgagtagtttacacatattttctcgcattctgtgagttgtttcttcatgttgttaattgtttcctttgctgtgtcaaagcttttaagcttgatgtgatcccttctgtccgtttttgctttggttgcttgtgcttttgaggtcttgctcaagaaatctttgcccagaccaatgtcctggagcatttcctcaatattttctactaatagttttatagtttcaggtctcatatttaagtccttaatccattttgatttcatttttaaatattgagaaagataggggtctagtttcattcttctgcatatggatatcaagttttcctagaacatttattgaagaaactgcactttttccagtgtatgttcttggcacctttgtcaaaggtgacttctgtcctactttagcatagctagataatttctgtttactatagtccatttgcaaaaaggtagccatttacaaatg

SEQ ID NO: 10272 - DNA, 1065 bp, Homo sapiens
ggaaaatctcttgaacctgggaggcagaggttgcagtgagtgagatcgcaccactacactccagcctggcaacagagtgagactccatctcaaaaaaatttaaaaaaaaaattgaaaaatttaaaaaaagaatcatagttgaaactcataaataagtatgtgtttggtcatctaactaaaagatatggatacttcgtaacaggaagttcaaaagcttgcagctcatttcccagggcaaaggtgatgtgctccagcttgcttaagatgtgctctagagtccggctatttggagagcctggcatgcaacagccaaatgggcagaaaatgggtattgacggttgctcaatttcagagtcacctttgcagtactctaaaagcacactggaattggctggaagagccattagtagacaatcaatatctgagcttttgatagtgaccatggtctatatgattatttgtggtactttatctgtatttttcttgtagcacctaatgctttatggttagctatgataaaatctaatctctgctgtagcactttttatttattcatgaaccttccccactttccctaatcaaagttaattcctcctgtctttattgtccttggctctataagccagtctcagcctcccataaaccacagacctgcctgcccataaaggcaagttgtcatcacccgcaaatgccaactttcttgtttccaacctgcctgcactcttaaccggctcccaataacttgtgaaacacacaatcaagtttttgtcattacttctccaagaaatttgtgtaattgcctgtgtgtttgtattatatctttatgtaccttttatctctaggagaacccaggagaaagaggtagtttttctagtaactagcccagttgttatcagggggagatacaaggtagaagaattctacctggaatttcaatcctaactaaagagtgtgaaaatttgagggaattgttctagtgatctttagagaatgcagtatttttgatataccagaagaaagtacactctgtgtattcaaaatgtgtctttatttgtaattgaagaa

SEQ ID NO: 10273 - DNA, 1026 bp, Homo sapiens
gtggtgccgtttactgaaatgttgtcctctctcaagtggaggaactcataagtgaacctttgtggagttctcaactgatgttttcttctggttcacttgaaatttagagctcactaaggaaggaagcaatgtggtaaaacagtcttgaccatgagggaaagggaatacatgtttgggagcaaggtaagaatttcattcctttgaagccattagtagtatctttgcaaaatgtaagacttttgcctctttcagacagcagcagtagtaaaactggctagccattatagtagccaaagtccattttcagtcattgttgcctgcagcccatctgcatctcttcaccatcacatctggaaagccctctttcctaattgtacctagtttgtttttagggccaaaatactgtgtatttcagcagttacagcaaaaaccacaaacatgtttcctatggtttgtggaacattctttttcttctgatactagtgtgtaaccttgccccattgttggtaacagcctgtgagaaactgaataaggaggcgttcaatttgtggttttcatcaatatttaaaaatactgagataggtgagaagagaggtggcagaggaagggccattaaactttttccctctttcagctttagcgtggacaaggttatgtattgtaagccttgttcctatctagcctatgttttttttttaattcagggtctgagttttattttcagtgcattgattggaatcaaagagtcagaagggagtgtcataaatagaaatcagggtttgttcagcttgaataccaacacaaactatttctagacagcatgccactgcagctgtgtgacttaagcagaatcaaaactcatattaactggaggaagatgtgtcagagagcattctgggcctacaagatgtacccaaagtggaattggttttgttaaggaatagaggaattagggaaagcttaggaaaatgatctgtagtctccattgttacctgtgtaggagagtaaaaggtcggcagagctaaa

SEQ ID NO: 10274 - DNA, 1031 bp, Homo sapiens
ttttgttgcgaattagcgaaactatagcattgtgtctatattctgtaatctcttaatgagttttgctttctttcttttcttttttttaaaagacggaatcttgctctgtcttccaggctggagtgcaatggcacgatcttggctcattgcaccctctgtctcccgggttcaagcaattctcctgcctcagcctcccgagtagctgggactacagacgcatgccaccacacccggctaattttttttttttttttttttgtagtgggtacgggatttcacagtgttgcccaggctggtctcaaactgagctcaggcagtccatccgcctcagcctcctaaagtgtttggattacaggcatgaaagtttgctttcctaaacaaaactgaacaactttaggatgggtattgaatttttttttttttttttttttttttttttaccagcacagcatctcccactcattctatactcctacttctttgtagtttccacccctatcacaccgttgaagtagctcttgttaggatcagtaatgatcttcatgttattaaatccagcagacttttaagtctttattttacttggccggtcagtgctaatcagcactattaatgacttttttattcttataaccctctactcccttgacttctgtgacatcacattatccctgtttttctcctttctcagcatttattctttcttagtctcctgtacagatttatccatttctatctattcatcaggtgttggaattcctcaaggcccagtccttggtggtctttattttcctcatgttatttcatctgtatctattgcttactgtttattctctcagaagtttttatctctaatccagacttcttctctgagctctagactcatatacattcgtccctcagtatcctcagggattggttccaggacaccctacccactagccccctctcagatagcaaaattcgaggatactaatgagtcccttatgtaaaatgacgtagtatgcgtatcacctatgcacatcctcctg

SEQ ID NO: 10275 - DNA, 1038 bp, Homo sapiens
gcagtagcaacccgctcgggtccccttccacactgtggaagttttgttctttcgctctttgcaataaatcttgctcctgctcactctttgggtccacactgcctttatgagctgtaacactcaccgcgaagatctgcagcttcactcctgaagccagcgagcccacgagcccaccgggaggaatgaagaactccagacacgccgcctaaagagctgttaacactcaccgcgaaggtctgcagcttcactcctgagccagccagaccacgaacccaccagaaggaagaaactccaaacacatccgaacatcagaaggaacaaactccggacgcgccgcctttaagaactgtaacactcaccgtgagggtccgcggcttcattgttgaagtcagtgagaccaagaacccaccaattccggacactgcacaatcaggcaaaggaaaagctggcttggcagagcaggaggaggcttagactgctttggtttggactatcaaatagaaatagtgaggggagggctatgaagggatacaggcagtctaggcagattttccctgtctcagctcttgtctgaccgtctcttctctgtctgcctgttttgtctctctcatccctttaccgtttcttgtcctgtggttttttttttttttttttttttttgaccttaactatagttgtcttttttttgagatagaatttcactcttgtcacccaggctggggtgcaatggcgtgatctcagctcactgcaacctctgcctcccaggttcaagtgattttcctgcctcagcctcccaagtagctgggattataggcgtgtgccgccacacccatcagatttttgtatttttagtagagacagggtttcaccatgttggccaggctggtctttaactcctgacctcaggtagtctgccctcctcagcctcccaaagtgcttggattacaggcgtgagccactgcacctggcctgccttttttattcttttggtttttacaaaattagctataacatggccaggtatagtggctcacgttt

SEQ ID NO: 10276 - DNA, 1044 bp, Homo sapiens
aataggtttatcaaaaagtgtccaacatcactaatcaataaaatgcaaattaaaaccgcactgagataaccactcacacctgttagaatggctgttatcaaaaagtagaatgagacacgttggctcatgcctgtagtctcagcactttgggaggctgaggtgggaggatcacttgaacccaggagttcaggaccaccctggccaacttagtgagaccctgtctctacaaaaaataaataaataaattagtcaggtgtggtgacatgtgcctgtagtgccagctactcaggagactaaggtgggaggattgcctaagcccaggaggttgagttttcagtgagctatgatcacagacgctgctgcactccagcctgggagacagagcaagaccttgtctcaaaaaaaaaaaaaaaaaaaaaaaaaaaaaagtcaaatgataacaggtgttggcaaagatgtggcgcttgggaacccttttataactgttagtggcaatgtaaattagtagagctattatggaggatagtatgggaggtttctcaaaaaaccaaaagtatatttaccatatgattcagccatcctacctctgggtacatatgcagaactgaagtcagtatgtcaaagagatatctgcacttacatgttctttgcagcactattcatagtagccaagatatggaatcaacctaagtgtccatcagtaggtgactggataaagtaaatgtgtatatatatacacagtggaatactattcaaaggaaatcttatttgtgacagcatggatcaacctggaagacttaatgctaagtgaaagaagctaggcacagaaagacaaatactgcatgattcactttgatgtgaaatgtaataaagttaacactacagaagtagtgagtagaatggtagttaccagtggccggtgaggggttcttgaagggaatggaaagaaattgtccaaggggtacaaagtttcagttagaccagaggaataagtgttcaggatttattgcataacaaagtgaccataattaattgtaatgtata

SEQ ID NO: 10277 - DNA, 1048 bp, Homo sapiens
aagctctttagtttaattagattccatttgtcaattttggcttttgttgcagttgcttttgatgttttagtcatgaagtctttgcctatgcctgtgtcctgaatggtattgcctacgtttttttctagggtttttatggttttgggttttacatttaagtctttaatccatcttgagttagtttttatataaggtgtaaggaaggggtccagtttctgttttctgcatatgaccagccagttttcccagtaccatttattagatagagaatcctttccccatttcttgtttttgtcaggtttgtcaaaaatcaaatggttgtagatgtgtggtgttatttctgaggtctctgttttgttccatgggtccacatatctgttttggtaacagtaccatgttgttttgattactgtagccttgtagtatagtttgaaatcaggtagtgtgatgtctccagctttgttctttttgcttaggattatcttggctatacaggctctcttttggttccatatgaaatttaatgtagttttttctaattctgaagaaagtcagtggtagcttgatgggaatagcattgaatctataaattactttgggcagcatggccattttcacgatattgattcttcctgtccatgagcatggaatttttttttccatttgtttgtgtcctctcttatttccttgagcagtggtttgtagttctccttgaagaggtccttcacatcccttgtaggttgtactcctaagtattttattctctttgtagcagttgtgaatgggagttgactcatgatttggctctctgcttgtctattactggtgtataggaaagcttgtgatttttgcacattgattttgtatcctgagactttgctgaagttgcttatcagcttaaggagtttttgggctgagacgatgtggttttctaaatatacaatcatgtcatctgtaaacagagacaatttgacttcctctcttcctatttgaataccctttatttatttcttttgcctgattgccctggcgagaacttccaacacta

SEQ ID NO: 10278 - DNA, 1025 bp, Homo sapiens
cctttcgccatctggtctgagctgggtacatgaaaaaggaaggatgttaatctataacaaagaattagtaactaagaggtaaggggcaccatttaatctttcacaacgttttacagggcaagaaaaataagaaagaaggttaatctgtaataggaagaaacaaaagttgtagtgacttgcccgtatgagctaggtcttacaatcaatcacattttattcaaggctcagagtaatttaaagtttcagcagctttcatttaaattattttcacattagccatttgagtcttcatttctgtatatcttctttctcatttggggagcagattattttctctttttttgttttcttggcaggagttccttatatattctgtccattaatcacttggcggttttagatgttgcaaatatttcattcataatctgtcatttgtctgttaactttgcctatatcttcctttattaaatagaaattcttaattttaacatatataaattcatcagtttttccttttatcgttggcaatttggagcttttgttaaagaaatccttccccactgataaagtcacaaagttgggtgtttaattcatatattgtattgtttctttatcactaccataagtacgtaagattacaaatttaagattacaatcctaaatcttaaatttgcaatcctaggttggtagtttttgaagctactaagattcaataattactttcaagaattgaggtgaaatttatgtcataaaattaagcattttaaaaggtacatttcagtggcatttagtacattcatagtattttacaactgccacctctgttaagttccaaacatttttaccaccccagaagaaaaccctgtgcccatttagtagttacatcccattttcccctctacacaaaccatgactctcatccatctgtctctatggatttacctattctgtatgtttcatataaatgtaatcatacatagccttttaagtctgtcttctttcacttagcatgttttcattgttca

SEQ ID NO: 10279 - DNA, 1027 bp, Homo sapiens
gcactgaaaaaaaatgagctatcaagctatgaaaatacctggagaaactttaaatgcaaattactaagtcaaagagaccaatctgaaaaggctacatattgtatgatttaaactgtgtgacattctggaaaagacaaaactatggagaaagtaaaaagatcatggtttccaggggttaggggaaagggagggataactaggtggagcacatatttttagggcagtgaaactattctgtatgatactgtagtggtggatacatgtcagtatgtatttgtccaaatcctgtgggactgttacatgttatgagtgatatgctctgacactcctgggagactccttggttgcctaaggtgcctttcagccaggaggtacagttccccttgtctttgggacttttcttgtgctcataaagtcttttataaactttggtcactcaaaaggaaattttaaatgtgccaaattgaatggagctttagatctggccagtttaagaaaatttgcctaagctgtagacattcacttcctcttttcaaagagaaactgctttctccatgataaaatttcaaatgagagaaaaggttacaaactgtagtgaataagacaagcaagactttttaatctcagagaaaagtgaaaaaatcacaaatatacacaaataatggaataagagaataacaaactaaacgcctaccttaaagtagtgcttcaattccagtctcatcagttgttgaatcaggttccataaagtctgaatctcagtcaagccagggagattcaaccttgagagtagtctgaccaagggcttctgcagtcttcagcgaggtcagttggatgcaacggtccatgctggtgctggggctccagctgttggcaaaacagcaggagtcaatgaaggcctaatttgggtcccatctggttcaccaaaatgtcaccctgaaataatcaagaggcccagaatccaattttaaaagagtttgttcaagtgcaaaatttgagactggccacccagaaaaaacaagactcc

SEQ ID NO: 10280 - DNA, 1027 bp, Homo sapiens
tatttattgctctctctcatgtagcacagtgcttagatgaatgaatgaggtgtatatacagattatcacggaaatgcagagaagggtcatttttactagtctaggcatggagttgggggctattagcagtaagaaggcctcatggataagtgatttttgaggtgaatgtattgtgctgtggtcctaaactgctgtgaggtgaacaacgtaggcagtgtgacatcagtggaccaggtagccaagactgctgctaagtgactataagattggtagcatatagagcatggataccccagacaaaggaatgattcatgtccagggcaggatggagtgggacagcctgagatttcatcatgctactcaacacagtgcagtttaaaacttaagaattctttatttctggaattttccatttaatatttccagactgcagttgactataggcgactgtaaccatgaaaagtaaaactgtggataaggggagactactatgcctacttaaggaatgttttgaataatgtgataattaagtcagacaaacatgtatgtatgtttgcatgtatgtatgtatgtacgtacgtattagggacaagatcttgctctgttgccaaggctgcagtgcagtggtgcaatcacggcttgctgccgccttgaacttctgtgctcaagcaatccttcctcagcctcctcagtagctggaactacaggcacgtgcctccatgcacagctaatttttaaattgcatttttagacatggacctctcactatgttgcccagggctggtctcaaactgctggactcgagcagttctcccaccttggcctcccaaagtgctgggattatagttgtgagccactatacctggcccctcaaattactggttttatcatctaattctgaaacttctagacacattttcaaactgttaaaatcctgtttctgagtctcatcttagcaataaagaagctagagtaaagatcaagttgtaccctacatgaatacaagccacctcttcagcttcctggt

SEQ ID NO: 10281 - DNA, 1033 bp, Homo sapiens
tcatgttttgtttattgatttatcacttgatggacattcgtattgtttctacataacctttaacctgtttcactatgaaaaatgctgctatgaacatttttgaaaagtttttgtgtggatgaatttatgatttaatttctcttgggtagaatttctgggtcatgttgtaaaccttaagttcaacatttttaaaaactgccaagctatttttcggagtggccgcagcattttgaggcttctcctttccctgcatcctagcctacatttgttattttcagtttctttgattataatcatactaatgggtgtaaagtggcatattattgtggctttgatttgcattttcctaatgactatcaaaagacaaaattacaacaaattttttaaaatttaaatttcttcatttaacaattctagaatgggctaacgcttcattctgtaaaatagaatgtattctgatgagctgacctgaggttttatagacagaaaatgactgaaggaaatataaacaaagaacaagaagtgtattggtcactttaaagttactttccttgtaaggcgcaaggtgggaacagtgaaacagaacaatagaaagtaactgattggttaacattaggtcacttcaggttacattttgttggaaggattaaaggtcgagggaactttgttatcatgctgattaaaagtggcctgcttgagaaattcagccatctccctctcctgatttctaggaatgccagataactcagtttcagtttgatggtatggaactttagtgtgagtgactccattactgcactatgcctagtgcagtagcttagcccaaaacaatgccttatttaacatgactaaggatgttggacgtcttttatgtacatattgaccatttatttctcttctttggaaaaatgtctatttaagtcttttgccttaaaagactttaattgggttgtctttttgttgttgggcctgtaggaggtattttatatattctagatacaagtcttgcccctctcctccctcccacccccta

SEQ ID NO: 10282 - DNA, 1089 bp, Homo sapiens
agagtatacatgtgaatatcattttctttttcaaagtctttaaaaaatacattttttcataagaactgatttatattttgttcatcccatgaaggctcttaaatttgtctagcaatcattttttgagttcctagtatatgccaggcattgtcagcctgcccttactgcagatattttttaagttatcagtttttcttattggaggcagtcgaaagccttgcatttaccagtttgatagctatttaaaatcattagccggttgtataataatggacagagagaatggtatgatcatgagtggtactttggtacttcttttatttgtttactgatttctttatctttaagatgtcaggattcttgtttatatatttggttgattctatcaaatgacaaaatttgtatgtaactgctttctccggttcagtgctttttgactcttaataatggtggtggtgctttatattattgaacaaagtagtctctgggagaagttgtcctgataggttgaagtcattcagaatgataatcaaatgccgtcttcattatacatgactggaagaattcttgacgttgatcagcattctgcaaaaaagcagaataaaaatgccttgttgaacatttagagtgggggtattagcatctgtgtatatgagttcaaagaaggcagcaggtgacaaaataaccatatgtaaattctggaaaacattctcttctaggtgtttattttctctttgcactttaattttctgcatagtgaagccaagaattactgtaaatacatttctaaatcccttagtctaaaccactgaatattcaataaatggctgggaaaaaaaggtataatttaaaggagtctttacaaataaaaaggaattgttaaagagacccaaatgaaacaagtaaaaaagtttttaatgtgcataaataaagatacatttggagataactgcattgctaccagggaaatcccataagcagctctgagtgattgtatatatataaaatataagagagatatatatatataatataagatatatatgatatatatacatattttatatatatatcttgacctctaaataa

SEQ ID NO: 10283 - DNA, 1060 bp, Homo sapiens
aggagttatgagctgggaactgtggatatataatcataatatcacaagtgggttgggacagaccccagggatttatgctctgactggattattgccaagagaaggtacaatttctgaggcagccaagatcttgcctgaccaaggactgcaggaccaccaattactcagacatcttgtccttcaggcctgtcttgttccctgtgattaagaattatccatccattccatactgctaaactggctgtgagtatttttctcaaaggttcatgtgggctttcttatatttgggcaactttttaaaatttgaaagtgccacattcctcagtttttaaatgtattcatcaatttaataactttttaggcagagggaaaaaagtcatactgctcaaaaggcatacgtggacacattccaatttcaaaaaaacattaaaatatgaaaagaaaaatcacttcttggaatccaggaaacatggtacctgtttttcctctttggtagctctgccaagctctttccttcttgagtaccaggctcagatgctcagttttgcagctgcctcactagagtctctgtgaaaagctctttcggtttcatcttctgtttaaactgtggaaagtaataagaagtagctgctaatgagcagcggccttgggaagtcacagcccacattaaatgggatcatctgagatgggcctctacagatgctgttccctccaagtcaccattaatggacatatgtggattcagcaaggagcagctttaaaggataaattgacacaggctttttcactgttcaaaggcagaaaaatatagattgtcagtgaataatgcatagcaagtttgaggcagattttagaatttttgcatgtgtgagagagaaagatggagagaggagggagtggggggggcctgtttgaagccattctagcagaaaatattcagtgagggtttcccatgaaaactattgcttaataactatctttagttcttgacatagcctggaacataactagtttcatccagcaaaaatttactgagcacatataatcctaacgatgatga

SEQ ID NO: 10284 - DNA, 1049 bp, Homo sapiens
aggctttcacacgaagcagtgaaaggagcctcagggtaagagtcagaagcccaagttctagttctgactctgccaccacatcacccaccgtgacccttggtttcttctccaggaaaagaaagcaagctgaagctgtgtggaatggggtggagcagtgagaagagcaggggttctgggtgggcgatttggggccctgtgcccatcatgccagttcccacctgtgtgaactggctggggtcactcttcttctctgagccttggtctctgggtctgggaaagggggctgaattttaacacctgccccacagggctgctcagtcgatctctttagacagtgtagtgactagcatgagccaagcacatactattgctcaataagcaatactattggattccttaagtaattaattaattagcaagcagtttaacttaccatgagaaaataaatgtctgtatattcttacaaccacttttactcccaaatttagtcctttgcctttcaaagagctccaagaacaataaaggttctcaaagaaagagaaaccacacgctggaattccttcttcaccaagcacctttaaccgtggtttttgaggaaaactcagtgtttcgtctgttctcacacaatagtcatcaacagaagacttctgtgaccaaatataggcagaggtggggttctccccaccatgaagcaagcaatcaactctgcagtggacaccagctgggtgtccttcaactcaattccaacactatctacctggagatggcctcaaatcccaccggttgagggctcagtccccaaaactgcccccccaaccccaccccatctatcatacttcagacaccagtcacaagtctgggcctctggaacttctatctgactggcttctagttgagattttcatgactgcttctttgggttcagttaatttactggaacagctcacaggactagagaaatacttacatttaccagttgatcataaaggacattaccaagggtatagacgaagagatgtatatgacaagatatagggtaaggggcgtgg

SEQ ID NO: 10285 - DNA, 1100 bp, Homo sapiens
ccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtaagtactaaaacaaggccatttgatgattttgtttcattaattcattgtaggattggaggtaaattgatcgagtattttattttaattcaggatttgggataaaaactattacttataatacattctacatgttcatattccacatgatttctcctaggaaggaaatggtctagtggagaaggcataagctttggagtcagaggagctgggcatcagttcccactctaccatggacttaatccctattggcctcagtttccacatctgtagaatggatacagtggatacctgcccagcataccacagggagatggtgtagatgaaaagtacttacctgatgaagtgctagcatcttcatatgaccactgtccacaaatgtggcaaggggagaaggaacaggcacatgtggatgaattttccacataattgaagctcttgtcttcaaattccaaaaaaaaacccttttcattttaaccattttgcat

SEQ ID NO: 10286 - DNA, 1031 bp, Homo sapiens
actgagatgcttacagttttcagccggtacggtgtgtctctgtgcttttgattatcttgttgctattttctagagggcctcactctattccttccactcctggttaactcttactcattctaggaaatatagtgcatatatcatagaggaggctagacttccaagtccatctcccttacccgatagcactcttggcataactttgtcacctcactcactactttatgttgaaactctttatttatctcttagttcatatctcccaaaagacatgaaatccctgaagaccagaattgcgttttattcttctttgtaataccaacttcttgcacaccccagtgttttgcacagaataggcatccggggaatggtggaaatgaacacagatcagaacaagctataaactccattaggacaagtctctgtttgtcttattcaccacaaaatcccctgtgcctaacacaaaacagagattgatactctttctgagaggtgtctcttcatttattgccttatgtctgtatcttccctagtcttcaaacaactcttccgattctccatttcccacccttccactctggccataatagaataactggaattggactagccatcctaccgtaagcgattgtaaaaatgaacacagtgtatgaaattactattttctgattttagataaaaggcagcacaaagctatggcttccaagaggtagaaaactacacaagttacatggtcgttccagctttcagcttagaggaactttataaaactcccaagtagtagagttcagatagaacacaaccatcctactagtttagggccattgacaaatctggaatttgtaggatagggtactagagagaaaaggctacagaaatctgcattgaggtcctcatgagcctttgattaaatgccaagcttcacatatgcaaggaaaaacttcatgtggctggtcaaagaacatctactggggaaaaaacaactgccaggaaataaaacaactaccaagcagctgcatgctgacattcac

SEQ ID NO: 10287 - DNA, 1032 bp, Homo sapiens
catagtgattatgatatggaccctgtagccatgctgcctggattcagatcccagctctgcccatttactagaaatagaaccgtgagcaagttaacctctctgtgccacctgttcctcatccataaaatggggatgatagaaagagtaacttcctcctaggattgtactgatgatgaagcaagctcatgtttgtgaaggccttagaacagttccgggcaggtgcagagtaagtgctgcatacttatttgataaataagaaagtatattctagacaattactctttggtcaaatagttattgttttcctttcactaacccatcaaaatattcatgctgttcttcatctctaatctacttacattatagctcacttggcagctgccatgaagaggtaaagttaccaacaggctgttgtagaaaaagcagaagatgcgggtcagcagatgagttcttgtcccatctctgccattgccctgcactgtgatcttggacaagttgccattcctttctgaacctcggttttcccatctgtaaagtgggagagttgagccagctgacatcaaagagcacatccaaccctaagccctgagtgttggtgacttgctcagtggcttcccttcagggacaggcaagaggaccgacgtctgtcaagcacctactatgtggcaggcactgcttagctctttcctcacatgcttcttcctgtagtcctcccagcaacacaacaggaagatagcatatctttgcattacacttggagacactgaagccctgagaggttaagcagccagctggtcactctgctggtagggggaacacaaggaccccagcctgggactgcctgtccctaagcagcctttttccactaggctgggcttcctcccagagggtattctgcaaaggtgtgatccatgaataaaagcatcattacccagctatgctggggagattcctgccctccttccctcatctaggtagctatgctctggcgctagacttgagttaggatcctgcctttgccacttcttcact

SEQ ID NO: 10288 - DNA, 1022 bp, Homo sapiens
ttgatcatcacctaacatgtcagagttttgtttgttatctgacttccaccttagactctaacattgaagtaggggctttgtctgtttattcttgatccctgaatgtagagcaatacctatgggtgctcagagaggcttcaaatatggagggggagaagaaagaaaagaaaagaagaggaaagggaaaaggaaaaggaaagaaaagaaaaaaaaagaaaaggagaggaaaggaggggaggggaagggagaggaaaggagaaagaaaagagaaaagagacccagtctggtggaggagcactaaagtaaggatgatgggtgcactaggtttgaaaaccaagggggctccaaccctttgcccctgctttaatgagaacagttcttctatctgtttatatactgaataccaatataaattttattttggaggaaaagtttccactgctttgaaaaaaaaaaggtttaaacaattcgtttaaaacaactgttctaggccacgggtcaccatgttagggcttagaacagataagtggcacggtcatgtctgcatattgtgaagtttagtctgtcaggggtatggttagtggagaaggggtgaaaccagagcagagaatctagctggacaagaggtaaaagcaatgttatcctttcaatcagaaaaccaaaggaacctgcccccaccctgaccggtctcctacaggaacctcagtaaattcccatttatttctctgttcttcagaccgatgttagatgcattctttggtctgtgctttctcttcctgaataaaatgattgtatttacatgtgctaaataccatattattatcactgactatacactatataacatatattactatatactaaatactgtattaaaaggaacatatcttctcatacacatgaatatgcatacagcttcatgttggctaattagtttcactgagtcctttggaaaaggaggcagactaaaaaatgaaggagtaaataattaggtgtcaagtaattaaaagtactattgagaa

SEQ ID NO: 10289 - DNA, 1201 bp, Homo sapiens
gaaacccaacacagttgccattttctagctgtgtgaccttgggcaggttgactatcacctgacctctgtgagctttcattttcattttatttccctgcaaggtgggagagaagaacccatctgcccacctactgtgagaatgagtgaggccaccgtgtccctggcactgtgcttcactctttggtaagtgtcagggaccctgctatgtggatggacacttgtaggatcagatgtgtcagtctgtggggagtttcctacagaagccatccagcccaactcgtcactcagcaggtgaaggacaaaaagagaccatgacttgcagcaactcagagtatgaccggccgggccacaagctttgtctcctgattctcagtccaatgcaccagacagtgccgtaggacctagggaaaagcggaatacaagagactaaagtcaaaaatgatcccaccacatgaaacccctaaaatgtaagtcatcctgatgggaggcagcatttcacatggaaagaacatcagtattccctcactgacacctgagttccggctgccctgcccacctcactacttgtgaggtcttgggcaggtcatagccgtctgaggcccaggttccaaatctgtcaaatgaggaagaggatgagtaaaattctagaacagggaccttagtgagctgctccagaaatggtacccatcattatgaagccttcttttcagtcctcaaatactgaaagaaaatggtgaggttggtgctggtgggaaagcttgctgtcctgggcatcaatcagggcctctcactgctcaggcaggggtcctgggcgctgggaggctggagaggaaggggaagaaccaagaggaacttgtgaggctccttgagctactcctgtatcttctgccacatcccctgcctacaaccttgctgggaacagagtcacaagcaagcagctttgagctgttggccagaaaaggctgtcaccacacaatccctgtagggaaaataatcatatcgtctaggttattcttgaaaactttttctaatatgctcaagatactgatacagactctgtgctgaaaatatttttttttttaattttattttttttttattgatcattcttgggtgtttctcacagagggggatttggcagggtcataggacactagtggagggaaggtcagcagacaaacaagtgaacaaaggtctctgg

SEQ ID NO: 10290 - DNA, 1048 bp, Homo sapiens
gcactgtcctttcaatgtagcaataaacaaaacagaccaatgtcatgaggcttctattctggcagaggagacaaacaataaacaagttaatgaacatacaatgtccaatgctgaagggtgctagggtggtaagcagggtggttaagaatggacaggaatgtgcagtgttggcacagagaagacagggttcaattacatttggagtggtggatcaaagaaggctcccaagaggaggattttgtgctaggctctgacttctgaggggagttttaagttagccaaggggaagaatggcatttttggcagaagaaacagcaaaagtatagacatgaaactatgaaaggatatgggcatgtttggaaaactgcaagcaaatctggtgtggaagatagaaagaaaattcaggacttgatgctggagaagtaggttgtggatagactatgagggctttttggtcttctgaaggtggaagctagcagagactgcgtagatgctgccaggatggcagaacctgtctaccaaggctgctccctgagcttttggccaggggcccagtaggagtacagtcatggcttttgcaaccaaaaaatggttaaaaacataagggacagttcatcccaatagttcacaaccccagtcttatcatgagaagaacattagacaaattccaatagtggggcatcctacaaaaacctttccaatactcacactaacagtcaaggccatcaaaaacaaagaacatctaaaaaattgtcatagccaagaggagcctgaggacacatgatgactaaatgtaatgtgtcctgcatgggattccagagcagaagacattagggaaaaacgaaagaaatctgaataaatcatggacttcatttaataataatgtttcaatattggttcattcattataacaaatgaaccatactgatgaaaggtgttaatatggggaaaactaggtgttaggtatagcaggtctgtgctatcgtggcaatttttctataatctctaactggtttaaaatttttattaaaaaacaggagactttttt

SEQ ID NO: 10291 - DNA, 1056 bp, Homo sapiens
ttttttttttgagacagagtctcactcttttgggcaggctggaatgcagtggcgtgatctcagctcactgcaacttccgcctcccagattcaagcgattctcctgcctcagcctcctgagtggctgggatcacaggcacttgccaccatgcccggctaatttttgtatttttagtagagatggggtttcaccatgttggccaggctggtctcaatctcctgacctcaggtaatctgcccaccttaacctcccaaaatgctgggattacaggcgtgagacaccgcacctggccagcatattcttcttatacactgaattccatctgtcctgttcttaattgtctcagctttagactctggggatattcaggagttccctctagaagagaagccttatcattttggttttgttttgggggtgggggggtgtttttttttttttgagaaatacaatattcatccagaaaagggcacaacacatacatgtactgtccaacaaataattgcaatgtgaacatcatgttaccactactcagggcaaaaaatagaacaccggtaatattcccaaagctttcttgggctcctcccaagaaacaaccctctccctcttccctcacctccacctcgtagtaacacactcatgtcgtggagaacctcatcattcctttcctttattgtttggcatctaagtatatgtatccagacaacccagctgttttgcctgttttcatttttcatacaaatagaatcatccaatacatatctctctgtatctgaccctctttgctcaatgtcatctttttaagagtcatccaaattgtggatagttccagtgtgttcctttgtgataccccatcatccaggtatccagaagttatcgattctactgttaagaggggtttgggttatttcccgtgtttgactgttacaaatgatggtgctatggacatttttgtacaagtcttttgagaatgctgatgtgttgggtatatacctcagaaaggaattagaggttcataggcctggtatctctagctttactagataatgccaaatt

SEQ ID NO: 10292 - DNA, 1028 bp, Homo sapiens
cctcctaaagaaaagcaaaccaaaaaaattgtagaagccatcacgtcctacaaaacccacagctctctctctctgtatattcccagcccagcctccagacccaaggaaggtgggaagagctgtccccaggggttcctggtgtggggttccatatagagccgaagatactgtgggggctcattcccaagccaagccaatctattttaggacatttccatcatccccaaaagaaaccaggatgcttcccccagcatttcatggaatcacagcaagcatttcttgaaggaattcacaggaacaggcctagcatgggaccgggaacagagtttgtgtctaatgaatgtccattccacagcccctggagcagggtttggtacaggtttgtggggtcagatctatcagctttccccacacacaagcatggaggctaccctgctagttcagctcagtttttctgcagaggtcgatctccaggtatgaaattatgtctggacccagggtcagggggtcgtacttcccagtgaactttccacacaaaaggtccagtctccatggctcaggtcagaaattacccactagacagcctccctctccaacctgccaggtcaaggcaaataggaatactgccccctgtgcctcatggcaaattgtcactcaattatggccactttagaacccaggttatcacaaattgacttggctgatctctctaaattgcctcattttcatctatttcttttgctctgtttccaagaagaaattctgagctcaggaaacatcgttttcatagcccagttgtccctttggtcaaggagttgtaagagaggggaatgaagtgggttgggggaagatttggcattatctggggttggatccccagaagaacctcaggccagtctgtgtcaggagtagggaatactgggcaggtgggagggcccttttggcagtaatgaggtacagccttggagagccttgagttggcaccggaggcgtgctgcttgaggaggaagaagggagttgaattaaag

SEQ ID NO: 10293 - DNA, 1663 bp, Homo sapiens
gggagggcttttgcttctagtgccttccccaagacctcatggaccgttgacttgtttcatcatgtggagcttcatcttatgcaagctgaagaaacagtatgccggtttcattgctgcaagataattgaccccttgtgacttcatccagaaggtagcagcaacatgtgctcttagtgaaagatcagcagctgggagacacatatgagctgggaaagagaggggcttggagtggctctggacgacctgggcaggactaggattctgatccctgactcctgccagcaccagggctcaatttgcatgaatcaaggctgtgttctaagtcctgggactgcagtgaggggtgctagtgccctcatctataaaagctagaacaggaacaagtgcttggggagactacatatgaatactcattggcagagggagaagtatgctgattaacagcatgatgacctgtcagagccttcatggacttgtctttgggtggaaccagggctttgcccttttggaggctggccctgtacactggagtaataatactgcgcctggaagctggacactgaaggcacttacttccccacttccaccccctcggcccagcaatggcttttaaatcatgctctgcagagccctgagaggttaatgaaatcctctctgggatttccataggagataggcagattttctgctgacttctaggcccccaccctgcagatcctcttctccctgtttgcagggtgggcttccttgttgctagggtggatgtttggctggcacacccccccatgaccatgctgtttggttgtagctgatctccattctcattggcagtgtgcctgtaccacagcaattattaaatgttttgaattttactcttgtttgcaaaccttctttggacagaggaaaaccgtgctgttccatgccagctgcatcctaacttaggcacatcataccagtgatcaaccttcaagccactgctacacagaactaaagcagttttttgtctttgagaagggttttctgtgcttccccgtgcatcctagggtcacagagtcacctggatgtcaccaatccacatggctatgtggggtttggctatttgtttactgcccatctgcccccaccaccatcaccactccacccagagccaccacagcaaaaaccctggttttcttgcagtggcagatctgaaagctggagtttgtcttttccatcccagcccctggcatgtctcttcaggaggcagatagcatgcttcattgcctgcctgtggacctggctcccagattcactcagctgtgcctttacaaacaaacagctctaaatgagcaggatgtgccagcttttctgggaggattccttatgagtacctactatgtactttgcattcattctcccatttaaatgtcacatctttccctgtttggtgtcattccagttgcacagatgagggaacacagaataagccactttctcaataatgagtttcccatcaataaaatggtccaaagaggaagaagacagtcatttgttgtggtggtatcagggattctagcactggatggttagatcatcttctggattacaggatgctcatcagtgcttgttccaggatctgatcaccaccgagatccctggatactgcagtggtacaaagggagcg

SEQ ID NO: 10294 - DNA, 1042 bp, Homo sapiens
gtgatttcttgctgctcttttacatcaccttttcagatgaatcatttgggacatcgaaccatcaacagtgttgctgtaaacgctttctgcagattcataaatgagatcatgctctgaggagaagcattaagcagcaatttgggaagcgtttgaggctgtttatttgcctgaaagtgtagcagccggggtggtgggggatgcatgtgttgagtctgaaggcagcacttttctcctcctgttagtgtaggaaacatctcattagttgttttggtatccaggagtcctggtgtgtccaggctggatgagataagaaggatgtcctgattaaagcccctcactgtcctcatgagtaaactgaggcacagagaggccaagggacttgtctaatgttgtacagccagcaagtggtacactaaccctgaagctaggcctccttctacttctgagatagaataattgctaggataaatgcacatctcttaccttctccaaacctcggtttcctcagctgtgaatcagggatgcttccacctttttgtcaagattgagaagaggatgctaagagaagcatttatgcagagacacctagctcagtttttagccctgtggccttggcaggttgtatagcctctctgagcctcaatttcctcatccctaaaatgaaagctatagggagaatttgaaaacctgaatttcagcagtgcctggagcactgtaatcactatgtaagtgttagctattttcattattatcattatcattatcttcattcttatcatcattatcggcacagaataagcccttagtaattattttttccccttttatgtagacagagttgcaatgtggctaaaatgcgggttctggatataagcaaacatgagtttaaaacctggctctgccatttactggcagtgtaacattggacaagcttctcaactttcctgagacttagtttaccacatccaagaagtggaatagcaatagttaccctgaggagctgctcgtgaggactagaaataactcacctgtcacatcattt

SEQ ID NO: 10295 - DNA, 1046 bp, Homo sapiens
gactaagagagatggtgttaggaaaagtgctgccaacaggctgaaactgtgaaccaggacctttgaaaagctctggggattcccaaaggataggggaaaaatatgtttttcatggaataacatggataaatctcacaaatctttctatattttctatagctgtaaagtaaagcaaatttactttagaaaaggggttattttttgaataagaatttgtaacagttagattttaatgagggtacataatttgtaattaggcattattcgctcttcaaaatcttgttctaactgggtaattaattgcatttttgattatagaagttaatccatatatactctcatcttaacaggggattacttttttgtagatgaggcacaaatagagggtttaataacctagcttctttcagtcttctatgattgaaaaatctcccgatctaaaatatgtgatctgaatgaacattattgaccatctggtggaaattacccaaaatgttgacagtgaacttagattagtggttctcaatcttggctgcacaccatgaagggaactttgaaaaaaatactgatgcttgggtgacagccccagaggttctgatttgattggtcttggcagcaatctgggcatctggattcttaaaagccctttaggtgtttataacgtggatccaaggtgaaagccactggcctagagagagttaattcactctcatggaactagcctttctttctctccaatgccactttgggctgcaaccctatgttgtgcagcccacatcattgctcggtgaccacaggctttagaatgtgcagtgatttttcatgaaagggtggctcctgaccatccattttattttattttattttattttattttattttattttaattttattttttgagacggagtcttgctctgttgcccaggctggagtgcagtggtgccatctcggctcactgcaacttctgcctcctgggtttaagagattctcctgccttagcctcccgagtagcttggattataggcacctgccactactcccagc

SEQ ID NO: 10296 - DNA, 1025 bp, Homo sapiens
agttccccaagtataagagctaggactacaggcatccagccatcatacctggctaatttttgttttgttttgttttgtagagactaggttttgccatgttgtccaggctggtctcgaactcatgagtttaagtgatcctcctatctcagccttcccaaagtgctggcattgtaggtgtgagctactgcacctggccaactttgccacaaatgaccagataattctttgttgtagggggtgttctgtgaatcacggatgttgggcagcatccctggcctctatctactagattccagtgccttccccgccaattgtgacaaccaaaaatgttgacagacattgccaaaagttcactgagcaaagaattgccaagattgtccgtccctggttggaagccactggactagcttgtatgacttttggcagacaaactaaactcttggtattagttccatcttttttaatgtatgacaacaatacctgctgtaagaatgaaatgaaatagcattaatcaagcttctaccagggagcctggcacaaagtagacagacacatctgagaaagaaccttcacacccaggttagtgggggaggcagggaagcttcaaaaagtgggaagcatttgacgtcgacttgaaggatgagaacatattttccaaaaggactagaagtattgtgattattattattcatcctccttcctctacccttgcaggcctcctctcacttgctggtcactccttcttctctcctgtaaaaatcaaccaaagagactcttctaaatcctcagctcctggaaacaggagatttggttctggcctcacatttaaccctccctgcgcctgctgctccaggagtgcatagactcgccccttgttctggagcaggccaagaatgacccgtttccccaccttgttaagtatgaattggaaatttgtacccatgcagtttccttgcaaaaaaaaaaaaaaaaaaaaaaatgcacttgtaagcattcagagctggcttgaacgagacaggagctac

SEQ ID NO: 10297 - DNA, 1048 bp, Homo sapiens
tgccatgtaattcaaactgataatttagcaaagtgtttccctttagaggtcctttttctgggcctactttgaaagtggatcgagacatgtaaaaatttgcatcattatcatgcaagcaattaaagtgcttaagagcttaaaagcaatttgttcaagttggttaaatatccaccctccccaaccttgtttgtattattaatttactcatcaaactgtgacatcaaaactattgtgaaggtaaatttcagtatcttctgttcggtaaaaaacttttaaatgtgaagggcttgtattgatgaggtccacagtgaaaggatccagttcagggtgagtcagagaaaccagctttttactaaataaacccagctctgctttgacctcaggatgagaactgatcatttaaacgttttattaatgtgcaattattctgagaaccagtcagcaatgcagctctttgcaaacattaattagctgaccctcacatcatcccacatgacagataaatagcattcacgttgcattggagaaaacaaatggacacacagagatgagggaggaagaaggcagctcttgccttgaaagaaatgtggtagaagtaggtggaattagaagaccatgtaagttttttacttcataaatatttattgagcaatgcactagataatctagagctattctatgcaatatagtagtcactagtcacattttaaactaaatttaattaaaatgaaacaaaactaatcatttatttccttggttgcactagccagatttcaagtgctcaacagccacatgtggttagtggctgccatactcgacagtgcagttatagaacatttctatcattgtaagacattcgattaaggttgggattaaaaaaaaatgcaaggatccttgccattgtgaactccaatgtaaaatttcctaaaacaatagctgacacatggcaactactgagtaattcaagttgtggttaagttctttgggctaatggttagggacccagcttctggagctagaggactgggttcatttcctgggtatgcca

SEQ ID NO: 10298 - DNA, 1044 bp, Homo sapiens
gaagtatctatccatatgataaattagatcctcagatcaaatcccccaggttacaagtttataattttaggtgttaaacatgtaataggtttcttctagcttatctgagtgttaacatgaaaaactaacaactttattttttcttctttttttcacttgcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggaccttatacctgtgtgttgcttctgaagctcacttcaactccggctgatggaaatgctgtgtgcactgggcttagctgtttttggaaagtcctttaattttttctcttccacttggcagcttttcttagttc

SEQ ID NO: 10299 - DNA, 1025 bp, Homo sapiens
cagcaaaaacatcctcacttctagaaccatagattaatttttacttgttcttaaatgttttagtaattggaattacatagcatgtcttttttgtgtctactgtcttttgcttagcactgtttgatagatacatccatttgttttactaagttgtagtttatgtattcttgttgttctatagtgttcctatttattcattttaatagtatattaaaaagggagaataattctgaatactaattatggtaaactctatgaggataggcaacttgtctgtcatgggattctccagttgctctgaaaatatcctgggagaaggggtataaaagattgagttttctaaaatactatgtgaagaataaatgatctgtaaagacatctgttgaccagtactttttagattccaacagtgtgattctattcccaggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtaataggaaaatgtcctgtcatcattttttaataacacactttttttttaatgtgcatactctgactttctgcctcagagaaagtcccagtgacaaaggggctccagagtttgtcaaacttgagctggaatcctgggttctgctactttctgattatgtgggcttggacatgttacctagcttttctgagcctcagtttcctcatttgaaaaatggagatagaattcattgattatagagttgtacgaattagaaataatacctaaagttgctgttaatggaataattactatgtgccaaatcctgggctgtgtactttgcatgtataatgtatttaatctttgtgatatatgtgtaacttccatctatgtaatacatggttgatgcttaataaatggcagtcattatcatagcaccatgatctagt

SEQ ID NO: 10300 - DNA, 1040 bp, Homo sapiens
ctttgttaagggtttttgcatctattttcgtcagggatattggcccgaagttttcttgtttcattgtgtccctgccaggtgttgtatcataatgatgctagcttcatagaatgagttagggaagaggccctcgtccttatttaaaaataatttcagtaggatttgtactggctctttgtacatgaagaccattttagacataatgttgatgctagggctagagtgtcaggataaaaagacgtggatgactagtggatgagcaacctgggattatttttaattgtttcactcataaagtgtgagattgatatgcaacaataagacatcaattatgtcatttatttgtggaacaaacacaaattgtgcaactttgtagagtgctctttttgttctggcttaacatctattccatatggtttgccaaaaggttcagtgactttttttcacattctgattttatcctgtgattttgtaaactcttcttaggggttcatgtgggatgtggctgaggaactgaaagctatgttggtgtttgctgaacatcgatactatggagagtctctcccctttggtgacaactcattcaaggtaaagatactttttacttaaaagttacaagctttttcttttcaatttagaatagtttctaaattatatgccccactgtgagataacttaaatttgaaatgcctaaaagctcaatagtttatatttaatagtttctttttagatacaatttgaacagactgagggttttttttaagccattttattataattcttaatgttaatcagtttttaactctgtgtgcctcagaaagttaaattttactctgtggctgcagagacagcacagggagctttttattatttcaaaaatatcagtaaacaattccgctttataaatcgtacacttaaattattgagcctgccactggaaaaaatataatgagcataacaaatttatctgataagatgtttttaataaaataaaatcaataaaataaggacaaataagctgtatgatgcattaaggccaa

SEQ ID NO: 10301 - DNA, 1089 bp, Homo sapiens
cctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaagaaaaggaaaaaaaatggtattggaaacaaa

SEQ ID NO: 10302 - DNA, 1049 bp, Homo sapiens
cctttttttttactcgcctcttctctttgtttgactcacaagaagcgctgtcttcctataagcaaaggaaaagagggtcaaatacaattttcatgctagcacacattttcgtctttctacattgcctgttcaaaagaaaaaaaaattaaccatgctagtattttcaactctgattaaatttcttttaggattttatgtgaataaattcccaaatgtgaagtaacagtgcattatattgtgctgaatcatatcactaggaggcaccttaagaactagagaaagaatatagaaaatttagtgggtaagaagtggctacttgtcagatatagccaattttccgtcttatctcattaagttttatctctacctaacagatccccagacactaatatttaacaacatattggtaactgcaagtgttagtatgtcatcttctggattcttttgccagtcccatagtgctgcgaatcattccctagcttccccgcttccctcttttgtttttgtactgcatccctctactgctctagtctcattttgcactttgcctggtctcctggtctcactgtttctaaatatttcttatccatcttggtattcttaagacccagcacagaaaaatcaataaataccatgggaaggagcaagcagggctagaaacacaatggatggtcactagatattaatcatctttgagtaattcttctaatcaaacatgctctgcatctagttaggcaagccagctccgaacacagaggctccaagaacagcaaaaggtgcatatccctggggagagcccatggctggagttagttctccaaggtgttcctgcccacaccttttctaatgagtccagttagtttaactcaatagtgtgtgaacacgtaagtaagctgccattatccaacaccgcctggaaaaacaaccatgcatctggtccctcccatatccctcagctgcaaacttgagagtaggataaacttctagctttctcttacagtggccaggtgtttgtgggcatagggtaatacagatggtctcttgaaaaa

SEQ ID NO: 10303 - DNA, 1166 bp, Homo sapiens
aaactgccgatttatactcttagtcattttctgggcagtcactactgatgttgaggtgccagcagggttgaagatggagcccccagccatcagctgaaccgtggatggggcacaagtaaaatagcctacctacaagcataattggaatcagaacttactctttaaatctgtgactgtgtgcctcaatttctcataccagctttctccataggttggaaacattaccacctagactcttatcattccactttcactaatcaggagagattgccctctttccttagttccaatttttaaaatcctcagaaaggagtctgaatggttcatcgtgggtcagacgccaccttttgacccagaacactgccaccaaggaataatggcaatttccatttaatctatgtagataatgtggcagattttgttcgtggcagataaataatgaaagctaatgtttacagagtgcttaaaatgtaccaggcatatgctcacctaagcattttacatatatgtagaatgtctccctagacagggtatagaggataaacagcaaacttaaaagaaattggagatggctccaattgttgttgttactgcaacaacagccatgagaaataaaagctgaaataacagcagcaagacatgagagagaaacttaaatgcagtaacgattgtatactctactgaagtagagtatacttcacctcacaataagtgttcatttggttatctaaaacttaatttatcagctgttgaatcagcagaggatgtaaccacttagatagcactatgtgactcaaataaatgacagattgagtctttcaagtgtcacagtatataataaggatcacaaattttgtgtgtgtgtttttttattaagagaaaaaaaatggctttggagtcaagtacacttagtcttaaatcccggctccactgtttgctagcgatgtaactgggtgtattacctcatctgtacaatggggataataccaccaatctcatggttaaataaagtagtgtgtgtaattgctcagcatagtagcatagtacttgacacacagcaaatagtagcaggatcaaatgggagaatatataattgcccagtggctgtaagacaagaaactcttagtgttattacttctctatatttcttagagatgcctaatccc

SEQ ID NO: 10304 - DNA, 1023 bp, Homo sapiens
ttcctttatagtgatatttggggcaaacacgactgccagcccctagaggccacatctgtgtgacttctgaattaattctcataaaatatgtcaagcagaactgaataaaagaaaatgaacaaccctccccagtaatatatgagggttagaaaaggcatgagtcagcaatgtctgttgtacacagttaaaaacttttatgtattataagaagtccaaacttcctccacattaatacattagcattagactatcctgcttcagccattagatccctgtcccatcggtaataataatagctaacatctcagtgctaaccatatgccaagtactgtcttaagcattatatgtacataatctcatttaatcctcaaaacaactctttaagttgtaccaggtactgttactatttccattttaccaatgaggagaccagagaagttaaatgacttgctggcatctcacagtaaatggcagagtttgggttcaaacctagacagcctgactccagaactcacactcttttttgggctttcttgttttatttctaaactgttatacagagtccttaataaggttatacctcatctgctttttcttttggtaaaggatagagaaattagcaagctacctgattttaagaagtttagtgctacaggttgaatatcccttatctgaaatgcttgggaccagaattgtttcagatttcaaatttttttttttttttttggaatatttgcaatacagttaccagttgagcatcccaaatctgaaatccaaaatactccaatgcacatttcctttgagtgttatgtcagcactcaaaaagttccagattttggatttcagatttttggattagggatattcaatctgtaacagttatattttctttgtaaggctgtcttaaatcatttctacaaaattgtccctccctaacgaggcaaaagcttataaatctatcaggtaagtgctacctttcacatattctttgtagtgccaaataatagggaggatacccaggaa

SEQ ID NO: 10305 - DNA, 1029 bp, Homo sapiens
ctaatggcataaaaggggagaaaacactgaagcagaaagaaggtagactttcctcacaggatgattaaacagaattataaagagcttttagaaatcattcttttcggcttcttttcataatattgagcatgtactgtctgtctagactattgtgattttgtcttccttaaagattggaatatgaataaaaataaaagcagtatttttattgcactcaggctatgtgccagaactactccaaatagtgtatatgtattatctcatttgctcctattatcaatactgttacatagtttccgttattacccccattttataaagttagcataacttttccaaggtcacaataatgatggtggtggtctgtcttacagcgtagtttagctaattaactattataatatggtgacttttgactaacattttaattagttgatttccccaaatctcttgcaggaaacacttaacaataaatcttatacatgttgttaccacacatacttattaaactctaaagcctcatttgcaggctagttaaatgatctagtttgattttgggttaatttagagggatgccacgtggacttgtttgtgtttgtgtataatgatggccacagcagtgagatcctgaactgactatggtatcccaggggtgtatgggactcaataaaggcatttagggtgagagtgtagggttttgatggacattcagggcaggacacttgacgttaggatcaccaaaggaagggaaatgaaactgagactgttgcataaaactgaaaacataaaaggattctcatttgtgaaaggactttttaaaaactttattcaccagcccagggtagcaacaaggatgcatgtttctattaggagtggaaaaagaaaaaaaaagagtaaatttaaacccaaccctattttgtggggagagtatagctccaagtcaaaaaaaaaaaaaattgatatgaaactgctcttgggctagtgaaatctctggacaactagaagagggatgtgcaaaattattctgta

SEQ ID NO: 10306 - DNA, 1026 bp, Homo sapiens
tgtgcacacaaaagtatcagatactattctgtgcttttacattgtaagttagttgttgactcatctctgaccaggcatcaatccacacagtatgtgcctataaaggtgcaagtatgtttgtgagtttataaagttcaattattccagtattttacagtaacattttatttatctggagttcaaagtcttaagcctcttcttctcaacatgagaaagatttaagtacatttctattagttttccacaaatttaattcaacttaatttaataaatatttgaggtgctgctggataatgctggatcatatttgtctggatcatgctgtttctatcttcagtgtctgaaacgcttttatctatatcttaacctagaataatgacttacacatggtagacagagaataactgtggaattataaataagctcagttctggggccatgttctctgggagcattccacgacacccttgtgcctggctgggttaggttccccactcactgtatcttcctgtgatactctgttcatagctcctgaataaagcagaacaattctacattgttctaaaattgacagttttgaagaatctgcctctctaatagattctgagctactttatagaaagaatatgtgtctttttcacatttgaatatctatggcctagcatagtttctatcacagagtaggcatgcagtacatattttttaaataaataaatggatatataaataagtgaatgaatggtaagcctatcagtcatatagctacatataatcatgtgggggagaaatgttattcaggatctcctattttctcttttttaaaatagcctacatctcccttataagatgatgagactaggggaatggcctaattgtctttgttgttagtatcctcatcctaatgttattttccatgtacaaaacaaaaaaaagtaagactgactgaataaaatgacactgctttccctccttggcactctcatatccaaaggtttatgttactataatgaaggcagaatgcaccta

SEQ ID NO: 10307 - DNA, 1033 bp, Homo sapiens
aagcccatagtgagcttttaaaatacaaagccttttttatgccactcccctgctcaaatctctctgatgccctgtttaatcctcacaacaactctatgaaattgacatgccttttcctttgtatttttagatgagtaaaataaggttaagagtcaaagtaccatgcttgatatattgctttagtgacagtgaatcagataggctgatgaagcagaaacttggaatataaaatccagcaataaagaggcacttattttcataagtatcttctcaccagtgtcaataaaatctaatcagttgccacatcccaaaggagtctgtctctttttatatcttatagtatcactgctactgcactgctattatacccatgaaggctatttaaaccctccaagttcttcgtaaagatatatttcgttttggcaaggtaatattaattagaagcaattaagaaatactggtgaaagaaaaatgaaattagggatccagaatttcttgcataattggacccctgttccccctgcctattccctaaagaccccaaactgtatgtcatgaagttgagaggcaatataatgtaatagttaagaacacaaaccagctccacctattactaactggaaagtggtgtgtaattttttaaaaaatcgtttttctcttagtttcctcatctataaaataggaataatactagttcctactttatggtactaactaggttttagttgctgtatttagaactttatacattcctcttggtgaatttctatgctaaaaggaatgatccaatcaagaatgaaaaatgaggattaaacaaatcaacataggtaaatacaacttctggcagtagtacttctatactttctgagagagaaaggccatatgtttgctgtttgcttctaaacatttatcagttacaagattgatggtgtctgtaacagagtgaggttataaaagttcacaaggcagagcagtaattgtgggatgtgttgaataaaccttatagctggaagtatctgttagttgctactca

SEQ ID NO: 10308 - DNA, 1031 bp, Homo sapiens
tctgtaaaactcagactattcaaattacagcacctaagctcatgcacttgaactttacaagtaggcatatgttttttacttttattttatgttgaaaacttggtcttttaaaatattttgttttacttttgaaatccagtttaattattttcaagcaggtgcaataataaaagattaacctaatattagtaaggacattttttttgtttattttgtcttttgttgttgtttagccctcctacaacctctctcttttaatgaagatattgtattacagtaatgaaaatttaggaaaacagaaaggaagaatcacttatagtttaactaccacaaaagcaagctattttcacttttgcatattcccatctgttggtttcttagggaagccattcctcttctctgcctaggctttgaataacttgagaataaaacaactgagtggcagatggagccaaaatattacctatattactcattaagcctaggttggaacatatagcttattatgaaagccaaatcggtctgctaactaaaccttggacataggcagactacctctccaccctccccttttctcaattgcaaccagtaatgaactaggcctgctctcaacagtgaggaagatcagacccttggagagcactggagaccagctgctccatttggcttacttgttcccaagaggaagaagggtgcaggtgggcgacacatgcctggtttatattttgccaaaaatgacagtcaaataattcatcctactttcctatttccagctctcatgaaaagcaaaatgaattaacgggcagagaaaggccagaagttatatcagtatcctgccataggaggaaaaatttttcaggtggagataacttatttcccatttacttaagcttcatctatttttaaagagaaaatgaaactcctataaacattttcatgaaaatagtagtctctgacttttaaattatttttgaagagattctgagaaatgagaatttggaatatgagtgtttgttggctccctggaaaat

SEQ ID NO: 10309 - DNA, 1023 bp, Homo sapiens
gccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccatgatctggtttttgcatgtctcctctagttcatggcatgacagtctttccctttggtttagccacatggttttctttcagttttggaagactcaagggcttcttgcctaagggctttggccatcactgtctcatttgcctggagcattcttcatacactgaaagactggcaccttttagtctttacattttaacttaagtgttaatcattttagagatggcttctctatccatgggattcctcctaggggctctctctctctcactgtttcactctctcatactcctaattacttattatttccctaaacccttatcacaatttgtaattgtacctttatttgcttagcttttaaattacattacaggttgtaagctctgtaatggccaggaatttgtctattctgttcactatatacctagtacctagcataatgcctgaggcatagagttcattaaatatttgtttaatgatgaattcatccaaaaatgaatcacaatgagcaaatgaatgaacagagcaataggaatgagacagcttgaccttaaaaggctattgagaaaataacatatggaaatgaacacaaagatatttaaaaaacaaaagacatatacatgtactaagctttcgtattatgttaaacttactgtattctgaactgtttcattgcttcatatttcaatttgcttttgtgctataagaaaatttatggcatttcacaatttagatttacttgccactcttgctatgattgatatgc

SEQ ID NO: 10310 - DNA, 1054 bp, Homo sapiens
acagaaaagtaaaagcaagaaattagaacatactaccagagaaaatcacttttacacaaaggaagacaggaaggaaggagggaagagaagaccacaaagtaaccagaaaacaaataacaaaatgggaggagtaagttcttacctatcaataataacgtttactataaatggactaaactttccaatgaaaaacataaagtggctaaactgataaaaaaaaaaaaaaaagacccaattatatgctgcctacaaaactcacttcacctatagagtgaaattaaagggatggaaaaagatattctgtacaaatgtaaactaagaaagagcaggaattagctatacctatatcagatagaataaattctaagataggaactaaaggaagagacaaagaaggacattatataatgataaaggagtccatttggcaagaggatataacaattataaatgtatatgcacccaacactagagcacccatatatataaaacaaatattattaaggctaaagagaaagaaagaccacaatacaatactagctggagagctcaacaacccatttttagcattgaacagatcatccagacagaaaatcaacaaagaaacatcagacttaatctacactgtcaaccaaatgggcctaatagatattatagaacattttatccaaaagctgcagaatgcacattctttctttcagcacatgggtcattctcaatgatagaccatatgttaaagtacaaaatgagtcttaaaacattcaaaacattgaaattatattaaatatcttttctgaccactatggaatagaactaaaaatcaataagaagaggaactttggaaactatacaaacacatggaaattaaacaatatgctcctgagtgacaagcaggtcaatgaagaaatcaggaaggaaattttaagattttatgaaacaaatgaaaatggaaacacaacatacataaacttatgggatatagcaaaagcaattgtaagatggaagtataccaataagcacctgcattaaaaagtagagaaatttcaaataaata

SEQ ID NO: 10311 - DNA, 1045 bp, Homo sapiens
atccagcactcatttatgattaaaactctcagcaaaattagcacagaagggacataccttaaggtaataaaaactgtgtatgacaaatcaacagcaaacattatactgaatggggaaaagttgaaagcactccccttgagaattgaaacaagacaaggatgcccatttccaccacttctagtcaacatagttttggaagtcctacttagagcaatcagacaagtgaaaaaagaaagggcatccaaattggaattaaaaagttaggtagggctcatatagaccaaaggagcagaacagagaacccagaaataaagccaaatacttaaagtcaactgatctttgacaaagcgaacaacaacataaggtggggaaaggacaccctattcaacaaatggttctgggataatcggcaagccacatgtagaagaatgaaactggatcctcatctctcatcgtatataaaaatccactcaagatggatcaaagacttcaatctaagacctgaaaccataaaaattctaggagataacattggaaaaacacttctagacattggcttaggcaaagacctcatgaccaagaacccaaaagcaaatgcaacaaaaacaaagataaatagatggaacttaattaaactaaaaagcttctgcatagcaaaagaaataatcagcagagtaaacagacaacccacagagtgggagaaaatctttgcagtctatacattcgacaaaggactaatatccaaaatctacagggaatgaaaacaaatcagcaagaagaaaacaagtaatcccatcaaaaggtgggctaaggatatgaatagataattctcaaaagaagatatggaaaagaccaacaaacatatgagaaaatgctctacatcagtaatgatcagggaaatgcaaatcaaaaccacaatgagataccaccttactactgcaagaatggccatatttaaaaagtaccagatgttgacatggatgtggtgaaaagggaacagttttacactgctggtggggatgtagactagtacaatcattatgga

SEQ ID NO: 10312 - DNA, 1057 bp, Homo sapiens
cttttgcattttctgtaagtcaaagtaaaatagacaatttactaaagtttttttttttaatttaaaattccccaattaaaaaaattagctgggcttgttggcatgtgcctatagtcccagttacttgggaggctgagactggaggattgcctgagcccaggagtttgagactgcagtgagctgtgattgtgccactgaactccagcctgggtatcccatatcttttttattttaaaagaaattccccgtagggacaattttgaccttggataagctatagactcttgatattgtaaaatattaattaatccaggaggcataaatagaatgaattccagaatgagaaatagaagaatactttttgtgtttaactactgattaggagtttgctatgaagcaacttagtgaggaagacgtagagataaaatgatctgttaattgattttattttacatatctattgggagagtacaaagcatatgctaatgacttgatactagaaaatgtgtgaacttctgggtttttggaaatctgctcaagtgtttttatttatgatagaatatttgatttctcccttaggcctattattgtttacttttgtgggtagaagaatctagtcagtgaggtatgcacaaaacattggattttacttatttatttttaaaaaacttcaactttttcttagattcagtgagtacatgtgctgatttgttacatgagtatattgtgtgatgctgaggttttggatatgaatgattctgtcacctaggtattgagcatagtactcaataggtggttttttagcccttgccccactagtcccttgcgtagtgtctattgttcctgtctttatgtccatgtatacccaattcttagttcccacttgtaagaacatgcggtattttgttttctgtttctgtgttaatttgcctgggataaacattgggtttttaaaatgttggattaaggcattctgttcattcatgcctttgtcaataagtaaatttctcactgttctgtaaaatacatttactgaactatacgaatactatacttt

SEQ ID NO: 10313 - DNA, 1028 bp, Homo sapiens
ttgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctg

SEQ ID NO: 10314 - DNA, 2159 bp, Homo sapiens
aaacagacttgtgctggtcaagaatgtatttaagatgcctcttctggttgaaatagctattaatgtgtccccttattcagacttgcgtgtacctagctcttctgtccccagtgtggacatggccttggatgacatcggttccaactgtacactgaaacctgcttatagagagacagtttggagacagtgaaacaggtgaagttgaatggaagttccgagttgtacaaggtgcaaattggaattccgattttagggcaacttttcagaggttgacagttaagtatttggggcatgcacaaatgtgatagttattttgctggaggtgacaggtatctcttaaatatcaacaatgccttttagttttcagtatgagatatagaaacagtctataatggagtaacattttaatgtctcaccattagagaagttggaaattaacatacatatgagactcctgcgttttagttaattggagaataagaatggctaatgtttctttgaggaccagcagtgattaccctatcactgagattgaataaattgttgaacatctttatttttgttgtattaaaattttaggttaaatttatatatgtatgattagatattgaaggttgtgaaatgtgaatgaaaacgtgtaaagtgaggcttcacaaagaatcttattctctgtgtttcaaaagtatttgtcctattttaaaataattttttaaattgagtggttctggccacttaaatgacacgattggtactattttcctaaggtgggatttattcccttgaatctattaaccagttgtataaattgaattatggtgtccttcagtgtaagaggcattaagaaattctttgtgaaacatcactgcttgataaagtatatacgtatttagcatccttgtttttctttgtgctaaagtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaat

SEQ ID NO: 10315 - DNA, 1030 bp, Homo sapiens
cttttcattccaccctcataacaacttttcaagggaggttcaattatcgcaattttacggatgaaaaaaaagggagactaagagaggatgacttgtccaaagccaggaaggtttggagaggcaaaagtgagttttgaacctaaggccctgggtatgccgcctacacaggcccccacacctggtttaatgctcactgttgctgtcgcgaaattcttatttattttttaacaagcggccccatattttattttttgttctgggtactatcaaggaagtagctgggcctgttttctggctctaaaacccgtgctttctcccagtatacaaactattcttcttaagagccttaaaaaggcattgttttcttcctctgtgctccgtggtactttgtattccactctgtcagtcctcatatttaatctgtgacccagagcctattaaggggataagcaaccagtttatctattatggtatgttgctctattaagtgatgcttatcactggaacaaactgacaaaatgtaaatcggcctcctccaaactactgcctttgaggggaaatttaaacaacaacactgttttctaaagcagacctatatccctgctgaatttttctgcaacatcaacaaacagtagctctcaaacaaaagcagaacagagatcctaaaagcaaataatgtatgagtagtgccgtgtagctgataggtgtgactttttgttccttaaactgtgagctcttcagggtgccctaaggaacttgtctggttccaaaaaattatgaaagagagcttgaaaagaggagagctacaggagaaatgaactgactggtattttcagaatactgactctgcttcagttagagaaaatgaattcaagttagtttgtttctagtaaacaaaatattaatagaaaatctttgtcaacctgactccatatattaaataattatttaaagaaagttgtttgaaggagtacctgcccaggtgcctgctgttctactcagccctcctttccccagatacccatgaggt

SEQ ID NO: 10316 - DNA, 1917 bp, Homo sapiens
tgataatactgactttgttttataaacagggtttgtgataagcatgttgtgaacacttctgggccagttaaatggtaaagaccacaaagcatttttatttatgagaagacatcctacaatacaatgaattaacatacccactttttttttccagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaagga

SEQ ID NO: 10317 - DNA, 1052 bp, Homo sapiens
gcagaaaggcagagagagaacaaaagggggcgaacccactcccttgatgagaacctaaatacctcttaaaagtcctaactctcaatgctgtttacaatggcaaccaaatttaaacaagagttttgtagggaacaaacactcaatcaaaaccatagcaagtatgtaccatgactgtatgtgtatttataaaatacattcatatatttctacagcaatatatatgaggtacatttaagcatgtaaaaataggaatttttaaaaataggacagttgtaataatttctttgtacattccactttggagactgtttttatatggagcttgttttatcaccaaaaggcattttaattttgcacactttagaattcttacaatgtgtaattgactgctagttgctgaacaaaggacagataaagtgtttcctgcacctgagcagcctaaaggtgagtgtaatacagatgcacaagtgactggttgataatggaatgagaccccttataagaaagacataacagagcacggcagaggagcaagaacaacacagaggcaatgacatttgagctaggcctcttatatctgtagatgaacatttgatggtaggtagtagggaagatggaactaagaatatttgagctacttaatatatgccaggcagcatgctgagtgcttgtgttcatttaattctcaagacagccataagcggcagtacaggtattgggcctattattctaaatcccattttataagagagttaggattagattcagttccatctttctacaaaacctggcactgtcattccaggcaaagggagtacaatccatttttctcttaagaggttgattttgccaatgagacagaatgaatctctacagcattgttaagtttctacccagtcttttgggtgactgaaaaattcaaatgtaaagatgtggcaaaattggttctctaaggattttaagtacagccaaatgatatgtcacaagttttttcctaaatatccaaccatttagtctttcataagcttttaattccactagcctcactttct

SEQ ID NO: 10318 - DNA, 1022 bp, Homo sapiens
tggattaaaaaattattaagggcagagatcatccatctctttgtatggggtaaagtaaatggtagtttaaatgaaaaatgaaattccatcaaaatggaatcttttaatcaaatctaatttctacagctgttcccaaaattcttccttgctctttgaagtgtttgttttgagagctgttacttacctaaggcataacttgtagctcttggtctcttgcctgattactattatatcaagttaacatttttgagagagctctagccctctcagatacctttatcttgttgccatttagtgagacattccagtgtgttgtgtgtcttacattttatctaggttactctaagcactgcattagtgcttgtttatgaggaagcagctaacaccttccagatggctgttagctcagacttgattcaattcttcaggaaattgtcattatggctttaattcagtagactgcgctgtagctttgaacttatgaattcctatacacatacccttttctccgtgtgtgtgtgtgtgtgtgtgtgtgtgtgtgtgtgtgtgtgtgtgtgtgttgagtcatttttctgtattttttagatattttcatggaattgtttaacaacagatactattgtttttctgtttcatgcctaacattgtagctgtctttattatgttgttctacattagtgcatcttcctagatgtttaacttcatgataaattctaggtccttgtggttttccttttgtttctcttctgtgcttcctcacagtcttactatttggttacttggtacagattgctagtgtgtctggaaaggggactcctgctttctcttactggtgctttacataaattgaaatgtccattgctaagccagtagttcataaactaattctttagttgcaatatacagctattatgttattaagcatgaagacagttatagtttcaattttcttctgaaagtcattgtgatatgaaataacactttttaaatgaatgtttatatggcagtttaggtatttttga

SEQ ID NO: 10319 - DNA, 1032 bp, Homo sapiens
cttgggtacattatgtaatctctctttgtttcctcatctgtaaaacagggataataataactatgtcatagggtttatgtgaggtttaaataataccctgtttataaagcccttgcttagtgcttagtagtgtttaataaatggtagtagttactttgacaaaaaagtatgagtcctaatttattgtgaaactaccaccaaaatcaattaacaatccacccaaattttgtaaaaggtgtttggaatgtctttctgtccccaaagcttgttgatcttgtacttttcaattaatttattattgtcctcttgagatttaacctgcaggccagtggtttctaaatgataaactgtggattggtgctggttagtgagaaagttttcactgggccttggtgaaatggaagagtaagcaggacaatgtaatgatatcataaagttaaccttaactcagagctcagcgcctgctctttttagcatgtgcgcacgcgtgtatgtgtgtgtgtgtatttctgtaaactttctcttttagaatagtgatactagctgggtctttttgttttaaataacttttaaaaattaaaagttggcgagggccgggcgcggtggctcacgcctgtaatcccagcactctgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgcagtccgcagtccggcctgggtgacagagcgagactccgtctcaaaaaaaaaaaaaaaaaaaaaaaaaaaaaaaaaaaattaaaagttggcagtcctgatagtttcacaaaaagtcgataatgtgcattgaaattatgatgtaaaactctaaccttgttggtgtatgtgtttcaggcatgcagtaattacttaaaa

SEQ ID NO: 10320 - DNA, 1050 bp, Homo sapiens
acttttatttatgcttttataatctattcacacaaagaggtggcgataaatggtgatattggtataatacctaaagataaagtgatgagtttatattttacgtatttacgaaatggaagatagttaaatcactgatttatactaataggaatatagctgttatctctgggccaacttttcattgtgtaaaaattatgattaaacacatttatgaggcatctaatggttcaagaccctttatagctctttgacatatggatatgatatatatttcaaaataccatttcattagatattaaacgtctgtcatatctgtttcctggttttaaactctgtaatctggaacacagtgacagagtttagttgccaggtttcttggtattgaagcctaccagactaactttaataatcttgttgtctaatttaagctacttaacatggaaatataatattgccaggtaaagtaaaacaattggcattttctgaacctcagagtggcttaaagtagttttaaaagtcagattctggtttgaatcctggctctgttagttcttaactttttttgagaaaccttgttttcagatgagactgtggttctcaactttaacatcagaagcatttggagagtttattaaactacagatatctgagtcccaatcctagagttttgattcagtaggtggggcctggggcccaagaatttttgtttttaagatgctcccaggtgactaggttttagcacagtgcattattagcacatgttaaatgttccatagagagtggtgagttttttcctttcactttgttgttgctgtttattaactcacccttaaaagctcatctgcctgcctactgactcctaatagctgagcctaatagctcagtgtaagttttactacgtgaactgcttgctgtatgcatgctcagttgctacctgctccctgaaatcttagtaggtgtttgttgaatttagttcttttttttctttcagctttatgatttgtttgctcatgtatgctaccttctttaatccccagttaagtaacattg

SEQ ID NO: 10321 - DNA, 1029 bp, Homo sapiens
gagacagggtttcaccatgttgagcaggctggtctcgaacccctgaactcaagtgatctgcacacctcagcctcccaaagtgctgggattacaggcatgaaccaccgtgccaggcctataattgcaagatactttcgtattaatttgctcaatcctcacaatagccctgtgaagtatgtagtagcaatgctgggactcaaacctagaatatctgacatcaaattgcatcatctctgcctaatgccagttcatggggttgattattgatattttatattttaatcactttattatgttttaagctaattcctcagactaagaccatttaacctagcaaattgaaagtaacagaaatcatttcatatcagtctggtaacatgatttttgtattgggttaagaaattacttgagttattctcatgttttcttatgaacctttttttaaaacagcatgaagaaagaatttgtatagtgagaaccttcctttggttctttttagactttctggttgtttcagaacttttgatctttcttttagtaataaaatttaaataatttccaaagggaaatgccgttattggattttagtactcatttttaatcctagatttgtactttgaattttctagtaagattttcgaagtagcagtcaaaacaataagtctcatttatttgagagaataacgaaaaaaagagccacgtagttcaggtgcaccaatttacctgaaatgtttatcataaaatttattggttttcttgcatttctgtcacaactatgttattcttcctttgtcttctgaattgtacctttttattggcttatttataatactaatattacataaaatttaaaaggtagtttttaccactttacgtgcttaagagtagaaactaatgatgtttggtgtgtggtaaaaggaaaattaataaagctcaaggtagttcttcaggttagaattctttaccacttgttttacttagcctagagttaacatttggaaagttaatgttgaggtttatagtgtggat

SEQ ID NO: 10322 - DNA, 1030 bp, Homo sapiens
attgctgttgggtcatgaataaaatactttaaataaaacagagctctaagactttgttaactcttggcctacagagtgtttaactgttttttgacttgaggcaaatgattattttatttgtaattttaaaaaatggtaaaactgctctttacacaccaatgattgtgaggatcagatcatttcatcttgtgaaaatacaagctatagaccttgctgtataatgtatacttttgcttttatggctcatgctttatgttcttttttagttctaaatgagtaccttgatatttgacatattgtgttgcctgtttttgttttttctgtatgatctctgcttcagttttcatgttccataatgacttaaaaatatgtgacatttcatagcaacttggttctctgttttagtagaaaaccagggggggagtttgaaatgtagatttaattgcagattcatttgtttatttctctggttttttcataacagggctgatggagttatgagaacaatgaacacagaaaaactcctaaaaactgtaccaattattcagaatcagatggatgcacttcttgattttaatgtgagttatgcttttgtaatttaagattttaaaaaattaggtcattataattcatgagaatttttaacctcaagttttcacagactctagtttttcacatcctgatatcctatatggctaaggattttttataaaatagtctcaagtcaaattactttctgatttttatgactgttttggatttatttctttagtgcttctctagctctagaattttaagatatacaagctaaagtggtgaaaggattgatctgaaaatatattttcttttgataatggcttttagatcttgaaaatgtacagggatattttttaaataaatagccaacttaatattttacttttgtctatttaatgggactcaaagcatggcaattattcagaagaagaagtttaaatagcagttataatagcttattatgtagctattgcccaagggcattgtgttcgct

SEQ ID NO: 10323 - DNA, 1065 bp, Homo sapiens
tcacgccatgcactccagcctggctacagagcaagactccatctcaaaaaaaattttttttttttggttgttgttgagacaggatctccctgtgttgcttaggctggtctcaaactcgtgacctcaagcagtcatcctacctcggccttccaaagcactgggattacaggcatgaaccacaatgcctagcctcacacatacagttttaaaaaatggaattgtactgtgtatttttctttactataacttttgacttaatatgtggtgaacattttctcctgacagcttttattttttgtgccatgcattcgttggcctcatagtatttcatagtcagactgtagtgtcatttgattaactcttcactcttggatatgtccacttaaattatgaattaggtcccttagcttcattagtattgttctaaaagccatctgattatttttgtcaatctttgtcattgtactcagcgttccatattctgtctttaagagtatttccccagttattaaagtccaattatgttggttagatttcttaaggtgtaagtcagcctgtgaagagcatagttttgagttaattctactggaagttatataaaaataaaacattgtgtttctcacagaagaccccatgaactttacagataaaattttaacagttacatcttaatttggaccatattttatgatccctttcacaaatcattggagtaagaaataagactgttcatttcatttcctggacattgacacttacgactaggcaaatttgcctgtgtttaactttgattagcctatgtctaatttcaacttgcatagttttgaaatacttaaaacaattttgctatatgaaaaaaattttgctgatacttcatataaaagttccttatcctctgtttactattttttgatgaatatgctttttgtttctactcccaccaaggaaaaattacaaagatttgataagtgaagcaaaatttgattaaccagttaatttgccttgccttccatattaattttatctccaattttctttttttttcttttttttttttttttttga

SEQ ID NO: 10324 - DNA, 1039 bp, Homo sapiens
gaatttaacaaagttaagaatgagtgttattaattaaaacaaaaatgggacatttaggttatagttgagaccatgttcttgttttttaaacgtgagatgtttttggacacagaggtgaaaaattctaatgtctctaactcccccagaagaccttagattgatttttctgagaagaaatttgtgaatgatttgcatagagattttctttgaggttaagaaattagatgagtttcccggggtgaaaaaaacagaagcagagattattgttaaaaatggtcatgggtagaggggttagagggcaaagtaggcagaatagaagcatgtttgtgttttaaggaggctaagaactagaatatagcactcataaaaggaaaatgcaaatgcactgtgaatagctgctactggtagtgtattaatttcttagctacatgtaaacttttattagtgtgcttataactaaggtgatgtgtaatatgtcatccaaacttgggtcacttttaagagtgaaagggtgtgctatctgaatgggaccctggacaacaggtgtgaaccaggactgttccagcaaaaccaggacggttggtcattcctaactaataacgtacttttctccagacttagtcccaattcctttaacctctccagaattatctataaataattatagatattataccataaatgttttttcctttatagtactctgatctgcacttgcagagcctctcagttgttggtttctttttccctgtcttgttggaaagaaaggagaatttttctgcccccactctggaccctgcttgggttcacagcattggtggaggtaagtagtattctcaatgtattgttagttgactttcattttgcttaggaaatgaggtttctgtatttttctgatccagtactagatttttttttttttttgagagtcctgatgatatttaactgggctaacgaacagttagtaagttcttagcatgtaatacaaaaaagtgtttgtaattttggcatttgttcttaaattacttgatacttaata

SEQ ID NO: 10325 - DNA, 1049 bp, Homo sapiens
gttgcccaggctggagtgcaatggcacgatctcagctcctacaacctctgcctcctgggttcaagcgattctcctgtctcagcctcccgggtagctgggattacaggcgcgagccaccaggcccagctaatttttgtatttttagtagagacggggtttcaccatgttggtcaggctggtctcaaactcctgacctcgtgatccgcctgcctctcggcctcccaaagtgctgggattgcaggcgtgagccaccgcgcctggccccacacacataattttcttttttgcaattatttattttttttcccttttagagtacacatttttttgcaattttaaaattgagacataatctacataacataaaattcagttttaaagtagagaattcagtgttatttagtatgttcacagtgttgtgtgcaaccatccccattatgtaattctagaacattttccatcacccaagaaagagatcctgtatctgttaacggtcactcctaagctctcctcggcccccctgcaaccattaatccactttctatctatgaatttttctgttctgtacatttcgtattaatggagtcatacaatatgtggccttttgtgcctggcttctttcagttataatgttttaaaggtttgtccttgtagcacatatcagtactttattcatttttataggtgagtaatactcccttgtatagttacccacatttcatttataccttcattagttggtggacatttgggttgtttagccatttgggctgtgaagaatagtactgctatgaacattcacatacaagttttcgtgtgaacatattttcagttctcttaggtatatatctaggagtaaaattactgggttatatggtaattctgtgtaactttttgaggaactaccaaactgttttccacatcagtgacactgttttacattcccatcagcaatgtatgaagattcctgtttctcctctactttcttgccaaacttgttattttcaggattttagttttatgatttttaaaaaatagtcatcctagtg

SEQ ID NO: 10326 - DNA, 1980 bp, Homo sapiens
ggaagcctgttttgatttctcatttggactttggccgtaaagtttgcactttaaaaaaaatgtacgaaatgtagattcttccaagttactgtgctcatgaatgctgttagaacaagtttttgctacacagaagcctattattctttgtgattgttcctccactgtggaaaaaagttttaaataaaaaagcattagtgcttgattctttcagatatgcatgcaggctgcttttaaactctcagtccttgcttgtcttagagaatggagaatatgtttaaatggtgacactcttatgaacagaaaactttttaaaatgcatcgtaaagccatatgtgattttttgattatctgatacgtgtagtagacgtttctgctatttacggctcttcaaatactacttggtttgccctaccaaatcttacagtttgtcctgacactgtgttaattcttttgttagttgcttttggtttttttttgttttttttttttgtatgggagtatgaagaaactagttgtgactgtgtgaactattttcctctttcctcattcaaaataagaatcgataaggcttttaaaagttttttttgtaaaggtttgtgtcttatttcaaatgtagcagtggttcttttaaagcattgtcaaaaagaggagaaaataggtagggttagaagagtgctatttgcatgttgtttcataaatgttattagctatttctcttgttatagccactactgcagatagatggtaactgggattaggtttggaggataatcttgcatttgtcgttctttttctctaccacttctgtgtttacaagctcccacgtttttggaacttgaatatacctggtagtatttgatttaaaaatatatgtgtcgttaatgtgcttctgtttcttttcaatgaggttttaaaatacagggatactattttccctacattgttgattaaaatgtcctgtaatcagttctcactaataaaatacctttatcttaggtaaagtctgaccagtgagtggtttactaaacaaataccttccttgcacacactaacatgctttgagaaaattaaaaagtcttctacggacagttcatggtgttgacatcatgaactttaggctttaatacagaaacctgtcatttcaagtaattttttgtcttttaggaatttttctttatagtgaaagcttagtttatgtgcaccttttaatgcccctagcaactgatgcttatttatatgaatctaatgaaaatgatttcattttaaaatggcagcatttaacaaaaaatatgcttaggactgttgtttttcgtataagcccttagagtgtggaggtggtttctgtcagtttctcgccaagatctttccacattaggaagtgattattaataattcatgaattatggcttaattcatactacattatatacttactgaagaaagatttttttgctttgcttatactgtaggtgttagtggataatagtgttgactagcatccctagtgtgaaagagttgtcaaacttgaaatatgtttgtaaaaataaacacgatttccgtttaatcttaggcctttagtagccataatcaaggtagaggaatagcagcccttatatttgaagaacttcagttttccaggcactttctcatcatctcatttaatcctgtctcacagctggaggtgggggcaattcatatacatagaaagtagcttctaattccatttagcagtacagaatgcttaaaagaaccataattattgcaggatagaaaaaacaaattttttttttttttgagacggagtctcgctctgtcgccaggctggagtgcagtggtgcgatcttggctcactgcaacctctgcctcccaggttcaagagattctgcctcagcctcttgagtagctgtgactacaggcgcatgccaccacacccagctaatttttgtatttttagtagagatggggtttcaccatgttggc

SEQ ID NO: 10327 - DNA, 1018 bp, Homo sapiens
catgtaagacatgcctgcttccccttctgccatgattttaagtttcctgagggctcccccagccatgaagaactgtgagtcaattaaacctctttcctttataatgacccagtctgggatagtatcttcatagcagtgtacaaataaactaatatattgtccctccttcttaatttactgtgaatctacaactaccctaaaaaatcatctttaaaaaaagttcttactgtaccatttacctcctccctggtatcatttacctaaattgtaaatttgcattgatttgtgtgattatttgattaatgtgcatcttccccactaaacagtaaattccaagatgtttgttcaccgtaagttaactagtgctcagcatatagcagggtttcagaattccttgaatgactatacataaatttacaaatatagcaaatgtttttaaattcattaagccattatcttcaatgcatctttcaggatgatttgagaggaaaagataggagtgatgcaggggaagagaaagaagcagccattcctatttgttttctgcggtcatttggttaaagcctaagcaacatctctaagttacaatggtttgataataatgagtttgcattcctgcagcacctctcttctcctgtggtttgcagacagatctcagcctcactttggggtgactcttctacaaacgatgctaaaaacagatcttgtcttgctactaaccaagcctaatgagttttctctgagaaggtgccaggtccccttccaaagtacttaccctgtagctttttatgatcatctcattttcttaatacaacggcatgatgtcaaaggcaacaaaatcaaccgtctttgcatgaactctcaaaaggagccatttagggtccctgcatctcttttctctaggtaggcaaaagggttgtgatccatcccagcgagtggtgtgggagtggctgtttttacctaacctttattgagcacttactttgtgctagtccgtttattgagcacttactttgtg

SEQ ID NO: 10328 - DNA, 1034 bp, Homo sapiens
ttctacatgaaggtgagaagccttcttaaagtctcaagggctcctttgagagtaagggagaaggaggtcaagatataagcactgatcaggaagtaattttggcagaattttgagtgagaactacttaggagtatccagtactcctggttaaacattttcctgggcttcactgaaaaagcctgaaacctgtactttgaaaatagaggaaggggacagttagctttaattagatttcatctgaccatgatgaaagtattaaaattgtacaagtaggatatttacagggcactttacattctgcccatttttttcactagtcaaaagagactgaaattcagtatgttctcaaattagctaaagaaaacccttgtcaaagacccctcaatccatctggttatcattattaaagcattatggggtatgtatgctttccattggaaaaaaatgaataatcccttcaaatatgtaatttcataggttttgaaatacgaaggcaaccgttaagggaactatcaaagcagtctgaagtacagtgtgagttgtcaagggaaaaatataaaagaatttttaataactgaaagttcaacaaattctaatgccaaagcctgggattgtgggaacacttgttggaatttctaaagactgttgtttagtgcatggaggcatctgaacccagaaggtaaattctgaaacacctggaccatattagagtgtctggggccgagaaggtatggtgaggggcccacccagaggtgccctctaacacaacttctttccccataacagcatacctgggagcttctgttcttctggctgtggcattttgtttcaagagcactgcaccctgtgccagccttgcctcttacacatcaacccatatgcagaagcatttccccttaagtagagtgtagtagaaatagtgagggcctggagtcaggcagatcttgagctagatcccagttctccacacttcccctcatgatctttgtgaccttgagccagcacagtgcctggttcataggagacactcaatc

SEQ ID NO: 10329 - DNA, 1050 bp, Homo sapiens
ctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaa

SEQ ID NO: 10330 - DNA, 1028 bp, Homo sapiens
atttttctatgcagttttattttcaatccattagaaaggaagtcttttgcacaataataagtgaaatactctcaaggtaacaaactaacaccttaacaatactgggaatctggtcgaaaactaagtcaccttcagcacatggattagaatcataaactgctccttagaaccaggcatctgagtcatttaatgcttaggtaccttgaaagagagaaactcccttagccaatttttctgtgttctataatctcacaaatgaagatgtctctccaattcctaaaataaacaacaaaaacaacaacaaaactactagctttataaattacttttcaaagtgggatttgacaataaaacaattttctgggtaattggctgaagtttggaaatctttatattgtaaagagacatttaaaatggcataattacgtggccaaagcatatatgaaaagtcattcttatggcagatgggtaatgcttggctctaggttgcccattaactcacgctgaaagatgactgatcagatcttttactcatctatttctcagtttctgcatctgcagaatgagcttctgtaagtctgcaatgtatctgagagtgcccgtgttattctgctctctttctatctctacacaaaccaaatgaaacttccagtcctcaccagtggcttgttccgaaacaagaaatcagaataagggtacaacataaaacaaagtgtccatagggattgttaattctttatttgtgtcttgtttggtttttaactgacaaagcacaggacatgaccctttttttttggttgggttgggggcaacagacatccagtaatcaactttggttaatttatggcaaaaagtaatttattggaaaactgtgggttcactcacagaattaaggaaaaaaattgaataacaaggctcagagaggatcagacctaggaaactctgggatttagacagcagaaactaatgaagaatctcctcagggctttgctcagagatgaataaattatatcaatgaccagatacta

SEQ ID NO: 10331 - DNA, 1049 bp, Homo sapiens
caatggaacagaagaacccagaagtatttccatacaaatgtacccaactgatattttgacaaaggtgcaaaagcaatttaatggaggaaagattactttttcaataaatgatgttggaacaattggacatccaataaataataaataaataaaaataaagcttggcctgtctcacaccttctacattaattcaaaatggaacttgggcttacatataaaatatgtaactatcaagcttttagaataaaaacataagaaaaaatcttgtaagtctaactaggcaaagagtttatagacttgacaccaaaagcacgatccataaaagaaaaaaattgataatttggacttcatgaatatttttaaaatttgttctacaaaagaacctactgagaagatgaaaagagaaactacagaggaaaatatatttgcaacctacaaagaactagtgtttataataaagaattctcaaaactcaacagcaaataaaacaaatagcaaacaattcaattagaacatgggcacaagacataaagagacatttcaccaagatacagatagcaaataagcacatgaacgatataaaacatcattagctattaaagtgtaaattaaaaccactctgagtgaataaaaatcaattctaagtggagtgcataatgtttcattctatttacatatcattcttcaaatgacaaaattataaaatgaagaacaggttcatggatgcagggagtaggggtggggagtgggtgtgactataaaaggacaagagagatccttatggtaatggaaatgttctaaatcttggctatatccatgtcaacatcttgattgtattgtactataagttttcaagaggttaccactggggaaaacagtaaggctacactggacctatctgcattatttcttacaacttcatgtgaatctataattaattcaaaataaaataataataaaaataataattaactgtaactggttcttattccaaaaaaggaacaaaattaatctcaggacagaataacaaactctacagaaatctgtgt

SEQ ID NO: 10332 - DNA, 1072 bp, Homo sapiens
aaatgtcagttaggtctatttggtctggtgtgtagtttaactccaatgtttcttcgttgatgtcctgtctgaatgagctgtccattgctgagaatggtgttgaagtctccagttattattgtattggtgtctaactttctctttaataataattaatttgtatatttgggtgctccagggtttagtacatagatatttacaattggtatatcctttttctgaattgactcctttatcattatatagtgtcattctttgtctcttcttatagtttatgatttgcagtctattttatttgatataagtctagctattcctgcttatatttgttttctggttgcatggaataccttttccacctctttactttcagtctatatgagtctttataagtgaaatgagtttcttgtaggcagcttataattgagtcttcttaaaaattcattcagctatcctgtgccttttaattggagaattgaatcaatttagattcactggtattattgataagtaaaacttgttactgccatttcgttgtttgttttctcattgtttttaactcttctctcccttccttcctttcttactgtcatcctttgtggtcaagtgattttctctggtagtatgttttaatttgttgctttttatttttaataaatctattataggtatttgcattatggttactatgaggcttacaaaaaggatcttacagttatagcaagttatttaaagagatgacagcttattttagatcagaaagaaaagaatatcaacaaagaaataattttaaaactctgtaactccatttccccatatttagtctttatgttgtcttcatttacatatttttatattgcctatacttaacaagctgctgtagctattgttgtttctgatacattagtcttttgggtttcacagtagagttatgggtgtatttcacatcacaggtacagtattacagtattctgggtttgtccacttattttaacattgagctttataacttcagaattttatctccttttagcacttccttttaccaatggattttcattatttaagcttt

SEQ ID NO: 10333 - DNA, 1060 bp, Homo sapiens
atacatgatattttctttatccttttatcccttgatgggcaattaggttgatttcatattttggctattctgaatggtgattcatattgtaaaataagatattgtgataaatatgggagtacagctatatcttcaatagattgaatttctttcttttggatatataaccagtagtggaactgatggatcatatggtaattttatttttagttttctgaggaacctccacacagttttccgttagttgctgtactaatttacatccccaccaacgatgtatgagggttcctttttctctacatccttgcaagcatctttatctcatctttttgataaaagccattttaactggagtgaattgtctcattgtggttttgttttacatttttctgattagtgatgttgaggattttttaatatacctgttgactatttgcaggtcttcttttgagtaatgtatattcatatcttttgccaattttaaaaattggatgatgatgatgatgatgaatttgctattgagttgtttgagctcaacaactcaatattctctatattctggttattaactccttggcagatggatagttgcaaatatcttcccccattcagtgggttatcacctctctttgttgatagtttcctgtcaacaatggatacaaagctatgcaaaagctttttcagtttgatgtaatcccatttttctatttttgccttggttgcctatgcttttgagaccttacacaaaatatatttgccaatatctatgtcctgaagtattttcccaatattttcttctggtagtttcataatttttggtctttaatctatttttatttgacttttgtatatagggaacaatacaagtctagtttcattcttctgcatatccagttttcctagcactgttcattgaagattctgtcttttccctattgcatgttcttggctcccttgttgaaatgagttaggtgtaaatgcattgacttatatctgggttctgcattctgttctatttatctaggtgtctgcatttatggcagtaccatgctgatttggt

SEQ ID NO: 10334 - DNA, 1030 bp, Homo sapiens
actttctatttcattttggaaaaaaagtggatgtttttattatcgtttgagaaaggaaatgatattttcttaaaatgctgtttcctgtgatatatcacttcatatgtaatgtgttaaaaataagaacaaactcccattaagattctagtgctgttatatttaaaaagctctatttgggatcaaaaacgataatttgctgagctttatcttaaacatactttaaagggacaatggaccatgactgaatgaactgcatttcataatgtttgaagccaaagaaatcttcgttatataaacaagtaaaactaagaaatatacctacatatgtaatattgtcttaactgtacttacatatctacatatacattacaagagaaataaataacagaataaaatgcaaaaaaattggctatgattgtgctggatgacgaaactatgagatctattttttctactttttatatttgccaaacttcttgaaaatgcatctgcatgaatgtatgctaaaaaagataaaaaatatcccctcttttgtcggagtggtaaatgaaaactcagaattttatgtatgcattggcaaaagcacttatgatttactaataactctaaaaataaatcattttcttttttgcagctatatcttgcttcttcataaagtggacagtaacatacttacagactggtgaagagaagttcagaaaattgttgctgttcagcaataatagttcatatttcttaagcacttactctagtagactatatacaataactcagtactcagaacaaccctataaggtagtaccacttttatgtccattttataggggcagaagctgaggcacagagaggttaagaatcatgctcatggtcacacaactaacaaatggcaaagcaagaatgaatccaggcactttgacttcagggccaacaggcttattatgcctgcacttaccaaatgtctactatgtgctttgcacttttgattatgcaccattgcttaatggaaaggatgatgacctcagatctagat

SEQ ID NO: 10335 - DNA, 1021 bp, Homo sapiens
ggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcattatggagtttatgtttacttcagggaatttttatcactgactcagtaagattcacttatgttacctatgtaagcatttatttaagaaggaaaagcatttgaagatatttcaattaaaaacaaaactatgaacctttatgacagggagatatactcagataa

SEQ ID NO: 10336 - DNA, 1055 bp, Homo sapiens
gaagttggttatgaggcaagtggacctgagaaaaaagactaaaggggaagaatagcaagtaaaacagaactccacttgctagatctctccctctgtcgcgctctttcacctgacccactcccttattccccccacaccctttccttctctccctacgttaccgcacaggaacgaagtctgggtcatgtgcggaccgcttgtggctcttaaatcctctttttgtcaccctggccgtgcaaaattttgaaacgtccctcggcaaaaaaaataaaaataaaaaaaaaaaatctgtccctggcctcttccctagttctgggtccagttgcagccaagtgaggggcagcgcgcgctcccaagtccccgtttcagagacgcgcacgcgcctggcgcccaacccccaatcccctgctgctcagtgaccccgcccacgggtttccgggccggcgtagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgggtcgtcctttctgcccttgagcccctaacgcagcgccacgccaactaccgcttccccccaggcagacgcttgtgggtggccagagcatcttgactggattcggggacccttggggaccttcttccccgccaggctcgcgaagttaaagttcatctgctgagaacttctaactccacactttcttggttatcttggggactcaacactttgatcaagaacttttttattcctcccgcttaattttgtttgctttgagagagacttgggaactgcaatcgtttggttctccagtccgatctggtagcgttat

SEQ ID NO: 10337 - DNA, 1058 bp, Homo sapiens
cacagacccttgattctgttagtatcagtgataaaacatgattgataaaactaggcatgatacattcttaaggtacagaaaaatgtggaaattgtgtcaagaaaattcacaaattttaaatggttctttaggctgatagtaataaatgggatcattataattttatgtaaaaccttcaaaggcttcctactaaagaaagctgaattccagtaacagattgagcccagactactcagttcatatttgaggccaacttagactatttttgatgccttaaagattccttcaagtcccctttctctttctaccatacccccagtaaagctacttaaaatcctctgtaggaaagagctgagtaattgggggcagagatggaggacaaatttaagggaacagaaagccattgggaagacaaatgaaagccagaatctgaagataattttaaaaccttcagggaaagtaggtgtctaatcacaggacttaattcacttgagtagaaatttgtaatttagccataggaatttaggaagtgttagttacaagaggtaacttgaagctgtggacatgatgatagcttttgttgcataattagaatgtgccaaacactttgctaagtgcttatgatagcttttctcttcagaacatcaccatgattatttacagtataacctgtattttacagatggagaaatgtaggcaaaggaaaggggcataacttgcctccagggtcacatagatagcaaatgatgaaatttaattttaaaattagaaactgattccaaagtccttacactcttaaccatgaaactgaagacatctaagtcaccacgcaaaacccagaatctaaatggccatttattagtgcttattcctttatttcctaatattaattaaatgacttaattaccatgagaagataatgtgctttcagttttcgcagtagttagttcagccattgattttcttactaagaacctctaaaaggccaatgggcagttgacaaaaattagggatggattctgcagctgtaagaccaagtgaaagtaaaaggcccatgg

SEQ ID NO: 10338 - DNA, 1078 bp, Homo sapiens
ttttcctagggattcagtcaatcatgttgatcttccatcagactgatcatccttactccatgctttggctctagcttttccatgagttttctctattcagggagggatttcaaatctacatcttagatgcagtctcaatctaatttcatgcagttcacaaaaatctggcggagtaagttttagctgaaagaacagtttttctccctgatgagcatcttcagttcacacattcagagtgattgtataggttctttacagacttgctaaagcttacaaagaactatgaacagtctttgctgtaccaaaagtatttcctttcatttcattcctcaggtgttcactgagcatttactattaatatatgcttccatcatatcacatggctgcagaacatttttcagtggtgttctattgcctgtagaataaaattcaaacttctcagcctaatgttccaggccctgctacacttagtctgttacccctcctccccaatttccaccaacacacacacaagcagacagacagacacacaaacacacacacactccatatatgaatgctattccttcctttggactttgcttattctgtggcaactgcccagaatcctcctcccattcttatgtatatgaactcccaccatccttcaaagacacattttacatggactgtgtagtgtgctggtaaatatttcccaactaggtctccagaaaacaagcaagctgatttgtattatagcatttgttgattttcataaagtaaatactcccactacagtcattttcaatcaaggtgatgtaactgaacatagagttaggaagacattggccaggtgtggtggctcacacctgtaatcccagcactttgggaggctgagttgagtgaatcacgaggtcaggagatcgagaccatcctggctaatatggtgaaaccctgtctctactaaaaatacaaaaaattagctgggtgtggtggcagccgcctgtagtcccagctactcaggaggctgagacaggagaatggcatgaacctgggaggtggagcttgcagtgagccgagatcgtgccactgcactcta

SEQ ID NO: 10339 - DNA, 1033 bp, Homo sapiens
aatcctgtagtaaaagatcataaagatatttataccttcacatcagtaatcctgctcttgtgaacttagcataaagacatagttcacagaagagagatgctatgcctaaaggtgtgttacagcattatgttttaatgtgaaaaattggaaacaacctacatgttcagcaagagggggatcataaattacgataacctagaatacaatgaagattatattacaacaaacgtatactgaagactgataagttgggaaattaaaaaataagtaaattttaattgcaggtctacaaaatatgcttctgggccaagacaaggagatttgtggaaaatggaaccatagtgtcaggataaagaaatgggttttactgtttttaaatgactagtgaaaggaggaatgtgagagaaatggttttggggacaggaagtttataaagccttagtagtggtatgtgcttctggcaagcaacagaaagaacacaaaggcaaaacacacacacacacacacaccccaaattagggataggactagctgcatgtgaattgcaatgaaaagccctgtggggtacttgatggaggaaaataaagatggttggtactactttaattggtagaacaaggtactactctgttatttaaataccaatgcacaacatttcccaaagaaacctttctttatgaattctggaagaaaactttctttgggaaaggttgtgcattgttttattttaagttccagggtacatgtgcaggatatgcaggtttgttacataggtaaacgtgccatggtgatttgctgcacctgtcaacccatcacctaggtattaaacccagcatgcattagctatttttcctaatgctctccctcctcccaccccacccccaaacaggccccagtgtgtgttgttcccctccctgtgtccatatgttctcattgttcagctcccacttataagtgagaacatgcggtgtttggttttgtgtcccctttattagtttgctgaggataatggcttccagttccatccatgtcc

SEQ ID NO: 10340 - DNA, 1047 bp, Homo sapiens
tttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagttatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagcttaattttagtgttgaatctatttgattatattttaatacttt

SEQ ID NO: 10341 - DNA, 1084 bp, Homo sapiens
caaaaagaacaaagctggaggcatcacactacccaactctaaactatacgagagggctgtagtaaccaaaacagcattgtactggaacaaaaacagacacatagaccaatggaacagaatagagagcccagaagtaaggccacacacctgcaactatttgatctttgaaaaacctgacaaaaacaagcaatggggaaaggattcgctattcaataaatggtgctaggataaccagccagccatatgggatagactgaactggaccccttccttacaccatatacaaaaaattaactcaagatggagtaaaggcttaaatgtgaaaccccagactataaaaaccctggaagaaaataccattctggacataggaatgggcaaagattttatgatgaagactccaaaagcaattgcaacaaaagtgaaaattgacaaatgggatctaattaaactaaagagcttctgcacagcacagaaaactatcaacagagtgaacaggcaacctacagaatggaagaaaatttttgcaaactatgcattgaacaaaggtctaatatccagcatttaaaggaacttcaagaaatttataagaaaagaatctcattaaaaagtgggcaaagggcttgggaggccaaggcgggcagatcacaaggttaggagtttgagaccagcctggccaatatggtgaaaccccatctctactaaaaatacaaaaattagccaggtgtggtggcaggcgcctgtagtcccagctacttgggaggttgaggcaggagaatcgcttgaactggggaggtggaggttgcagtgagctaagattgagctgctgcactccagcctgggcaacagagtgagactccaccccaaaaaaaaagaaaaaaaaaagtgggcaaaggacgtgaacagacacttctcaaaagaagacatacatgccgccaacagtcatatgaaaaaaaaatgctcaacattactgatcattagagaaatgcaaatcaaaaccacagtgtgataccatcccacacttgtcagaatggctattactaaaaagtcgaaaaataacatgctagtgagcttatggagaaaa

SEQ ID NO: 10342 - DNA, 1032 bp, Homo sapiens
tttagagagtagtataatgaactatgtaaacatcacctggcttcaaaaattattaactcaaggccagtttaaaaaaaatctatatcccacatactcaggcacatctgaagcatattttatagatgagattatctgaaggtaatcagaatagttgcagaatcactgctatataaaaagttggatgtaaattctccctatagttttatgaatataatgtttgttttgagaaacagtgttataaagctaataccaagagagactccaaagattctgaggattctaagatattaaatattgccattcaggtagctcccagtttatttaatgcctaacatttgtagacttggggaaaatagaatcttgctgtctgctttgctccatagtttatgtttcatagtctgatgatctggtatgggagcaaaaccatttgtaaacatctatttatactaaccccagacaaaatagatctaaaataaaattttataacattttacttgggtttctgctctctgtgaattctcctttagataattctcccaaattcttacaaattttcacagctacaattattgctgttgtaaacgtaactacagattttcatgtttgtctttaactcatgagcactagttaactgttgacatttccttaggatctcaaattcaacaattccaaagtctgacatgtattttctcatctaaaaccagctttactttctcattttcctttttctttctgttttatcttcagttgcttaagcttgaaacactggagtgattccttttactttgtccttggttctctatttcaatcaataattaaggcatgttgacttttcttttatatttctcaaattcattccataaaggagactatacataaaacacctataatgctgcgtgacacagaaggcctcaggaaatgttcatttctttctctttctcccttgctgcactgccaccattcttggccactgcctgtatttctgctctggattatctccatagcatccaaactgttctctgccctcttgct

SEQ ID NO: 10343 - DNA, 1157 bp, Homo sapiens
aatttattgtagagtgtatatgttgtgattttctttgtacatgtgttttatgattgtaagttgatggaagtttttcccccttctttattctcctggtaatcctatgtaggttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcagggtaagtataaaaagtttttaactaagttcttatctttcttatgtaagtaaaattttgtttactgtggaggtaaaagtaatgatatgcaaagacccctacttcatatgtggcacacagtgtgcaatcagtaaatgttggtttcttttagggggatgctgctgagttagaaaagtatatgacatagagattaaacaggctttgtggtcagatcttgaatcttggtaaataacgcctctgggctttgtgacagtgcttcagaagatagtaatgcctaccctattagagttatgagacttaggattgtgttcttagtacagtgccaaacatgaaaccaggtactcattaatatatatatatgcaattccataatttcctttcacttctgaacttttatttgctgccactgcttcagtccactgccactacactagtctgtaatccctttacctgaagtatatgcaataacatcaactgatttcattgtccatagtctggggattcttaacccagtttccataaaataatctattgatgggattcagggattcttcaaatcccttaaaatagtttgcaagatttagtatttctgtatgtatgtatgtgttttgctgttgagcagttgtatagctttcatcttgcaaaggtgtcaaagacacaaaaaaggttgagaatccctgttctagtcactcctgatctaattaatcttatatattatttccaaggtaattgttgtaaaatcttcattagcaatttattaaaaattcttattatggatctgtgtttcatttccctcctctttgattttcaaaagttgtagttt

SEQ ID NO: 10344 - DNA, 1081 bp, Homo sapiens
ggtggtgtgtgcctgtagtcccagctacttaagaggctgagttgggaaggtcgcttgagcccaagaagctgaagttgcagtgagctgtgatcatgtccctgcactccagcctgggtgacagtgagaccatgtctcaaggaaaaaaattgccttttcaactatttttaagtgtatagttttgtggccttaaccacatcccctgagagatttttttttggaaccccttatgtgataaatgaggacgctgagacttacagaaacaaagctacctgcccaaagtcacagagctagtcagcttcagaggcaggatttgaacccagaactgacatactcagaaaggtcccaggttcctgggatctgtggtatataacagttggagtccatgatcactcttctgcctctgcccaccatttgacagtagaaagccatttgctagtgtatgtctcttttttgaaactctaggggttggattgtgtttgccagtgaggtggtggtcagcccgatttagggtgtgtggctgacgcaggtgctgcctgtcagcggttgccaaggttggtttgtgagctctgttgtgtcttgagaaggttgaagagtgggctgctgtactgagagggttgtgtgtcggaattctgtctctagaaggtcctcagcagtgcagtggaaagggcaatggcctagagctcagatatgtggccttgtcaggtctgggttattttggagaacacacattgaacttgggaattagtctgtactttagtcctgattgtgccgtgtggtagacatacttaggcttccatttcctcatttctcagtgagtgataaaaatgcctgttccacctgcctcccaggatggtggtgatgattaaatgtcatgatgtagggaaaaagtgctgaggaaaccacagggctctcaaggaagtttctctgatgagaattttgagtgtacaatggtgcgtgagaacagtggggctgaccttggagatgtgaggaggatggatgcggatgtgaagagcagcaggtttgctttatttcatttttgtttttggcagcagcttgtttcctctaccatcgcttcactggt

SEQ ID NO: 10345 - DNA, 1065 bp, Homo sapiens
tccctccaatgagtaccttctgataagttgtaagagacaaatcaactggtttgcttgtaatagaataaaatagaaggaaagcttaaatttacctgaaagaagcattttgcttcattctcgctcttctcttctagggttaaatttgcaaaatccatttcagcaatactggtatcagtggtgcttattaaagtaagttctggttcttccattataccatggccagtttctgtttcctgtgaaccacaattaaaaggaaaaccatgtcaaaatagccttaaaagacttaaactaatcgttttgtatataatgcacattttttgcaagtgtatataaatgtgaaaatggaggaagaaaagcaatgattggcaaagaccaacagatcagatttccttaggcttccataactccagcattcagttgtagaaatactggagcctactttggggaggggatgaaatagtgtgacaatggactgaaaggtatctaccacaatgattacaaacctaaatgcttgtagtgttgggcaaaaaatataaatgcaggttggctgtgccgaattgtatcctttaaagggagcaggggtcgactgggctgctaccaaatgtgggccactgactgctaacagataatgtttcaaaagtatctaaacacaacaagaacaaaagcagccacataaaacgtggtttagttgtaattcttattttcaatctgttatgtttatttgtggaaggataaactgcacatactgctagatgaaaaccagtcaccagttgactggtgttgaaagcaagcagattataagttgcttaatatgaggagcaggtttccaatacttattccaataatggatgaattcattgcactggaatgaggctcaacactgaaagtgctgaagcacaggcagaaccaccatttttcagggaagttggagaaaggatatctgaattgggagaaaaaggatcttttgtaaaatactctcagaagacagttttcaaatttttaagtttctgcattatgctggatatttctagtgatcacaagctggatagcaatattaacaagcag

SEQ ID NO: 10346 - DNA, 6511 bp, Homo sapiens
aagtttactgcaggaaatgcaagaaggaaaataattttttagagacttgataaagaacatggggttttcagtactatttttaataagtagcattctgatacatattattgctagttaggatgtcaaatgaaaaaataagcaatgttaatttggatttttaacatctacatgtagtctctaggttatctgaagtaatccagggcattcagctatatgtaattactaaactatttgagttattgcttaatccatgattttttgtttgttttatgcagggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaatttcatgttgatgatatacacaatggctttttgttttaaaggcttttatcttgagaacatggtgtctggagttaaaggtatgtctcaatttgagttttcacatcatatttgtttatgtgtaggaaacagtatgttgtcagagcaagtttcattttattcagggacatttctaccatgcttttaattcccatttatactgatttctgaaaagaagaatcctagattcacacattttatagtgatgtgtcagattcattttagttgcaagcattagagggtcctgaatttgttagtttgtagcaataatcagaactttggatttcctacttgaagcctacagcattattttgaattaatgcacaatctaaaatgaggcagaggattttatggtttaatgcaaaatatagtataataaaagatgattacacaggtcataagaattcataaatttgaatgatgtagagtttgattaaaagttatataatgccaaagtcgtaacttacaggcacattatattcctgtattttataatggatgacaattaattttgagccaagaattaaaatttgctgaaatcttcgaattgggaaaacaacatcctctgttgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggtaagattctctgtttctattgattctgcttgtttccctctatcagtagcactgccagcataacaagaacttcgtacaaatacactactaagctttaaagacttttacaatgcctcattctagagaatgggcactgttgatcatggtgtccaaaaatagttaatgtggctaaattgagacaggttatgcttccatcacagtatgcatattgcagtggtgacaatgagacctgtaacattttgctatgtttatgagtaaaaatgtaggagaaaaatgttgacttttcaatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctattgcaacatctatcaccacttaggagtaaaaaaaaggactaggcttacgttattatgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcactt

SEQ ID NO: 10347 - DNA, 1062 bp, Homo sapiens
ttctaagccaattatctgaaaaatacgctaatacttaggagtagacttttttaaatatttgagagttgtatgttgaatgaattcagaattaatttatgatcccttgccagaacctgaaattttatttgggaggattaatacatgttaatctcttcagttaatctcttaagtttaaggtgattatagtaaacattagaaatcttattcctgtttttacattttaaaatgcctttagtaagtcccagacatgacaagatatgtacttcacttttccatgttaccagcttaggtaaattcataattgtaatgtgaattttaataatcagcatttgataagtccacaagtggggagtagttaagatagcaaattcagagtctttgctaagggggggcattgccctttttgaacataggcacctgctgggtcttaaaaataaaatctcgacatacttatggtgtttttaatatatagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgtaagtggaatcatatgaaatactttggtaataggttataaattaaatttctatgttaattgcttcatattttgcctttaatatagttatacttaaataatgaacaaagatacagagtatgacaattgggattattacagttgagccaagcttggcacaccgttcatctagaattctccagaacacaaaattctcaaattttgtgtttcctttgactagtattgcagtttcagttatatttcagagtggaatatacaactaattaggtcatcgaagattctgtcatctcgatgataaattttaatattacagagcagaggatgaggatgcaacacatcttgaagataacgaatgtgatatcaaattggcagtaagtgacttatttttttcctattccattttgggaaggcagga

SEQ ID NO: 10348 - DNA, 1050 bp, Homo sapiens
tacaatatgacaaagttcagttgcttaaatgaatctaggaatgaagaatctaggaattataatggagaggtgattaggagtttaaaatggtttattgattggagatccttttcctggtttatatagggcacactttgctttaggaattccccctttgatcttggaaaacggcttttaattgtacattaatactgtattggtaattgtacgttaaaatatgtggctaatgataaaactacattttttacttatattgaaagatgcttttgttggaagggacggtacttttttggaatcttgttgcgttgaatacatttagagggtaacaactgaaagaacctgtgaatagaatttctggatttctttttaaagaaactgatctgaaatggataagaagcttaaccttggtaaatgatttcgcctgaaatcattggcatagtctgaccacgttcaacactgtagtagatactgtcaatatttagggaagctttgtcatatttactaaatttcataatttcagaaaactgtttaaaacaaagagcaattgatggataaatcaggaatagattctcttgaccatgtgacatctgatgctgtggaacttgcaaatcgaaggtgagtggattcaatcatgtttattgtatctgaattatgagaaactattgtatataatgagtgacagtaaagataattttcaggaattgggaaagaaggaaaactagatttcactgaccttccaagtttatctagttacatagattgatataatagcattgcaaatactttaaattcaaaatgtgaatatattatgggacacattcgtcgagaaaaaatgtattctttgggtcatattagcatctcttccagactacatcctccggttcggtaggctgtgtttgttttactcagacactcttagcagtgaaccgaaccatacagccttttggagctcatacattgtcttgaaagatacagtttttttgtaagctgagcatagtggtgcatgccattagtcctagctagctacttgggaggctgaggcaggagcat

SEQ ID NO: 10349 - DNA, 1029 bp, Homo sapiens
agttataagtcaggacttacctcttgcctttattaatttgctgtttcaattaagtttaaataaaactacatgactgaaggatactgcccttcccctttccttcaaggctgccatttgaagggcctttgctagtttttgttgatttgcttgaaagtgtttctcttaggcccatgacccctttcatttatttttttatttaaaaaattgttaattgtagcaaaagcataacataaaactaaccattattaagtgtacagttcagtagtgttaaatagatccatattaaacagatcttcagcactttttcattttgcaaaactgaaaatctatatccctgaaataacaagtctctgtttccccttcttcatcccctggtaactaccattccactttctctttctatgaattcaactactctaggtacttcatagaagtagaatcatatagtatttgcctttttgtgactggcttatttcacatagcgtaagtacctgaaggtttatctacgttgtagcctgtgacttacacctttcatttttagctttggctgctgctgccatgttccctgtatttaagctgtggtttaaaacagcttgagaggactcaactcaggctgccaagaaaaatggcagcaagagctcattctacctattaaatactaacatgttgcttccaggagggaagtgagcaattattgtttattccaaaacatctggatatatatgcggttatatgttacagttaaaaatttgtatactagttcatgttaactgcaaagacaaactattagcaaattatctattagacttcatttggatttgtctctggtttatttaagttttgtctttgatagcagcagaaaatgaatcaataaatgaaaatgaatttatatttcttaaggcatccattactcatcagagatagttaatttagctaacatttggaagtgctgataccaccaacaaagcctagcatcaaataatttcttttaatttcttttaatgtcttaaacacaaataaaaaacttat

SEQ ID NO: 10350 - DNA, 1068 bp, Homo sapiens
ctgtatttcttaatttgcatgtcaacctttctagcacgattggagaaatttttctggactgtatcctcgaatatgttttccatattgcttattctctcttctctctcaggaatgccaatgagtcataggttttgcctctttacataatctcatatttctcagaggttttttttttccattcttcttcattctttttcctttatttttctctgaccaagtagatttgaagaactggttttgaagctctgagattctttcctcagtttggtctgttatgttgttaatactttcagttgtattatgaaatccttgtagtgaaattttcaattccagaagttcagtatggttctttcttaaaatggctattttacctttgtaaaattgttttactggattcattggattgggttttaactttctcctgaatcttgatgagcttccctgccatccagattctaaattgtatgtctgtctttcagtaacttcaatctggttaagaactattgttggtgagctagcaggctcatttggaggtaaggggacattctggctttttgaattgccagaattcttgcactgattctttctcatgttagagggctattgttcctttaactgcagtgtaagtcgagtatagtcaactggccttgtttctgggtgctttcagagggccacagctctatatagatctttactgtgcctagattcttgccctgggtgtcacagagatgtatattggcagaattattttggtgttgtaattttggctgtgatccagtagctggcatttaacattagtgtccagtggataggctcttactcagctgcatagttcttttgtatttctgtgtgttcacagccgtgctctgtggtggggttggggagagagatgaccactcataagggccactcctggaccatgggtgaggtccctcctatcactggcactgtacctgcattactgttgtttggtgtcttgggttgcagggctcccttagacagaggccatggctgccagacaggccacacccttcccagaccagcactgtggaggaaggcatgtcccat

SEQ ID NO: 10351 - DNA, 1131 bp, Homo sapiens
tgtgagaggtatgtgagtttaacagcaacccaggtgaaaaagacttaggtcagtaagagttatgcaggcatacccaactgtccaaatctattgatattttaaacagcatttaatgagtcttgcagaggtgtccaagggagagaatacagtcatggattcttagtttctgtttctggttgggccagtaaagcccttttctcatccttcttttcctcatatcactagcgacagaaactaaaaaccatggcttcagctgctaaaagcctaaaacaaaagaaaacagaacgaaaacagaacaaaaacaataacaaaatgaggtgggttggacaagcttgcacagcaaggaagttctctctgtgtactaaattggccataacatgccaaggatactgtactcctctttggaattatatttcaaggagactgtcaactatatatgatcattcagaagagataccaaataatataaaaaatggttggccaggcgcagtggctcatgcctataatcctaccactttgggaggctgaggcgggcggattgcctgagctcaggagatcgaaaccagtctgggcaacaaggtgaaaccctgtcccctactgaaaatacaaaaaattatccaggcagggcggcgtgcacctgtagtcccagctacttgggaggctgaggcaggagaatacttgaaccgagaaggtggaggttgcagtgagccgagatcatgccactgaactgggtgacggagcgtctccaaaaaaaaaaaaaaaaaaaaattggttgaaggaacttaggatttaggatatctaacctgggaaacattcagatctttatgtagattatgttctatcgtgtaaaatgtggaatgaatagatttgatctgtttagtcccaaaggcaatgctttttaatctattttggcttatggattctctaaaaatctgatgaaagctatgtcttctctccttaaataagtactcacatgcaattgcacccaatttcaaagggttcagccactcccatgaggcgcattcgtgttttccagcttaagaactcctggcccaatggggatggatgggaatagctagaaacatactgatttaagtttctcatctgatagaatggacctggaagatttaa

SEQ ID NO: 10352 - DNA, 1054 bp, Homo sapiens
acccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaattagcttaagcaccatcatcactgtcttctcagtctcattgcaggtttgaatctacaagttagcaaccatttacttaaatttggggcctctacctggtacttgttgaatttatgattgaaatgtattttcttattttctgattgcccttagtgttttatgattgctatctagtatttaaaagttataaactatgtactgttagttttgtcttgattgctttcattcagcaaacattttatattgtccctgttatgggttagatattctgctttatattaggactgtacatataaaaaagctgaggtctgtagccacaagattttctcaatttagtagataagagacatttgtgtaaggaagatatttattgaattatttttcctaggtgcccattttataaatgaggagacagaccagactcaaggtcatggagtggcgctagaatttgaacatatttctgactccaagtgtagacttttctatcatcctgtgtcctatcaaaattttagattattataatattaattcggtgcattgcaaatggatggttttctaaaaatgaaaaacttctaaaagtgtcatgcaacacatcagaatcactgttgaaatacacatagttgcaaccactgtatcttttacaggttgttttttggaagctaaggaaaagaagctatagattagaaatggcttaacacgtttattatatttctatttatcttataaggtgcatttaaaatagaaatagtttgccaaattgcaagaataatgctaggaagaaatgattcctgattcttaaatatctagcttaaaattgattaaccctttc

SEQ ID NO: 10353 - DNA, 1048 bp, Homo sapiens
catctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaagga

SEQ ID NO: 10354 - DNA, 1908 bp, Homo sapiens
ttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagtgttattagggatcatatctccagaaaattgcctttcctcctccattcagactaaggacagattccattatgcctcagtcaccaccagaagcacatctctccagtcatccattttctcccaaactcttatcttatcctgttctattataccttccttaactggactctgtctccaccctgcacccctccctgtcccccagctcttcattataaactctagaactctttttataattatcagattcctcattattatcagtctcttctctgaatgttacctccactttctaaccttcagtgaagcccagctgtcccctgaggttcctgtgtcccatgcagttctcttacccctgggcttttggaaagaagcggggatcactgttctccttgctccacccactgcttccttttctgcctgcaaacacactgttccctttaagcttctgccatctggctaaaccgcattgctttttctctcagactttttacctacttacctaccttcaattttgccagtgtttttagtgtttcaacactcaagtagattaatcttctaatgccttgggctttgtgtgccttgacttttttgtctccagttacatgttctacattccacctcagccatgtattccattggccactcctgtagcattctccttgggagctaggccacttctaacttctagacttctacattgttggcttttcttctgagaccctctctaatccgtatataaagtagcagtgttgtccacccttttaattccatagtgttaattcgccatcttagcat

SEQ ID NO: 10355 - DNA, 1034 bp, Homo sapiens
cacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagc

SEQ ID NO: 10356 - DNA, 1026 bp, Homo sapiens
ttgttggcctataatgtggatattacagtagatgattactaaacattaactgataaaagaggaatatctacaatccccaaaaccacataaactacattaaattgattggctactatcatgtacagatgcctacactaatattagggtagtcctcggtgctgcttctttctattagacctaaaaacattaaatatttatgcaattaaaatctatatatttctattttttaactcaaaagtttcttttactggagaaataataagaatgttttaatgttctaagtaggaattgccattcttgctataagaaagcaagattatatattaaggatgacattattcttttgagtgtaattgctgcatcagatgatacacatgttgagcatctttctgtgtaactgactaagccttgcagtgcatgtagtattcttgtctcctgatacaaacattttcagacgttctgtttgcttttttttcctcaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagtt

SEQ ID NO: 10357 - DNA, 1033 bp, Homo sapiens
ctttaaacatcagattttcactttagtatcttttaagtaaatactaggaaaaattttttaaagcttttcacaggataagcataaactgttaaaaaaaaaaatgagggctgatttttagccatgtaaaattttataactagaaagaaatgtaatttgtaggaaaattataatttataaaaattagttttattttataacccaacagattgactttacaaaaataacaactttaataaagttatcagaattttttagattttatgggttatttttactgcttgcagagccattagacacaggtttgagtgttgcatcatgaacatggataaatatgcctaggtgtgtgtgtgtgtgtatattgcttatatacacataaaaaaacctttgtgaatgtctaataagattttccaggtgtttataatggttactaaactgataacattttcacttctaggttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcctttgggttgtgtgtatgtgtattttttctccccccaccccgcccttttttttttaagaataaggacaagtgcttacaatctgctcaagcaattgtttttcagatattggaattcagcaaagagtgacctctctggccattctaaaactttaatgttgtgtcctaaatctggtggaggaaaagca

SEQ ID NO: 10358 - DNA, 1050 bp, Homo sapiens
tagagagcttactctgtggttagagagaaagatgttttctaaataattataaagatagctaaaaatggaaaactataccttttgactttttgtagaggttaatagattattatgtatcttcacttgtgaaagcatggataatgtttcagttaatttaatacattactgtatggaaaagaagggtagttaaatattaaatacttgttcttatgtttaaggcttaggtatgtggtttcagtggactatttttaatgatttttaaaaatatatatttgaattctcaaaaatgcaaaatgtgttatagataacattatagagtatctataaccagttattttataaatgggtgttttttacttaagtggctttactttccaattttattttccatttctaataggatgggtcatttgttgaacaaaatatcgaattaatgacctactttgagccaattgatagttttctaaacccagcctattctgtaaatcttttctttagcttgtaagacaatttctaaacatgttgtctagttgtgttatactaaggaactcagtattgcataattctaataacagcagttactttttttttttgagacggagttttgctctgtcacccaggctggagtgcagtggtgtgatctcgactcactgcaacctccgcctcccgggttcaagtgattctcctgcctcagcctcctgagtagctgggactacaggcgtgcgccaccatgcccagccaatttttgtatttttttttggtagagatggggtttcaccatattggccaggctggtctcaaactcctgacctcgtggcccactcgccttggcctcccaaagtgctgggattataggcatgagccttttatagttgtatagatgatgtcacactcttaagagctttacagatatttattcatataatattctcactgcctattttaatagccttctattcacccactgctgtgggagggactgccactcttgggtcatgggggtggctgaacgtataatacctaacactggacagatgagatcaacagtgg

SEQ ID NO: 10359 - DNA, 1047 bp, Homo sapiens
atttactttcctgaatgtcattgtaattcagcagtacaccaaactagataacaatttttaggaatcaactcggtcttcattgaattaatatctttcccaaattgctatgattgactgttcctacttcccctcccccagaccgtagctatcgttttatttaaaatgtttcattttgagaaaggttgaagtattaaccagcaaagaataacaattccgtaggcaaatcagtttgtttcatgtctaggacgatggttctgcagtgtggttctagaaccagcagcatcagtatcaactgggagtttgttagattattaccccaccccccacccctagacctgctgaatcttttgaaattctggggatgggacccaaccatctgtagtgtaacaggccttccaggtgattctaatactctaagaatttagtaccaccagtctagtagtattaaccaaatgcttccacaaatgaaaattgtttacatccacttcagtttcaacatgcattatcagttgtttgagatgatattggcagcgccagtgctagaatcaggaagattccttttgcctattttacaaaatgcagatttgagaccttcagatataatatgctctcactgtaagaaaaatatgtcttattttattgttgctacattctgaactttagcttggggaaaaaggaattgggttttgaaagcttgtttacgacaaatcaagtgaaaatatctcttggacgtgcttgcttacataaaaataagcgttttggcactaacattggtagactctggtaggtctttccatcttagattatttttatttcaaggaagattgatattttaagctttcataaagaaaactttttttaatcaaagaagaaatgataacatttgtcctgatgacagatttgggattgatatgttgttttttaaaaattcttttgaatctcttggacaatattaaatacatatatatatataaattatggatgttctctttcacctatagtagcttactcttcaattaaaaatggagtgtcagaaagtctccattt

SEQ ID NO: 10360 - DNA, 1048 bp, Homo sapiens
accctaaataaatagaaaacataactactaatgtagtgatactggaagccacagatgtggttgcagttaggtctttaacagatcttttgatttcaaagcagagttttctctgtaaaatgttgataatttttacttgccttacagattgctgtatagttggagagagatagatgtgtgttaatgaactttataaaccgtgtaagaaagaaaaggacaagtccatatatttttccattttcccagactatgttagttctttccgtcttatgggaatatatttcaatacatactgagtaatttggttaatactcacttttctgtcctgtttaattattgcctgtaaatgagaggtaaagattatgcttttagtcagaatgacttttttttttttttttacttatttttgatttccatatttctgtctgtattccctgcccctttcccacccctgcacttaaatagcaaggcattgacttttgattctcgaataattaaattgcctccttgacacttcagcaaataaggggaattggtatttagtttgaaaagactaagagttaaggaaaattgtgcttaataaaagggggggtggtaaatctagggtaaagcaaaaatttttaattagtttaggagaagagatggaagtaaaagtcttttaaccttttctccccatctcttcagccttttcattttcttcctttgaaatatttggattataataacttaagtgtgtattgaccttcacagtttttagggtgctttcacattatttcagttgattctcacaaactgagaagatttaagtggcctggtctcagtcatacaactaataacaaagaaatccatttaattcttaatactgcctttgtaataagctgtttctaattgtcctctgcaatattgaggctgctagggaatatccctactcccagcttcaccatctgtggaatgcccaaagataccgaagattctccaggtaatattggttggaaacatgaaagttagccatactttaaatactattgtagattaactgaaggagtaggag

SEQ ID NO: 10361 - DNA, 1050 bp, Homo sapiens
ctatgagataccaattcttccaccatttgttttagtttcagtgatgtatcatagaagggtcgatgtcgtaaaagtcaaaagcaggctgggcgcagtggctcagccactgggattacagtgggattacagaatcccagcactttgggaggctgaggcaggtggatcacctaaggtcaggatttcgagaccagcctggccaacatggagaaaccctgtctttactaaaaaaatacaaaaattagccaggcatggtggcgcgtgcctgttgtccaggtacttgggaggctgaggtgggagaattgcttgaacccaggaggcagaggttgcagtgagctgagatcgtgccactgcactccagcctgagtgacagagcgagactccgtctcaaaaaaaaaaaaaaaaaaaaagtcaaaagcagtcttgaataattagaacccttctgtcagattatctaatgtcaacttgttttctgacattacttctgtgttgtcttcttcatcttgtggcactggtttgaaagcactcttatccatcccagtcatcttctgttaattcctctatcatggtgtctactgactctttaatttctccaaaattcgtatcttgaaatccttcacctccaaccttttttgccatatctaccatctttttcatgattggctttgtcataaatcctgtgaaatcatgcatatcacctggagagttttctccaacaggaatttattatttcagacttgatggctttcatgactttttctataaaaatgatggcatcatcttcaactgtaatccttccagaccctcataatgttctctctgaagttctcttccacagcattaagaaccctttttatagtgtatgtaatgtgccttagaagtccttatgctccctgatccagagggtgaattagacacactgtgtttagggacaagtagactacttccatgcctttggtgttgaacttccatgctcctgggtagctaggggcaatgcctagtattaaaaagactttaaaaggcagtctcttactggcaaattacttcctgact

SEQ ID NO: 10362 - DNA, 1064 bp, Homo sapiens
tagattgaaaacctaaaactgaaaataagaactttaaaattttagaagaaaatatatgacaatatcattatgacttacgatatcaggaagaatatttaaaataagactctaaggtattaacttttaaagaaaagattattattttgattgtgctaaaatttaccaactttatgtgacaaattccgtatgtgaagactgtgaaaagacaggtcacattttgggatagtagacttgcaaagaatatgtgtaactgataaaagattagtacccaaatatgcaaagaacatctacaaattaataagagaaaatgcaacccaacagaaagttgagaaagtctatgaacaagaaattcaaggaaaaatatatacataatgtttaaccaatatattttaaaatgttaaacctcactataatcagggaatcagggatatgtcatttttaaagcaactgagaaaacttatttcacattcatcagatcaaaacaattaacaagtctgataataccaaggattgtttgaaaagtggggcagtgggaattctcatacagtgctgaaacagccacagtagagagaaatatagcaatatctacaaatgctcattcttcttagcagttccagttttactaatgtagaaagtcccacatttattccaggagactggaataaagatcttaattgtacattatttgtgtacgtgataaatgtacatcatttgatcattaataaattgtggtatattctatgacagaatggtatctatctagctaagtaaatttcaataaacaaaacatactatatattgattatagacatatatgcagttgagaaaatacaagctcctcctaaaacacacgagtaatgtattgagtatcttacagtttctctcttgcttcaccacatcaccaaaggcctgtttacctcagttctttttacctagtaccttttacatgtctgacttccaagaaaaaattacaaggcacactaaaaggcaaaatttatatataagaattatagctttctattataaaaatacttataaaatataagagaaaaattctataataa

SEQ ID NO: 10363 - DNA, 1032 bp, Homo sapiens
gtcaatacagatctaatatggtggatctgaagtatcaaggacccagattgtcttacattccagggttacctcatgaaccaaaattattgttggaactccagctattatatcttcaggaggaagggaagaagaggagcatactctctctctttgaaggatacttttttggcagtcacatgtcattttttttaacttacatccagttggctaaaacatggatggtcccatggccatacgtaggtaaacaagaggctgggataggcagtctcatctgtgaggcctttgtgctgagctaaatttggaggttctgtcactgaggaataggagagaatgggtattggagtcatagcagcttttccccttgggtacagatgaatcatttaaaagaaagacattttccacctaaagtctgcaatatttcacttatgccagagacacccttagagctgcaaatgcgatgaccaaaatagaaaacacactgaaagagaggaggtaatacattgctgcagaccaaaaaagagaattgtatcttggagcactctgaactcttgagtttagctttctatttttttgtgtcttgtcttgggtcagatttttataatcctaatctggaaccataaaatgaaagtggtacatttaatattgacaagatcattaagtgatggggaaacagaaatcaaaggaagaatggattgccgtgctatattgtatttcacttgaagagctcaaggaattgcacggtaaagtagtagtggtaatgaagttgatggcctactctgcttacttccaatttgacatccatttccaagccatgtatccatgtattttatcctcttctagaatgttgcatcgggttctacttaggtattttctctcatttcagttgtaaggatgtggtttccataagggaaataaataaagctgaccattttaatttatgaatgcttttgccaatattcagtttgtttttatatctttgacctaaacattttattaaaaatgcggagacatctgtgtcttatatattctttt

SEQ ID NO: 10364 - DNA, 1096 bp, Homo sapiens
atcctgttgaattttagtcatatgtgctgagcaaacagatgccaaaaggaatacttttgatcaccttgaaaaggaaaccctgtagagagggttacataaagaatagggggagatttacagccctctcccttgcttgtatgctactgacaatgtgaatcacctctgaaggaagggagggttgggtttatctatcacatatgcatcatctcaccacggtagaagccgatgctcttaccagtgttgctaagaggatgagagacttaaaatgatggccaaagatccaattcaaacccaactattatctctcttgggtggtccctatgatctcaatgtacagaggatattgatattttagggttgtttcatgaactcaccttatattcaaaatgagagcccacttatattttcattcagcaaactttagccgcagggctgcaggtatactgctggccaaagtgtgattcctcttctttgaacactcttagtctaatgggagaggaggagactgataaatgaacagtttgtaacagtgcagtccagatggtggttaaaaacagttaattacttgtttgcagtctaactggggctagttactcaacctcttagaggctcagtttcctcatctataaaataggcataagaacagcattaccttagaaaaactcttgttgaagaatcagtgagatcgtctatgtacaatgcttcttaaggtgtctggaacattataagccctcaataaatgttagctggggtttatttgttgtttgcttctataatggttataatcagaggctataacagaatctttttaaaaaataatttatacttttggctgggcgcggtggcttatacctgtaatcccagcactttgggaggctgaggtgggcggatcatgaggtcaaaagattgagacgatcctggccaacatggtgaaacctcaactctactaaaaatacaaagaaaaaaaaaattagttgggtatggtggcaaatgcctataatcccagctacgtgggaagctgaggcaggagaatcgcttgaacccgggaggtggaggttgcagtgagccgagattgtgccattgcactccagcctgg

SEQ ID NO: 10365 - DNA, 1057 bp, Homo sapiens
tactgtgatgattttgtaacataatgtgtataaagtatttaacatgctcatcgatacatagttactactcagtccatggtggttattaatcattcacttaatcaaaaaataaaatttattgagttcttatatagtagaaccatgcattcaagctacatgccccaggcactgtgggtacagtgctaaaaaggcagagacagcccctaacttctcagaacctgcagtctagctgggaaaaccaatactgagtgagtaataaaacaaagaacaagttatgagagggagaagcataaaagagtgtgcagatgcataactctgaggttaaggaaggggcccctacagaagattgtgaaccctgaggacagagtcagcaacagaggtggagataggtgtacagcatgtcccaggccaaggagcaatgcgtgcaaggccaagaagtgagacagcaggaatgtactgggaaagaaaaatcaccaaagtgccagagaggtggacagaggggtggactgagacgggcaccaaatcataaaagactttgtatgagtataagccatactaaagagtttgttttgggttttatcctaaaatcaatgggaagccattgaaaaagctgttattaggttggggggttggcaacataatcatatttggcttcagtataatagagatgagtaagacacagtcccttgtcatcgaaacaatataatctcatggcggcagaagttgaaggggtcacagttaaagaaggctcaggaacaaaaaatgttcttaggtacaaaattctaggtgaaatttttaaaaagggagtgaccacatctctgtgatgtgacatttgaaacagatgttaaaaatggactgggcaccctttggataaggagagctgctggtgggaaggggcgctgcctcctggatatcctgtctaagaggtaaaattagcaggcatactcttaaagtgctcccagctttgttaactggattctacatttcccttccttccaccactccatatttcagaatccctttgagagaaaactctgccacccttattgtagcccct

SEQ ID NO: 10366 - DNA, 1030 bp, Homo sapiens
agacgtttctagtaaaatcattattccctttttatatatgtaagagaaatttaatagcttctctctaagttcattcactactcagaaacctgattagaactgtgaacttctgatttcaagatcaatgctggatccatttgtatcccccagtgaatctctagaattcgagtattagcaagtatgcaggtaatattgtataagaaacatgcagtgctccattaacctatatgcagtcaggacataccctgaagcaaagttttaactacacagaaatgtggccttaaccttataacaagagctttttttttggcaagtgggctatgtaagaacactgcatgttggaaataatggtagccagagaggaattagagatattctatagctacttgaaattttcagttttttaaagaataattatttcaaggctgaactaattaagtacatttctacatcctgtaaaatcttacgccccacctaactttaaaaaaaatacaatatacattttgaggatttatggtatatttggctcaacaatcaagataactgaagacggactcatctctaacaatccagcagtgcaattagagaagtctgccttaaggggtgatttttctacaaagacagccaatcttcaaaatggccagtggcaatatgttgtgttgacctgttttaatgtatccctctatgttaggtatatgcaggatggactggggaggaaaaagaaaagaaggcctttggagtaataaagatggagatgagatttggtgactggagaatttaaaaataaattccagtgcacctaaatatccatgagtcttttcagtctaccagtccatgaggttacagaacatcaagaccagattctcacaggttacaacctttctactgcaccttctcatttgagaattccaatcctgttcaaagttactcctaaccctcaactataccccaggtatttgggagtccaaaacaagagtttgacaagctctcctaaataggagcaactgctgaatactagcagctgccactc

SEQ ID NO: 10367 - DNA, 1029 bp, Homo sapiens
cttgtgttacagatgtcacctcatgcctctcctgcaccttcccctaacaagtctcagatgctgagacttggagatgggaagagtatttttgcaccatctctgcacagtgtggctcagggacctcacagcctaaaggtcaccctgtgcaaggcaaagtgctcctgcttgaataaccacagtctttgtccagtgtctatctcttccctctcagtttatttgcttctctgcctctacccctaagaatctgtataaataatgagcttctcaggtcattcaagggcaactcattaactcccttaggaaaagccagcaatgtcttttcttccaaagtggtggcttaatggccacaagcagataatgctttataaaaaggtaataataaaataataaaatgactctcatgtgatatgtaacaaaaggcccaatttaggagacaggtgtcaattaatgcggccatcactcattcttaccagtggatgacacaggaggaaacagaagccaaagaacctaggattgagaatatcttgagaaagctgcatctgagcataatacataagcagcttctttttgcaaatcatggcaggttttgcatttgattcctcgttctacatggacccttttaagtattttcctgatcggtggtccttcttccctcctctcatgccctttcacgaggtgtatgcacatccgttcatgtgcagtctctctctctctctgtctcacacacacgcacacacacgcgtgtgtttaaatagacaaaatcataatgatggtagtgatgatgatgatgataaggagaaggaggcctggtgtctacagaactttatcctttgagtgtgcattttcatggattaactcaataaatgtttaaaacaactcaatcatctttgttaggtaaagtaagtgttatggtttacatttaacagatgaggaaattggggctgacttgttaaaaaaatagtagtaaagccaggatcagactatctttctattcttcttcttaggtggttctcttaccatagcacactg

SEQ ID NO: 10368 - DNA, 1045 bp, Homo sapiens
ttttttgtatttttagtagagatggggtttcaccttgttggtcaggctggtcttgaactcctgacctcatgatctacccaccttggcctcccaaagtgctgggattacaggtgtgagccaccacacccagccactatttttaactttcccttatagatgagacaactgaaacacaggccactacctcacttgctttgggtaaaaaatttgagagaatgtcaaaaacctcagtaatcaagattaataatattttaatgtaatcctttaaaaaaccaaaattaatcctaataaattcatgatgatcaaaataccaaaatataaaagaaaggcaagattcaataggcagaatgttacaataacttgccaggatgatacagttaggaagaggcagggtaaggacttgaacccaagtgggttgaccccagggaccacatgcttaactgccatcgtgtggtcctcctaacaaataataccactacaagtcttgatgttttgataggacaaggaaaggtacaggcgtaggagcaagcgtcatttgggattaagggatgcctcattgttttggactaattgggacctcatgcaaaaaaaaaaaaaaaattctaaaaacagaagcagaaaatccagatggggcctaaattttataccttgaccatctatgaatttaagtatgaaaaaagaagatttccaaagcatcctcttaatttttcttctggctggctcctgctgggagaatcagtgggtaaaactaccctgcattctggctgtagaaatgtgataattagaatcacttaatataactgcagtgtcctccttggttcctccaccttgagagagatagatggagcatttcccttgcttgcatccaatctgtgagattctggcaggcaggctgcttgtcttgagggcttgtcattgagagctggtcacctagaatgccccgacatgtttgagctgcattgttaaactacattggtattctcccagcaaaactcctctccttcttttaccaaatcagcattctgtgaacacagtatttccttgc

SEQ ID NO: 10369 - DNA, 1046 bp, Homo sapiens
aaccaaaaattccagccatatttatcagaatatactgtgctttgtgttttagttgaatcagggctttgcccaagtgtcgctctctacaaggcactgtgggacaatattgttggaatacccaagacatggaaggcatggtctctgatatcaaagtagcaatttcaccaaagttgtcagatttaggggttagcatcccagcccttgtgacaccagcagtgcttcttctgagggacactgctgagaatggagaaggtggcaggcaagggccttccacagacgcctccctcccctaaagaatgcacaacctcctttgcccttgcttgcttcctgggttgcctttaactggacccatatcccttggcatctgccattcattatttggtttctactatcaccctgtctccagctctgatttggctcttcattactgaactttggcgtgttgtttattctctcactggagtttaactttgggtggtacctgttttctgtttcattagtcccatgactgcattgacaaccagaaggaacactgtcctttatctgacatgtatttacacatattttcactaatatattaaaaatgtatttattgaacacgaatcacatgcaagcattttactggggccctgggaatagagatgccctcattggattgcagagtggagtgggaaggtcggaaaaatgaaccaataattaaatataatatcttgaacacagaagaggagcacctacccatactggatggagtcttgaaacacgaggggaataagacagagaagaacgcgcccggtcttggggaggtataacacatatgcaataaggtgatgacatatcaccgttagataataatcgcagacaatgaagagtgtgtattcttctcagctcacatacaatctgatagcccagttcactcttccctccaatggtttttactccatcctctttctggtcccaccatcaattaccttggagacagtaggaaatgaaaaagaaaagaggtggaggtaagagagaggaaagacaagtgggaacccagggctcaa

SEQ ID NO: 10370 - DNA, 1096 bp, Homo sapiens
tcagccatggcttctcctgaccaagggatgttaaagttatctagaacattaagagtgttaatgagtatatacagagagactaattgtgagcaaaatcattaattagggtcatgtttacatttttattgtggctaatctttcatctgttcggactaaggttcttactgtgttccaaaggtgataataatataactaaattcctctgatactaaagtagtcacacttttatttcttaatttacctgagttgattcctggccaccctccccctccttatcacactagagataattttcagtaatgttttctttatgctgttaagtgattcccttcccagtggagcgagaaggtgaatgtacttaatgaaatgattgatctgcattttggcattcgtccaaattgataaaatatagagggacttttccattcattattttgttcatcatttatagaaaatgcggaaacttttgggtaggtttggctttctgccaattaatgttgtcactgttttcctctgatgcatattcacatgagtcaacagaaaccttttcgactaagcagagttagatttagcgagactgcgtacatcacggtatttattggatgtggaaacctaaaataggaggggcgtggtaaaacctcagacagaagtactgacaaagagtttccccaaacaatagaaccgccatagcccgcacacattcccaggacacattctacagaatggacaaagaaatactcatctgtgtcatcacttgctcaaaaaaaaaaaaaaaattatctgaaacatggaaggtatatcaatcagatttgcatttggctgtgagtgatagaaaatgcaaaataatagtaggttaaaatacataaattttttttctgtctcttgtaaaagaagtcccagagtaggtaaaccaggagggagacacttaacagtatcagggatccacgttccgtctcttctgcggttctgcccaccttatcatggggcttccctgtcacggacaagatggctgctagtggtccagctgggaagaaggagaaaatacctgcagcaacagcaacaaggactacccctctcttttttttttttttttttt

SEQ ID NO: 10371 - DNA, 1036 bp, Homo sapiens
ctctgcaggatctcaccaattgttttcagaagaaaattaattagaaaacactcttacgtataattgctgttctagaaaatggttacaatttacttctttaaatgtttaacaacattttaaattatgtattgttttctttttgccattcattcatctcttggtggtttggggtgtgatttgtgtttttcccctctcttgacttatctgagaaattctggcactagccaggtttgggatgtttttgttcagacattcttaagttatttggtaagaagaaaggctttgttgcatttttctgctgagaaacaactttctttttctttgtttcaaccctgaacttcctaaaagctctttatttctatagattgttctacaaagctatgcctcaggaggtgagagactagggagcattttttttttgttcaactagaagtagccacattttcagaaaacaactaataagtttaaaatatgtcaaagataactttacaagagaccgcgtgaacatagatatgtaaaggagagcctagtgctctcaatgcccatatctgcaggcctcaaaattgcttatgaagtctagaaaccatggccatctgccagccggaggcagcatcaccacaatggaattcacagtcactctgttaagactttataaatacagtgagggtccaggagccaggaccttcaggcgcatgaggcttgtctggtctggtctggccgactgagcaaggaaaccctgtccttgaatgaggacttcctcagcttcagtgactaaatgtttgttctcaaaagtaaaatgtcccaatggaaggtggacagcggccatcttcttattttatttgtttatttttagccaggcactccattagttgtggcaggaagtcatcctgagaggaaagtcaaggtgtatgtacatggttgacttggggaaagtgtttggaagttggaaaagtggaaccatttttgagtgtgacttcatttctcttctgacctagctctacacagtgtcatatcctaggaactgggtgctagcatg

SEQ ID NO: 10372 - DNA, 1083 bp, Homo sapiens
tttgaaggaagtaagagagtatgttggcccaatttgtggttctaatacttcagcaatgcggtccagcattctggcctccatatctgtgaacccacattctcctcttagaaatgccctccttggccgggcgcggtggctcacgcctctaatcctaagcactttgggaggctgagataggcggatcgcgaggtcaggagatcgagaccgtcctggctaacacggtgaaaccccgtctctactaaaaatacaaacaaaattagccgggcgtggtggcgggcgcctgtagtcccagctactcgggaggctgaggcaggagaatggcatgaaccggggaggcggagcttgcagtgagccgagatcgcaccattgcactccagcctgggcgactgagtgagattccatctcaaagaaaaaaaaaaaatgccttccttttctttccacccacccacatcctacccagacatcaagttccctcttaacaccataggcctttaggaagctctccttggataattgcccaccacagtgatccttattctctcggaatttctgtagcacttttagtttatgccaaacaatttctcacttaattatatgttctcttggatcactctctagtggtttaaagcatagtgttacgcacataatctgtgcagccgtttgaagaaaaggcacgtggctcatggaggagccaaagacgtgatgcttagggaagaccacaagtacccatagggaggaatcatcttggggggatctaaatttgcccctcagactcacaagcacagtgatgtgaatggcaggataccacatgttactacatcagccagaggcaaactcatcttcctcggattcatcagattgattctaatttattagttttcaaaataaaatatccctatctagcataactagacacctacgtcctcaggtaccttcaggtgagctctttgagtttagttagaggcatcagaactcttggtgagcatggaatcaaggcaaaagcgactagtcaggtgaatcacaggtttaaggattagaacaagaagattggtgacatattttttaacctaaggagattcctgc

SEQ ID NO: 10373 - DNA, 1076 bp, Homo sapiens
aagtataagaagatctagctcatttttataggcttactctgggtctacattgtatggagatatgttgcatagtttattgcatagttgcacaagttggaagtgatggttgcttggagctagttactagctactagcaagctagtagcagtaaaagtggggaaaagtgtggattttagatatattttaaagtcagagccaagagtagtgccaatacgttggatgtagggtgtcaaagaaagaactgaaccaaggatcactcaaaatgtgtgactcgtgcagctagaactgccatttattgagctggagggatattgttggagtgtcatttttggttactgaggaaagaagaggcgagagaactgaagtttcattttggacattttagtttgacatgcctattagacatccaagcggagaggccaagtagtcaggggaataagtaagctggaattcatgcgcaagggctggcttaaaagtgtacatttatgtatttaaggctagaaggctgaaagaaaacacctggagcagaagtatagctaaagaaaagaagaggcgtttgaacagagtgctaacactccaatatctagaggtcggaaagatgaagtggaagcagaaaggagacagaggagaagtgagggagagaacataagagaaaatagtgccccaaaaggctagtgaagaaagaacttaagaaggaggaagagtttatttgtcagataaagagtttgttgtcaaatactgccaataaattagttaagctgaagactgtaattgatcactgagtcaggtgaaagtcattggtgactttcaatcagtggtgtcctggtaaactggctctctgaaaagcagtgacaacagcaaaatcctgatttgtagtgtttactaaatttccctgtggaaatattcccatcatagtcaatttccagctacaaacagtttaacaaccagcttgcaaagttcttgaatatttaacaattagcttctgctagttgcgccacacaccaccttaacaggagccattttgtaggagtggtggagattggagtagatccataagaaatgaaatgagaattgga

SEQ ID NO: 10374 - DNA, 1104 bp, Homo sapiens
ataaagcaaaaagaggtttttaatggattatatatatacttactaggacatgccaaagtgagtggaaggaaacagaaggaaatagccttggtcccttcagtaacaaccatgttaataccttctcaggaacataacatacaatagctatttaggctgaatggagagctgaagcataaacctacaatgatgattcatgtgactttctaccatagaaatctcaccagattcacagaaccatagacactttggaaaagagctaagaggaaacctagttcaatcccttacctgatgcagtatgcccaccatgaagtcatccgtcttaatcatcttcaataacaggcaacttgaaatttctcaaaagtctgtgcatatttgattccctctagcagttccaataaaaataaccaagtcatttccatggtatatgaatgaagtggattatgatgccaacattatattgtttcataactttctgagtatgtttctcagttttagagatttattctaatccaaatatgcatttattcgagcaatttagtgtttgcttgatgtatatactgtattaatctcttctcttgctgccaataaagacatacttaagactgggtaatttataaaggaaagagttttaattgactcacagttctgcatagtgagggaggccttacagttatggcagaaggcaaatgaggagcaaagtcacatcttacatggcggcagacaacagatcgtgtgcaggggaactcccctttataaaaccatcagatctcgtgagacttattaactatcacgagaacagcatgggaaagactcacccctatgattcaattacctcccactgggtccctcccatgacagataggaattaggggaactacaattcaagatgcaatttgggtggggacacagccaaaccatatcatataccaattttccttgtaagtagggtttttgatttttcaaatgtttgttccttggaagccacataggtaggaaaaatatttacttacttttttgctttgagacagggtctccctctctcaccaggctggagtggtgtgatcataactcactgtaacctcaaactcctgggctcaagccatc

SEQ ID NO: 10375 - DNA, 1067 bp, Homo sapiens
aaatcattttaaggccaaatactggtgtttgctgacttccagaacttccttatgtttccagcctttgcaaaacaacatagccaagtatatagtatctaaatctggtgggctgcttctgagattttcttggaaggtatttaaatatatgttggtttttgtttgtttgtttcccactcataatatgtcctgttttctaaaaactttttaggttcaggcagttgaccatttatgtgaaaaatgtctgaaaaatttgaccctgataaggtggatgcctcttgtgagatcacagaagcccttaacctggaagaggcgtgtaaaccaagaggtttcaatatatgtaacaattgaaatttaagcatatttaaatgttatctactcaaatatttattgagtcctactatatgccaggcactgtagtaggcacatgttgagcaaacaaaaattcctgttctcatggggcttacattctagcagagaaaacacaacacaacacaagtacaatgcataggatgttggatggtggcacgtgttgtggtataaaataagtcagagaaaggagtcagttttaaataggaaggttatagaagcctcactgagaaggtggcatttgagcaaggacctgaaggaggtgtaggatagtaccaagcagacatcaggggaaagagcattcttaggcaggctgaagaaaaagtgcaaacattctgagacaggagtatccctggaatgctctaggaataacaaggtggcccatatggtcagagcagtaagcgaaggagagagaaatgggaattgatatcaaagaagtaatgcggtcttggaggcaggttgcatacggccttgtagaccactgaaaagatttcagcttttgttctgaattagatgggaagtgtattagtctgttttcatgctgctaataaagacatacctgaggctgggtaatttataaagaggtttatttgactcacagttgagcagggctgaggaggcctcagggaacttacaatcatggtgggaggggaagcaaacacatctttcttcacatggtggcagcaaggagaagtgcagag

SEQ ID NO: 10376 - DNA, 1072 bp, Homo sapiens
aaattaggaaaaagtatctatagcatttagtctagcagccaaatacatagtgagcattcaatagataaaaattcatttccttcccttcacagaactcttctttttatggagtctgcatattcctgctatccaaagtgttatttttaaggcctcatataatgctaaaatgttatgattctgtgataaagccaattttttactttggaccacttccatcatatgctgctgtattcaatagtaaatatgattactagaagagggaggaactaacttagctgagttctatccaaggatgacagcagtagttatgtgctacaaggtaaaatggtgtatgacaataacgtgcaggaaatcatttgttatatgcatttgctaagttatgagacaaatttagtactcaggtatttctaaagattcctaagaatagcatgattcctaatatatgattgttcaaatggagactcacatgctgcataaagatattcctgtggaacatggatctatggcagcagacagacagccaccccagagtccagccactcacattgcaggggctcctgggcaaaggtgatatacatccaggaggcaagtgattgttctctacaaccgcagacatacttataccttccaaggagaccatggttggcagagtattctatgaataaaaagatgatgtatgcatgtgtgtgcgtgcacacacatacttacacgtgcccctttgtgtgcatatacaatatcacacaaatacacaaaagagaaataaggcaagtataaattatatctccttccaaaaaggatctgaagaggcttctgtaaaataataccaatacaagagaaaatagaatctctaaaatgagaagagaagaatacactaaaagcagagtattatgtcacatgaactaagatttacctcatctggacgttacttttcctaaaactccaacaatataactaagactataactaagaagcagggaggaataaacaaaggcttatgaaggccgggcgcagtggctcatgcctgtaatcccagcactttgagaggccaaggtggggtgaatcacctgaggtc

SEQ ID NO: 10377 - DNA, 1050 bp, Homo sapiens
gacattttggttatataaagaaaatatttttagagatgcatactaagtaattaggagtgaaattatggccgggatttgctttaaaatactttggcagcaagaacaatgtagggaataaatcaagtgtgacaaaatcttgccaatttttgaatctagttgatgggtatatgggggattattttaccattctctttaatttatgtatgtttgaaattcttcatactaatcttttttgaagagaaatggtcagaaatatatctctacgtttgctgtttttttgtttttgtttttgagatggagtctcgttctgttgcccaggctccaggctatagtgcagtggcgtgatctcggctcactataacctccacctcctgggatcaagctgttctcctgcctcagcctcctgagtggctgggaatacaggcatgcaccaccacacccagctaatttttgtatttttagtagagacggggtttcaccatgttggccaagctggtctcaaactcctgacctcaagtgatccgcctgccttggtttcccaaagtgctgggattataggcataagccactatgtctggccttatgttctctgttttaattaaagtctcaaatatttaaaactttaaatggaaaacttttgaattaattaaattttaaatgcaaaattgtaaatgaagatgtctttgaaacctcactccggaattttcatttcctctgtctccccatcatcagctggggtcccagcccagctgcagcctttcccaagctgaagtggtcattgaggtcaatgatgctcttaagccaaacatggctgacagtacctatgatgtgcacaggtgggtggacaagactcattacttttagttacagaagagcctgacaaagttggctgggcaccacagtaaggattcaattcacatgataattctacaggagactaaatgactgagcaaacagagcatttgtcctcttttgcctgtgtttcttcatctgtgaagtggatatgacattgtttttccttatcattcaaggtccaattcagatatctag

SEQ ID NO: 10378 - DNA, 1049 bp, Homo sapiens
actcaaggaactgaaccagagatcccctcattctgtttttcagaaaagtcacaggcttacatattgctgaatgatggcaaggctatgtccacatgatagaaaaactgtatatcccagttgactggtgcttttggctaccttaatggcttcagtctacctgccgatctgaccattgggaaaaaattagttgtgaagttgcattatgtaaaactgaagcttgtgtagtcaagaccagggtttccctatagttcctcacagccagctcctctgtgcagggactggatgcatagcctggctcagagaggatggtaggaggctttgagccaagtatcctcagggacaactagattgctctcttctctgttgggccttctgggtaccacgcatgatgagattgagtcattctgacctgtcagagtgggtgagtgaatgctatatgaagataaaccaagaccattagaaccctttgaatccagaggcacaaaaatgtaaaaagctctatgaaaaaaacaggagtctggaaactgttaacaagatcctaggactagtttaaattttaaagtgtgaaagagatagcattggaataaataaaatgtacttctactttatacggtaagtggagataagcatataggaaaatcagcccaagaggtagtagcttgaatgaaaatataagtatgaaataaattagatacaatataaatatattttacaggaaaccaaaatggattatttagggaatgtttagagttatcatttccagcctttaaggttaacaagaggacaactatgtccttccacaaattatccattggcaccgttttgtcctcattttttcaataccattccccaccttccatctacattaggaccatgaattgggatcagacattgtcaagtatcccctggaaggcaaaatatgtctgatggagaacctcctctttaatatactctttagaactaaggaaaacagcccaggttgttgaaatcagattaggaaactcatactatctatctcagaagctttctagtgcctactgtaactaaat

SEQ ID NO: 10379 - DNA, 1027 bp, Homo sapiens
gaaaaccttttaatgtatgaaagcccacaatttggtacctgtatttcttgtgggtccagtcagccagcaagtctgaggagcgagggctacaaggtcattatgaagagaaacttgatcttgaattaaagaagtagactcttctctgccaccaagattggtctcttaactttttctccttaccattgcttatttcagaatgaatatattagatggaactttagggagagacctgaagctctttgctgagaagtgattttgaatccattcagattcaagtagggaataggttttttaagccgatgaatgttttctcattacctggagaaaatgtggggactcataatcggtgggattttgcttcaaggtgaagatgtgccttcttatttatttttgtatttccatggcctacaatagtgtcagacatctattacacaagcattccataaatgtgtgttgaactaccctgtggcaagcatgaatttttaagggacagcagttctttatatttctgtggctgaatgtattgtacaccaaatgtgaaatactgatcttcaaggcatccttttggttcaacacattaaaaaaaataacatgtattaagcgtttatcatgtttggcactcttctaagcgttttctgaatgttaacatatctttgcaattatactatgaaataggtactatcttattcccatttggcaagtgaggaaattgacaaattaggtgaaggaagatgcccaggtcatgcaaccacaagtggtggagtcagaatttgaatacagcaggatgatgccagggccaaggtttctaatcatgacttcgcacctcgtataggagcagataattacataggtattatcagactcaacttacacatggtccaggcctgaattttgaaggcaagtgcaacaagacatttgaaagccaatgacaattagaactaactgctaatctaagctgcagatgaaattcagaatgaatgtctaggggccacagattactctttgagactgttgccagtcgtctctt

SEQ ID NO: 10380 - DNA, 1048 bp, Homo sapiens
tataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaatgaaccctgtgtgttctatatttttaattcttaaaagtggtattctagtaggatctatcctttagataattttttcttaatggaagtcttggttgaacttggattcatctattatgcgactcatggcatggaccgtagtgtacgtatccataaaaagctacattaagctcatatatggaaatgagttaatattttctacaattcatttcctgaaattatccgtattattattgtaaacaaatggggtggaaaaaactcacaattgtggtaacagtactgatgctgatgtttaatgtttaatgaggagtgcatacctttttcaaacattgtgaaatggaaatttcacatatctgtatttttttttaatttgagatggagtcttgctcttgtcacccaggctggcgtgcaatgg

SEQ ID NO: 10381 - DNA, 1111 bp, Homo sapiens
agtaaaaaactgccaatacttaattttggtgtaagagtttgtttcagttttacatgttgcttatagctagaaaaatattataatccagtcatttttaacttcataaatatggacttatcatacttttcatgctttttttttttttttttttttttactttgcccatccttctgcctttcattaaagccatttctcttttttcccccgaacttggcaaactcttgtgttttcaagacttagttcaagcttgatttgcttggggacttttgttctatctggattgggctaagtgcccctcttcactagcattttggacatagcatcttggacataccatttttcatgttgttttgtaaccatttgtctttctctcaaaactgtaagctccctaataccggtaataggtattttatttatatatctctagtgcctagcccaatgtttgaaacctcacaggtgctcagtgtttgactagttgtataagtaagagaaggtaaaggaatcattgtgtaaacactggaagttaataatgcattttgattctactactaaagaaaatccaaaaaccagaaaggatatatattcgttgtcagataacaatctttatttcttgatttaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggaggtaaggtgaatatatgagaatcttatcatgtagattctgaaggctaattatgatcagcaaaaggaaacaaatgattaaaagatagtgaaatttaagagaatctctttcttctgtcgtttgtattttctcttcttccgctcattcctttcatgcttatcattgtccttctgaatagatgccctgatgttctaaggattcactcagcccatcagataaattttaataagcattaacactgtcctttattgaaggacctctgtcctttcgcttttatgtatgtattgcttacatatatattaagtcccc

SEQ ID NO: 10382 - DNA, 1010 bp, Homo sapiens
agttcatacttcacaacagggctcattttttagtaccttttatgggttttgacaagtgtgtaatgacatgtatctaccattacactatcatacagagtagtttcattgtcctcaaaatgccctgtgctttaattcattctcctttcctccctcctctgaatcactgatgtttttaccctctccatagttttgcttttgccaaactgtcatatagttggaatcacacagcatataacttttcagattgtcttctttcacttaataatatgcacttaggtttcctccatgtctaaatgtggcttaatagcgcatttctttttatcgctgaatatttttcattgtatggatgtaccacagttttgttcatccattcacctattgaaagacatcttggttgcttacaagttttggcaattgtgaataaagctgctataaacattcatgtgcaggtttttctatggacataagttttcaactcatttaggtaaatatgaggaggtttcctttaaatactgaggcttcctgttaatactgagcatctctacctcaggaagatgtatatgtttttatgcaacatattttatcttgtgtattcttaattacagcttctcattcggctctattatctactcagttctctttattttcaatgattttatccctacaaactctttttcctcaacttgtaaccaagttcatgcctttcctcctttgagttggcatgttccattagctactattttaaattttatctttttgttcccatttcccagtaactctacaaagcactgtattcaggctcttgcttgtgtcagtccagtgaaattgttcttactgaagttattgataccctcctaattgccaaaatacctttagttcttatattaaccaggtattgtcatgtactttactaccattgaccactctcactttcagaatgctcttctactttctgtggtaccctacttttcttgcatttccgtttgtaatattcctttcctctattacta

SEQ ID NO: 10383 - DNA, 1274 bp, Homo sapiens
gttcatataattatttcatgggcattcagtaaattatttgttaaattaatgttctaccatcttcactcagatatttcatgtgattttgtgtttgtggaccattaaataaagccaaataaatataatttataccataaatgcattcattgctctaatctggttatcactgttatattcctaacaactttattttatagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggtgtgttatattttgttggatttgttattgtttttcagtttttttcttaaagtatttaatttttataaaaaagtgctgagtccgttccatttctcaataattctagaatttattttttaatcaagtattcttgaacatgtttgattacactattgtacgtaatatactgttttatcatgagcctcagtccatccttttttaaaattgaaagactatttgttattttatatgatctttcttgtttttaacttcttataattctaatgtccattttaaa

SEQ ID NO: 10384 - DNA, 1048 bp, Homo sapiens
gggtgcctgtagtcccagctactcaggaggctgaggcaggagaatggcatgaacctaggaggtggagcttacagtgagtggagatcacaccactgcactccagcctgggtgacagagcaagactctgggaaaaaaaaaaagaagatatttagcagaaggtacagttaatctgccccttcaagttaaagataatgttcatgatagaaaaaaggaggtaacttctgtttgaaagacactgttgttttgtagatagcattttgaaaacaagtctttggggatgattccactgttatttgattttgttgtgaaggtattataagagatcaaaattttatagtttcatacataaacattttgaaataagattttctaacttgctaaaaaatcttccaaaaaaattcagttaggttctgaacacatttcataatagtggcatttattgaacacatatgtcaggaacttggctaaatgtgttatattaaacacaaagattttaaatcacttgcacagataaatagtaaataaaatggtagagctgagattggaacccacagaaccttctctcttatttgttaatattacctcttattcattatctagtgtctctttgtcctaagtatttgtaatgaaaattgattgacatcagggagagtagatacttgctagctgaatttctggggtaaaagaagcttttcataactggtatgtggaattgaaagtgaatattatgactagataatctgccctgcagacagtcccctcattctccatggcttctgggatggctgtcttccaccttctcttctcagcctgccagcactcccctgtcctcactttcagctaacagccttgcttcctaattttcggaaaaaaactttctgaaattgctaccaccatctgtatggacagaagtggcctctgaactataatcccatttttctggggttaccagagctctgcagttctcaagtccagccctctctccttgaccactagatccagattactcctgctgactcaaggacaggctctaccaatcctcccgcaa

SEQ ID NO: 10385 - DNA, 1108 bp, Homo sapiens
ctatttttggggcgtgcctccctgaaagctgtttttttgtttgttttttaactttccgaatcttccagattccgaagcagaaccaaccccgatttaaaacgtgcagcgtcacactaggtccgctgtagcccagtggggcagaaagtgcgcggcgagttgggggctttatgaaatgcttctttcttagaagaaggacgtttaccaggagtgcttgtcttggagaggagttaaggcaccgttcccccgggaggggtgggacttgagaggtggccggccagaaccgaaagcagcaccatcttagggatttgaacacttcagtggctcagttttcttaagaatctcaagattaaaattaagttcacgtgggaaatgtttaaactgtggatttaaacgcctgtcactgcattgcaccgttttcttattattgcttgctattcactacaattttttttatatacaggtttaaaaaacactactttgcatactgaagtaatggaatgtaaaaaaagaatgctctgtttggaatcttatgttgtgaataggcaaaacagtgtcagtgtattggacaatactttaaaatgacaaacatatacttgcttaagtaagcaatgattacagggttgtgttttaaaaactcaaaaccaaaacattgcaaagtaccatcgaacttttaaagccaaaccatatttgttttgacccagcatacagacaggaaggacataacatttcatttgtcaaagactaaattgtttctatataaagagttttgtagaaagatttccttttaaccgactttaactttctaggacataatattatacactaattattgttcttttatattggtgctactgatgaatggctaatcatttgcaagtatggtgaatccagttacggatagtctattaccaagtttagtttgcatgtctttcaagtgtatatatacagttctgtttttaaaatctcctttcaccctgttaatactggtttaagaaacctttagtattagatagtggtgcacttaaaaataaatggagtactttgttttgcatttcaaggccggattcagaagccagccagagcccacaatacagcttcgagtcattac

SEQ ID NO: 10386 - DNA, 1013 bp, Homo sapiens
agactggcagagggagctagggaactacgtggagaccacacacacacaggtcacttgaactcatatagaaccccaaaggcttctatgtgctggacaacttaagcaaagcgtgactctgggcaccaacccccaagactctatgtcatgccataagctgctgcagctgctgctgtctgccaggccagggaatgagcacggcccaggcactctcactcttatatgccacaaagacaggctacatctgagcatgccccatgcctgctcatccctcccaagactgcctgcctggccattcccatggcttgttggggagggaggagacagggggaacctgaccccacagtgtagccaccattgccccatctgagtgttttgttggcagcctgggggcaatttgctcctccctatcacagctgttacttgagcccaaggggccagtggacaagtctgctgacttggtacttgttccccaggactcaagcacaccatccaggagcatggagatttatgatctgatctcaagcagggtaggagcccccactgtcagaaccacaaagagcatggtgtgggttcacgcagtggcagggaagcatggtggcccgccctccataagactaaaacagaaagggtacggcctaataacaatggtttctgcccccaaggagtcacatggcctgtggctaggcaatttgaatgcagttggcttgggactagcataaccattctgttctgctgctgacagctagatactggagacctaccagctcaggggtgtgggagctgggtgggtcccactgcaatgtggtacagtgaaaaccctgggctgtcccaattcccctgaatgggctctgtagcacaggagaggcacctcccggcctctctggaagattgccccagtggcctggaagctgaccctagacccttgccagccaccttggcagcagagccgggatggggaccactgggaaccccatgggcccactcattgcccaagaattctgatacctctcctg

SEQ ID NO: 10387 - DNA, 1618 bp, Homo sapiens
atgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttttaagtgtgtgattttgcttcatttcattaaactcaagataaatagaaaacactcaaaagggcagattgcaagtggggttgtctgggtaaggagcagcagcaccacctgggaacgtgttagaaaatgcaaattctttggccccaaccatgttgagttggaaattctggggtagagctcagcgatctga

SEQ ID NO: 10388 - DNA, 1033 bp, Homo sapiens
tctttccaatatatgcatttttgctataaatctctctaagcataacttgagttgcatcccacaagtttttaggtcataggttccttatcaaaatatttttaaattaatttttttactttatcaataattgagaaatatgttacttattttctcatcctttgggaattagcgtgtgaagatttctgtagtttttaggtacattgaaggtatgtgaagaagtcagatttgttaacattgttgagaacctgtcatttccttatgaatttcttggggtctgttcttttgcttagagatgttgacaaaagtccaactctataaaaagtatctacttttctccatcaggtctatcgtattttgttttatatatttctcatcttgtatatgaaatatattttcctgttagattaatccatttatgagatgtcttttctttttaaaaaatttctagtgatacttttcaccttaaagacttgcatatgatattaatagagttgttatcttttttttctggccagtagttgtattgtaaaatttcttttctttactcttactttcaatactttttagcatttctatatcttatatttaagttgtattacttataaacagttaaatccagtctcataatctctgtcttttaaatggcctgttgattctgtttgcttttgtttttgaaatggagttttgcactgttgcccaggctggagtgcaatggtacgatctcggctcactgcaacctccgcctcctgggttcaagtgattctcctgcctcagcttcctgagtagctgggattacaggcatgcgccaccatgccctaattttgtatttttagtagagacagggtttcaccatgttgggtcaggctggtcttgaactcttgacctcagatgattcgcctcccttgggcctcccaaagtgctgggattacaggcatgagccaccgtgcctggcctctatttgcttttaatatacctttaatatgatgtatagactggttcttgaacatgagtagaatttcgcagagctgagaat

SEQ ID NO: 10389 - DNA, 1030 bp, Homo sapiens
atatctttttcagttagctttataaagtaattgtccagatggccatttaatttgtgatatgggataaagtaatctaggggaaaaaacacttctttaaaatgactttttttttttgggggggccgggcacactggcttacacctgtaatcccagcactttgcgaggccaagctgggtggatcacctggggtcaggagttcgagagcagcctggccaacatggcaaaaccccgtctctactaaaaaataaaaaaaaaaaaaagctgggtgtggtggcaggcacctgtaatcccagctacttgggaggctgaggcaggagaattgcttaaaccctggaggtggaggttgcagtgagctgagattgtgccactgtactccagcctgggtgacagagtgagactccatctcaaaaaaataaaataaaatgactttttttaaattgtgaagaatataggttaagattatattgcagtagtaacgtaataatatattcaggataaaaaattgaagttagatctgaaatatcaacatcctaaactaagaaaaaccttttaaattaatgtactcttgtttttttcttcttagctaatagtaaataacgatagactcacactcccaggaagggtgaggaagggacaattcagacctctctagactccatgcatggcctggttaaatcacttttttttatcagcatctcatttttccttccagcaagtttatatcctcattgaggaagagtgtcttgccagaagattattgtgataatttttataagatatgtatattcttttctgaatctcagagtaaatattctttgtcttcctaaatgaactggtagaatgtttacattttcattctatttctgtagaatttttttttttttaattgaaacagagtcttgctctgttgcccaggctggagtgcagtggcgcgatctcggctcactgcaacctctgcctcccgggttccagtgattctcctgcctcagcctccctagtagctgggactacaggtgtgtaccaccacgcc

SEQ ID NO: 10390 - DNA, 1114 bp, Homo sapiens
tagatacaatgtgagtacaggcattgggtaaatacacctgttccaaatgggataaattggccagaacaaaggagctgcaggccccatgcaagtctgaaatccagtagggcagtcattaaaccttaaagttccaaaatgatttcctatgactctgtctcatatccagatcgtgctgatgcaagaggtgggctcccatgtccttgagcagctccacccctgtggctttgcagagtacagcccccttcccagatgctgtcactagctggcgttgagtgtctgtggcttttccagacacagtgcaagctgttgatgggtctaccattctgggggctggaggacagtggccctcttctcacagctccactaggcagtgccccagtggggaccctgtgtgagggctccagccccacatttcccttctgcactgccctagcagagtttctccatgaggcctccacacctgcagcaaacttctgcctggacttccaggcatttccatacattctctgaaatccagtcagaggttcccaaacctcaattcttgacttctgtgcacccacaggctcaacactacatggaaaccaccaaggcctggggcttgcaccctctgaagcaatggcctgagctgtactttgaccccttttagccatggctggagctgaagcagctgagacgcagggcactatgtccccaggctgcatagagcagggggcccctgggcctggcccaggaaaccatttttccctcctaggcctccaggcctgtgatgggaggggctgctgtgaaggtatctgacatgccctggagacattttccccattgtcttttggtggttaacatttggctccttgttacttatgcaaattcctgcagccggcttgaatttctcctcagagaatgggttttcttttctgtcacatcatcaggctacatattttccaaactcttacgctctgctacctcttgaatgctttgctgcttagaaatttcttctgccaggtaccctaaatcgtgtctctcgagttctagttccacagatctctagggcaggggcaaaatgccaccaatctctttgctaaagcatagcaagagtgacctttactccagttctcaa

SEQ ID NO: 10391 - DNA, 1030 bp, Homo sapiens
tgtgaactatgaaagggaacatttaacattttaaacgtaaaaaaaattttttttttttttttttgagatagagtctcattctgtcacccaggctggagtacagtggctcgatctcaactcactgaaacctccgccttctgggttcaagcagtctcctgcctcagcctcccaagtagctgagattactggtgtgtgccaccgcacccagctaatttttgtattttaagggttaaagagatggggctgggctgagtaaccagcctgtcatgtaaattctgggaaaacccaggaaacactgaatttgcctgtgggatggtgggagtagggagaagtcatgatgaatgggtgttagaagagataaacagtgagggaaagtacacaaactgaaaaagcacacaaaaatcccaaaaacgaagtgcacaacagcaacaaaactaacaggaaaacaaaacttgggggcatttttaaaatatttggtttttttccttttcaagaacaggaaaaacaaaagatggtgtagaacataaaacataggccaaaaaaagtagacctaggccagaaaaatcaactaccaaactctgggttcctgttgtttttccataatgcagccatctggctcacagtgggttcagtctaaattctagtgtgaataggagaatgaattcaattggcatttaatacttgacattcttttttattgtctttcttttgcattaaatactcctttttcacagagagcaggcaggcttgctctagattcccatgacttccttctttcagactaaaattgatgacttaccccatcatgttgagtaacacaaagatttctcacgaataatttttcccagatgtatgaagttcttaggaagaaactttgagttaagcagtaagtagagttaaacaataattggtactgaacgttaactgcatggctcttcatctctttgtgtgtccgtgttttttaaatacataattttgtttacaatcttattagtgaagtaattcatgcaccagtcttcttggctttgaa

SEQ ID NO: 10392 - DNA, 1048 bp, Homo sapiens
aatattgcagaacagcaaatgttgctgcctgatccttcctctggaagctgggaggtgtctcccagttaggcttctcgggggtcagggacccactttaggaggcagtctgtccgttctcagatctcaaactctgtgctgggagaaccactgctctcttcaaagctgtcagacaagcaagttttaagtctgcagaagtttctactgccctttgttcagctatgtatgccctgctcccagaggtggaatctacagaggcaggcaggcctccttgagctgtggtgggctccacccagttcgagcttcccggccactttgtttacctactcaagcctcagcactggcggacgcccctcccccagcctcgctgcggccttgcagtttgatctcagactgctgtgctagcagtgagcaaggcttcgtgggtgtgggaccctctgagccacgtgcaggatacagtctcctggtgtgccatttgctaagaccattggaaaagcgcagtattagggtgggagtgtcccgattttctaggtactgtctgtcacggcttccctttgctaggaaaggggattccccaaccccttgtgcttcccgggtgatgcagtgccctgccctgcttcggcttacgctctgtgggctgcagccactgtccgacaagccccagtgagatgaacctggtacctcagttggaaatgcagaaatccacctatcttctgcattgctcacactggaagctgtagactggagctgttcctattcggccatcttggaacccgttgctggtaatttttaacatcatccaattttgtttaaaggaatgaaatgtaggaaaataatgcaatattatgctcacttactcagtgaacagctgttagtttggactgcccactccgttagtcactgttttaggcacaaggcatgaagtggtaaataagatgaataagttcctgctctcatgaagataatatccaggtggagagacgtagactataaggaagtaaacaactaaaaagatgattttgggttgtgattaaaaataaataaactgggc

SEQ ID NO: 10393 - DNA, 1024 bp, Homo sapiens
aatatttatggactctaatgagctagcacatcctaggttctaagaatacaaaatggaccaagccttaacttctaggagtttttgttcttttgttttttattttgtggcaaaatatacatgacataaaatacataagtaaccatttttttaaagtgtaaaggtcagtggcagtaagtaccttcatgctgctttgcaacttgctggagtttttattcctgtggggcatcccagtgtttcacttagtttatgttcttggtttactgctgttctttgtttcattatctctgcctttttgactggtgtctggtggtacgtagtcaggacatactttaattctagttttagtaattctacagaaaacgttttcattgagaggaaaaaaagtctagagggattactccaaaatgtaatagtggttatcattgggtagttgtgagagggtcttagttaaaaaatattttattacactattagatagcttttccttttgtcctttattgaatctaattctgcactactgaacttttaaccttgggtagacaaaggaggtagaagaaacataaagacagtaatattagcaatagacaccatttttgaatgcctacaacttataagatactcctcatacatttactaatttaacagtggtgaggtaggtgtcatttctggtttacacatggggaaattgaaactcaagagtggttaggaaatgcccaagatcacatgacactaagtgtcacattcaggatttgaaacccagttgtattctaaaacctatgtctctttatcacactgtctgaagtgtggtgtggccttacttttaaaacatgcttttcactgtgaatgattattaaaaatcaactgaatactttgagggcagctccagagtcagtgggatgatttcaaatgccccttctagcacagggaaattttttgagaaagaagaaaagcattgcctcaaatttttctagaaggagaacagataatacaactattaaaaatgtttttgcacaatgtgttttac

SEQ ID NO: 10394 - DNA, 1024 bp, Homo sapiens
aaaaattaaaaccctactgagaaggtgcagttaaataagaaaatcctattttatccctccattgtatgaaattaggggtgttggttgggtggtgcaagacctagagatgcctgtgagtagaatcggcctctcctgaaatggtccactccactcagaagagcagagtcctcagtggcagaaattggcccatctgtccccaattgtgtgggtaaatgaattttggcaaagctgttgcattcggtggctggtatatagtaagtactatgtaagtgtttgttatgtaagctagatgtttatcttgaaaaacctggtaatacagtcccttttactgacagcttcaagatatgtttcataacaacaggggccaaagtagaacttcctgtggaataatctaccctcctgacaccactacccctactcccgctaggcagaaaaccacatactgccagtattcttagttaaatgttctttcataacaggatatttctttatttttacagcatctgcaaacatagagaattctgggcttccacacaactccagtgctaactcaacaggtgagttttaaaagattaaaaaaacaaattttcatttgtctagggtacatgaagtaataacagccagggaagtaggcataagctggttcactgacctgttttaaccctgagttcttcacccatgaatcccaataacctgccctagtgccctatagtagacatcagtaagtgatagttcactggattaatcttcctcagtcttgtaaagatgtcaataaattctaaaacaaaaagtgtatcggaatttcatgttatgaatttttgaagcacatttttagatgtgagggttttgtagtttgcctgtagatatgaaatgtcagcacagaagtctgcaggtcctattgatgaaacaagtcactgtaaactagtcagccatggcagccttaatatacctctgctgactctaaggagaccctacttacatttcacccattaggcagactcaacccaaacacttggtgaggccc

SEQ ID NO: 10395 - DNA, 1023 bp, Homo sapiens
tcaaaggcttccttccgggcaccgcgaagccagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcgggtaagtggctgcgggggtcgtcagccccgttcgtgggaggcagcgcgctgccgaggcttgggttcccaagttgggctctggtacagaaagttccgcgtgtgtctggccgaacgctcggggcggacccagaggtgaccgggcggggtgggggaaactgaggtttggaccagtcacccgctggccccggggccgcctgctgaggaaattgcctggtgcttcccctctcgctttttggatgcggcggtcgcaggccgggacgggtgcgcataacctgttgagttaccgcaagttggtttttacagcctttccctgaagttaatgtttgccgaggttagagtttctaaggcttccgtttgtaaacaagattagctgagttgaaaaatatgtctacctaggcccgcggaaacgtctcccagttagtcggggagcttttcaagcgtcccccaggcatttcagcgtctaatattatgcagtattatccagatgaattacaatcttta

SEQ ID NO: 10396 - DNA, 1028 bp, Homo sapiens
cagttgttattggtgtgaccattttctttttaggatcgatgaaacattttgctgtgtatgctgtgtcatgtattagaacctcttataatatggctcatttttacatggtttctgatttaccatgtgttaaatattccttaaaatacatctagtaacactatatagtaaggttagattttaacctaagtattgaatcttgtcttataatgccaattttattggagctttgttgcatttatttttggctctatggtccataaatgggagttaatagcaaacgttttattaaaaatgtcttagctttcccccaaattatatcattttttagaagttttatccttctggggtgtttttggctttctgagctttaagatattaatgaattttttccacatacttcatgggtttggttttaagtatgaggttaaaattgtggattttaaaaagctaataaatacttgaagtgaatatatagagagagccagatttccccaaaactctgtgagctgtgtgtgttttgtgtagaatattagccataattaacttttccctttttttttttggagacagggtcttactctgtcacccaggatggagtgcagtggtgcggtctcagctcactgcagcctcgacctcctgggttcaagagattctcgtgcgtcaacctcccaagtagctgggattacagatgcctgccaccatgcccagctaagttttgtatttttttttttgtttgttttagtaaagatgggatttcaccatgttggccaggctggtctcaaactcctgccctcaagtgatcccacccacctcagactcccaaagtgctgggattacaggtgtgagccaccactcctgggaaataattaactttttcacatagaaaatagatcacagataaaagctcctcacatattttgaaggtcaaaaaaaaatttgctgttgctaacaattgcctttgaaccatgaaagaggaaaaactaactttatttgagcaacttgtcatttgagacttaaactaacttatc

SEQ ID NO: 10397 - DNA, 1050 bp, Homo sapiens
actttcccaaaatcactcaattaagtggcaagggtgggatttaaatcgaagcctatactctttcacttgtttccaaagatgccaaactcaaaatgtggctaaacagtaaatcttgagcaaagaaatgatttactaggaagcagcacaatagaacatactggatgtaggaaatgttatatatcttgatctcattggtggtaacacaagtatatacatatgaaaaagttagttttatccttactgttagtactcagtgctcttattattcctcaaaaatgaaaaaaaaagtaaaaaatagattatgttaatatgtaaatgcccatgaggaatctcttagaaacacaaataattaaaaaaatagtaaatgttttagaaaaaaccaaatcacaaaaacagttaaaacttagtttactaaattgagtaaatgatgtttgtttaaatatttaaatacaaatatttaaatcatttttgcagcaatcaaagtatcgtgttatgaacaaagatcaatggtacaatgtattagaattcagcagaacagtccatgctgatcttagtaactatgatgaagatggtgcttgtaagtataacataacatgttcctttgaaaacaaaatttccaaaaatattaaatgagagtatgcatttgtgtagtattagcatagaggttttaaactttgtaatagtaacttatttaattgtgtgagggattgtgggagaagtagagagagagcttagattcagcagtattatataaaatctatgctggtaaatgaaatgttttcagttcctcggcaaccaaacattttagctaaatttaaattataatttttgcatccagaagctaaaattcagctttgtttctgtctttcctggcatttgcctatggaagaaaagtacagtcatgattttaaaaatataacagcaaaacaatcagccacaatagaaaaagctttaacattattgtaatattatgctacccattaacaatatggcaaataatgtcagtataacttctctctgaaaactataaattgattgtgagctaactga

SEQ ID NO: 10398 - DNA, 1052 bp, Homo sapiens
gatgaataatatttttatcagcatgtttgagatttcaagtggaaataatgggtgctgaagtatggcagtggcatttgggaatggtaagtgatataattagagcatggtaaggttatcaggaagtggcaggagatgaaactagagatttgtgccaaattgtgaaaggccttgactgccttgcttcttgctaaacagtggaatttatcaacccactgagacaaagtcagttaagatttttgagccttccatatatttagctgcttatatttaatgtcttgtctttaaaaataacacgtatgacttgttgtttgcatgcttttgcatatataacttatttgaagttaggtgcttctactgattgactttgactttttgttcacaaaaatatagggatcttgatttatgactggaccacttaatgtattaatttgcactgtgttatatcctaaacttttaaaactactcatgactaatgtctttcaccaaactgttacctacgaactttctaaagaaatgtgtgacaaaggcgtgattagtttcatttgctctgccatttttagctgtatatgtgataaaacatgttttaatacatctctttttaacttcgattttatttggaatttttgaatgagctgtttgtttgtttttaagcaaagtaattggagtgaactttctttgattcccaggttttcttttttccccttttttctttttttattgcattggtagatgcagggcaagaaatttattactctaaatttgtgactcagaattttaaaactaaattaacttcataaatgcgctcacttttttcttaatgcattacgtctaacccccagtgatacttttatttgattttcttgattatgtaatttgtttgatatttcttttatttaaggtgtgactgcacagaaaagttacaaaacaaatttgactttttgcgctcacagttgaatgatatttcgtcatttaagaatatctacagatatgcctttgattttgcaagggtaggtgcaattttcttgttttgttgttttaatagcttttcatct

SEQ ID NO: 10399 - DNA, 1032 bp, Homo sapiens
ccttggattttctacatagtcatgtcatctagaaatagggacagtttatttctcttttctgatctatatatcttttatttcttttattattatacttcaagttctagggtacatgtgcacaacgtgcaggtttgttacatatgtatacatgtgccatgttggtgctgcacccgttagctcgtcgtttatgttaggtatatctcctaatgctatccctcccccctccccccaccccccgacaggccccggtgtgtgatgttccccaccctgtgtccaagtgttctcattgttcagttcccacctatgagtgagaacatgcagtgtttggttttctgtcctgtgatagtttgctcagaatgatggtttctagcttcatccctgtccctacaaaggacatgaactcatccttttttatggctggatagtattccatggtgtgtatgtgccacattttcttaatccagtctatcattgatggacatttgggatggttccaagtctttactattgtgaatagtgccacagtaaacatacgtgtgcatatgtctttatagcagcatgatttataatcctttgggtatatgcccagtaatgggatggctgggtcaaatggtatttctagttctagttctagatctagatctagatctagatctagttctagatccttgaggaatcaccacactgtcttccacaatggttgaactagtttacagtcccaccaacagtgtaaaatcattcctatttctccacatcctctcctatttcttttttttgacttattacatgagctagaacttctaccactatgtcgataagagtggaaagagtaggcatcttttccttgttccccatcttagagagaaaacgttggctttcactgttatgttacctgtaagttacttatttatgctctacgaagttgaggacactcccctctatttttttttttctgagttttatcatgaatggatgttaaatttttaaagtgctttttctgtattaaatgataaaattatgtggctttttttt

SEQ ID NO: 10400 - DNA, 1058 bp, Homo sapiens
aataagatgcagcttttgtcctttagtcatattctactaggtcagggaaaacattacaatactgtaacccagccaacctttttggcaccagggatcagtttcgtagaagacagttttaccatggatggggctggggagaagggaaggatggctttgggatgaaactgttccacctcagattatcaggcattagattctcataaggcgcatgcaacctagatccctcgcacgcacagttcacaatagggttcgcattcctgtgagaatcgaatgccgctgctgttctgacaggaggtggatatgctggctcactcgcctgccgcttgcctcctgctatacagcctggtttctaacaggccacaggctggtaattatgctcagcccagacattgggcaccttgctgtaaccataaaccaaggagaacgtgacatgtgctagagtggaaatacaagatactatgaaagcacagatgagtaaggttaatttcagctgagtaggtaggtaaatgtaggtgtggcctgtgaactagaacatgaagaatgattaggattttgtttgttgaggatacaggaaaatgtttcagaagagggaaattgtgagcaggaccttgaggaaggaaagcatatgtttgaaggaagtagtttgatttcttaaaattgtaaagtacataaaaaaattgccaggataggttttgaattctaatattttgagtgatggcttcactgtagagtgctttagctaatacgttgagagagtttaaatctatgttacagatattgggaaaccatcagagattttaaagcacaggaattttaaaagatttgggggataattttcaatgagcaattgtttttaatattttaaagtcacagtctcttttgagagtcttatgagaactatggacctcgttcccattaagaggcacatgtactgctagacacaaaaatttgatgtgctctcaggaggttatggaatttctcttccttcgtctatagatacgaggtttcaaggatacttggcgagtttttgttctggcatagtgtactagagtggaggt

SEQ ID NO: 10401 - DNA, 1065 bp, Homo sapiens
cagtccggggaaagcacattagttacagacctcgctttagacttagatctgttactatttacatcactttggcaaagtcagttaacatttacagaccttatctaagttataaggtattatatctctatgtaatctcatttgacttgcttctaaccaaattttaattagtaatcaccaagtaatcctccagtttctaggggggctatactgatatttcttttttattttttatattttttgagacagagtctcgctctgtcacctacgctggagtgcagtggcgcaatctcggctcactgcaacctctgccacctaggttaagtgattctcctgcctcagcctcctgcgtagctgggattacaggcacctgccaccacgtctggctaatttttgtagttttagtagagacagggtttcaccatcttggccaggctggtcttgaaatcctgacctcgtaatccatctgcctcggcctcccaaagtgctgagattacaggcgtgagccactgctcctagcttatgctgatgtttctagacatcctctaaagctttctctttgaatcactaatggcaactttgagagcaagtatgttttcttgatgctttagaaaaatttacaatatatttacatcgtggcttttaaaaaaaccgtttgtcttttcccttaattttttattttttatttttttttgagacagggccttgctctctcccaggctggagtacaatggcgtgatcatggctcattgcagcctcaaactcctgggctcaagcaatgctcccacctcagtctcctgagtagctgggaccacagactggcaccaccacacaaggctattttttttttccctagagatggggtctccctgtgttgtgcaggtttgtctggaactcttgggctcaagtgataatcccacctcggcctcccaaagtgccaagattacaggcatgagccaccgcgcctgggcctcttaaattttcaaatctgatttttgttttctttcaatcatatataagaatacatactcatttatgcattttaacacctttattgtatatgtatgc

SEQ ID NO: 10402 - DNA, 1020 bp, Homo sapiens
gactcagacataaaaagccctcttttttctctctgtagaggacacactgtaccaatcctcttttcacttcatttagtcccagttagtgtagaattagtggggaagactaagagtaactcatagggattttcagccacattggtatgcatagacaataataccgtcagcaccattatcttttaattcaaagagcatggcatagaattcagagcatgtacaaaacgtataaatttatagagtttcattgctctgctcagaaatgtaagtttatagtatgcataaatgccattaaatcatattttcagccttctttatatctttaccattaataattcattcatggatgtggttttatatatatatatctatgcaaagattaatttttcacctattctgtatcactatagatgtattggtaaaactagacagaacatttgtaaaaggcattgccaatagagattgaaagtagctctggccaggcgcggtggctcacgcctataatcccagcactttgggaggctgaggcaggtggataatgaggtcgggagtttgagaccagcctgaccaacatagtgaaaccccatctctactaaaaatacaaaaaattagctgagcgtggcggcaggcacctgtaattccagctacttgggaggctgaggcaggagaatcacttgaacccgggagccggaggttgcagtgagccgagatcttaccactgcactccagtccaggcaacagtgtgagactctgtctcgaaaaagaaaaagaaagaaaagaaaagaaaagaaattggcccttagtctagaattagcatatgtgttaaaaaaattcagggtaagaacctgataattttaaaagggaggtggagaggaggcttattgcattttcataagtctttcttgagtaaatactatcacctacatgttgtggtgaggtgattaagatactgtgacagactcttttttttacctgccttggtagtggagcctgaatcattcagagtagctaacatgtctactt

SEQ ID NO: 10403 - DNA, 1028 bp, Homo sapiens
aatatagttgtatttaaatctatcatcttgctagttattttctatttgtccatcagtttctttgctcctttttccttttcatcctttctttcaagttttactttatgattccattttatctccagtaataactcataagttatgccttttataatagaatttttttgttgtgttttccctagggtttataatatacttctactcatcaaatttactttaaataatattatgtcattttatgtagtgcaagaatcttaaaatagtgtaatttcaattcttcccattttttatgcaattgttatcaattttacttttacatatgtgttagacccacgcagatcctcattacatggcaggttataagatgccactcttttagactaacagcagcacatctgtctgatttcttgtttcgaacctctagaattccttttaaaaactcaccttattaggtcaggcccacctaggataatctccctttaggtaaactaaactgattaaggacctcaatatctgaaaaaaatcttttctcatacagcatatcataatcacaggtgtgatacgctctcatgttcacaaacctcattcacactcaagaagagaagaagggcttgcatcattagaggtcatctcagaattctgatgaaagcatttgttaaaagtccctgtgttatagtttcaacatctgggtctctaagtatgattctacttattgctttatttcttgacaatgagttattgttttgttggttttcttttctttttctttttctttttcttttttttctgagatggagtctcactctaccgcccaggttggagtgcagtggcgtgatctcggctcactgcaacctccgcctcctgggttcaagtgattctcctgcctcagcctcctaagtagctgggattacatggatgcgccaccaagccctgctaattttcgtatttttagtacagatggggtttcagcatgttggtcagaatggtcttgaacttctgacctcgtgatccgcccacctcggcctccc

SEQ ID NO: 10404 - DNA, 1050 bp, Homo sapiens
ggcactaaccattcactctgcctgcaagacactttctctcatgtatctgtatgatttacttctacacttctttcaagtctttgttaaaatgtcaccctctcaatgaggctgattttgaccactctatttaatatttcaaactgtccctctccccaccagtcccaatcccttttatcttgctcttctttttattccagaacattgtcaattctaatgtgtcacgtaatttacttatgtattatattaccatgtattgtctgtcttctcttgctatactataagcttcacaaaaataaggatctttaattgtgttgttcattgctttatctcaagcgctgaaaagagtgcctggcccatcatacattattaactcatttattgaataaatgagttaagtagcttccatctaacaatattttatttcacttggatctcaacatttttttaaaaaaaaactttaagaaatacatgtgtttctttttctcctccagtagttctatttgacaagacgtgttatgattgttcaatctgattctctgccttctggaactcctcagataggcagttgtttttttctctgatgattcagtgacgctctgaccttgtttctagttttatttcttctccttctcctcctcctcctcctccttcttctcctcctccttcctcttcctcttcctcttgttgtcttcttcttctccttcttcctcctcaccttcctcctcctcttccccttccttttcctcttccccttccccctcctcctcttcttctgcttctgcttctcctcctcctcctccttctccttctcctgctcctcctttttttaaagggacagggtctcattctgttgtccaggctggagtgcagtggtgtgatcttcgctcactgcagccttgacttcctgggcacaatcttccctcttcagccttcaaaatagctgggactacaggcatgcatcactacatctggctaatttttaaagttttgttatatagagacaaagtcttgctatcttgcttaggctggtcttgatctccttgtctcaag
